United States Patent 7,989,676 (NUCLEOTIDE SEQUENCES AND CORRESPONDING POLYPEPTIDES CONFERRING MODULATED PLANT CHARACTERISTICS) - sequence listing, part 2

SEQ ID NO: 1935 - protein, 304 aa, Populus balsamifera subsp. trichocarpa
  misc_feature (1)..(304): Ceres ANNOT ID no. 1450499
  misc_feature (1)..(237): Pfam Name: TRAP_alpha Pfam Description: Translocon-associated protein (TRAP) alpha subunit
  misc_feature: SWISSPROT Homolog: SSRA_ARATH Translocon-associated protein alpha subunit precursor (TRAP-alpha) (Signal sequence receptor alpha subunit) (SSR-alpha) with e-value of 1.6e-132 and BLAST sequence identity of 99.6
  misc_feature: SWISSPROT Homolog: SSRA_RAT Translocon-associated protein alpha subunit precursor with e-value of 4.0e-24 and BLAST sequence identity of 31.7
  misc_feature: SWISSPROT Homolog: SSRA_RAT TRAP-alpha Signal sequence receptor alpha subunit (SSR-alpha) Liver regeneration-related protein LRRG137
  misc_feature: SWISSPROT Homolog: SSRA_MOUSE Translocon-associated protein alpha subunit precursor (TRAP-alpha) (Signal sequence receptor alpha subunit) (SSR-alpha) with e-value of 2.2e-23 and BLAST sequence identity of 30.9
  misc_feature: SWISSPROT Homolog: SSRA_PONPY Translocon-associated protein alpha subunit precursor (TRAP-alpha) (Signal sequence receptor alpha subunit) (SSR-alpha) with e-value of 5.8e-23 and BLAST sequence identity of 30.7
  misc_feature: SWISSPROT Homolog: SSRA_CANFA Translocon-associated protein alpha subunit precursor (TRAP-alpha) (Signal sequence receptor alpha subunit) (SSR-alpha) (PGP35) with e-value of 1.2e-22 and BLAST sequence identity of 30.3
  misc_feature 216070:<222: Transcription Factor
  misc_feature: Phenotype: INFLORESCENCE - Late Flowering Useful for modulating flowering time
  misc_feature: Phenotype: WHOLE PLANT - Bushy Rosette Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(304): Functional Homolog of  Ceres CLONE ID no. 40766 at SEQ ID NO. 1977 with e-value of 2.20E-77 and BLAST sequence identity of 65.9
MKHLRVFFFALLLLASPLLQVATCQSDSDAEVAETAEEVSDLGIVGEDAQDFGDANFSPAPGVETVCVFPKNSARLVTAGEETELLVGMKNDGELPITIIAIRASVHLPFDHKLLVQNLSAQGFNNATVPASAQATFPYIFGVSKYLQPGSFDLVGTIVYEIDQHPYQSTFHNGTIEVVDSGVFLSMESVFLITLGIALLVLFGLWVNGQIQNLSKKTKRAPKVEVGTGTRDASMDEWLEVCGFSIVLPPILLPLLEKFPSLIYSIIGNSIGQVTIPEVKEEEVNSGAYPVSAAQGTVEECKLL

SEQ ID NO: 1936 - protein, 146 aa, Arabidopsis thaliana
  misc_feature (1)..(146): Ceres CLONE ID no. 40781
  misc_feature (39)..(143): Pfam Name: FeThRed_B Pfam Description: Ferredoxin thioredoxin reductase catalytic beta chain
  misc_feature: Utility: pH (high) Useful for making plants tolerant to high pH or low phosphate
  misc_feature: Phenotype: WHOLE PLANT - pH (high) Useful for making plants tolerant to high pH or low phosphate
MNLQAVSCSFGFLSSPLGVTPRTSFRRFVIRAKTEPSEKSVEIMRKFSEQYARRSGTYFCVDKGVTSVVIKGLAEHKDSYGAPLCPCRHYDDKAAEVGQGFWNCPCVPMRERKECHCMLFLTPDNDFAGKDQTITSDEIKETTANM

SEQ ID NO: 1937 - DNA, 513 bp, Populus balsamifera subsp. trichocarpa
  misc_feature (1)..(513): Ceres ANNOT ID no. 1440480
  misc_feature: Utility: pH (high) Useful for making plants tolerant to high pH or low phosphate
  misc_feature 216255:<222: Transcription Factor
  misc_feature: Phenotype: WHOLE PLANT - pH (high) Useful for making plants tolerant to high pH or low phosphate
atgaattggagctgctccaccgccaccacttgtggcatttcttcttcctcctcctgcttttcttgcccgcccaaaaccccttctttccgctccgtaattcgagcatctaaagtggaaccgtcggataagtcggtggagataatgaggaagttctcggagcagtatgctcgtaaatccggaacttatttctgcgtcgataaaggagtcacttctgttgtcattaaggggttggctgaccataaggattcactgggtgcacctctttgcccctgcaggcattatgatgacaaagctgcagaggctgggcagggcttttggaactgtccatgtgttcccatgagagagagagatccccaacccaagagccacacaggtatgagcttgattccactactctttctcaattatgaggaggttgaagaggagtacaaaaactggattagggtggatgacaaggatacacccatctcctgtcatgttgagtggatgattattggcggaaactttgcttaa

SEQ ID NO: 1938 - protein, 170 aa, Populus balsamifera subsp. trichocarpa
  misc_feature (1)..(170): Ceres ANNOT ID no. 1440480
  misc_feature (43)..(116): Pfam Name: FeThRed_B Pfam Description: Ferredoxin thioredoxin reductase catalytic beta chain
  misc_feature: SWISSPROT Homolog: FTRC_SOYBN Ferredoxin-thioredoxin reductase catalytic chain, chloroplast precursor (EC 1.18.-.-) (FTR-C) with e-value of 1.1e-58 and BLAST sequence identity of 85.9
  misc_feature: SWISSPROT Homolog: FTRC2_SPIOL Ferredoxin-thioredoxin reductase catalytic chain, chloroplast precursor with e-value of 2.1e-57 and BLAST sequence identity of 78.1
  misc_feature: SWISSPROT Homolog: FTRC2_SPIOL EC 1.18.-.-) (FTR-C) (Ferredoxin-thioredoxin reductase subunit B)( FTR-B) (B1) with e-value of 2.1e-57 and BLAST sequence identity of 78.1
  misc_feature: SWISSPROT Homolog: FTRC1_SPIOL Ferredoxin-thioredoxin reductase catalytic chain, chloroplast precursor with e-value of 9.5e-55 and BLAST sequence identity of 73.1
  misc_feature: SWISSPROT Homolog: FTRC1_SPIOL EC 1.18.-.-) (FTR-C) (Ferredoxin-thioredoxin reductase subunit B)( FTR-B) (B2)
  misc_feature: SWISSPROT Homolog: FTRC_MAIZE Ferredoxin-thioredoxin reductase catalytic chain, chloroplast precursor with e-value of 4.8e-51 and BLAST sequence identity of 69.2
  misc_feature: SWISSPROT Homolog: FTRC_MAIZE EC 1.18.-.-) (FTR-C) (Ferredoxin-thioredoxin reductase subunit B) FTR-B)
  misc_feature: SWISSPROT Homolog: FTRC_PORPU Ferredoxin-thioredoxin reductase, catalytic chain chloroplast precursor with e-value of 1.5e-38 and BLAST sequence identity of 66.0
  misc_feature: SWISSPROT Homolog: FTRC_PORPU EC 1.18.-.- (FTR-C) Ferredoxin-thioredoxin reductase subunit B FTR-B
  misc_feature: Utility: pH (high) Useful for making plants tolerant to high pH or low phosphate
  misc_feature 216384:<222: Transcription Factor
  misc_feature: Phenotype: WHOLE PLANT - pH (high) Useful for making plants tolerant to high pH or low phosphate
  misc_feature (1)..(170): Functional Homolog of  Ceres CLONE ID no. 40781 at SEQ ID NO. 1980 with e-value of 1.30E-42 and BLAST sequence identity of 78.7
MNWSCSTATTCGISSSSSCFSCPPKTPSFRSVIRASKVEPSDKSVEIMRKFSEQYARKSGTYFCVDKGVTSVVIKGLADHKDSLGAPLCPCRHYDDKAAEAGQGFWNCPCVPMRERDPQPKSHTGMSLIPLLFLNYEEVEEEYKNWIRVDDKDTPISCHVEWMIIGGNFA

SEQ ID NO: 1939 - protein, 351 aa, Arabidopsis thaliana
  misc_feature (1)..(351): Ceres CLONE ID no. 40824
  misc_feature (161)..(308): Pfam Name: ADH_zinc_N Pfam Description: Zinc-binding dehydrogenase
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
MTNAEAVTVTNKQIIFPDYVTGFPKESDLKITTTTIDLRLPEGSTSVLVKNLYLSCDPYMRICMGKPDPLSSSLVPPYKTGVPIIGLGVSKVIDSGHPDYKKGDLLWGLVGWEEYSVITLTTYSHFKIEHTDVPLSYYTGLLGMPGMTAYAGFYEVCSPKKGETVFVSAASGAVGQLVGQFAKLMGCYVVGSAGSKEKVDLLKTKFGFDDAFNYKEEKDFSAALKRYFPEGIDIYFENVGGKMLDAVLINMKLHGRVAVCGMISQYNLVDPEGVHNLPTILYKRIQLQGFGVCDFYDKYPKFLDFVLPYIREGKITYVEDIAEGFESGPSALLGLFEGKNVGKQLFVVARE

SEQ ID NO: 1940 - DNA, 1047 bp, Populus balsamifera subsp. trichocarpa
  misc_feature (1)..(1047): Ceres ANNOT ID no. 1509015
  misc_feature 216579:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggcaggtagaggtgaaacagtgagcaacaagcatgtgttattcaagaactatgtgtctggtttccccaaagaatcagacatgtatgttgccactactaccactgaactcaaagtaccagatggttgtaataatggggttcttgttaagaatctctatctttcttgtgacccgtatatgataattttgatgaagaagtccatagaccaaaggactttcacttcgtataccccaggctctccattacgtgggtatggagtggcgaaagtgttggattctaggcacccgggctttaaagaaggcgactttgtttgggggacagtaggctgggaagagtacagccttatcacttcattccaacccttctttaaaattcaggatactgatgtgcccctttcatactatacaggaattcttggcatgcctggtatgactgcttattttggtttctatcaagtttgttctccaaagaaaggggagcacgtctacatttcagcagcttctggtgctgttggtcagcttgttgggcaatttgcaaagttaatgggttgttatgttgttggaagtgccggaagtaaagaaaaggttgatttattgaagaacaaatttgggtttgacgaagcttttaattacaaagaggagcctgacttaaatgctgctctgggaagatacttccctgaaggcattgacatatattttgaaaatgttgggggcaagatgcttgacgccgtgcttccaaacatgagatttcgtggccgcattgcggtatgtggaatgatctcccaatacaatcttgacaaacctgaaggtgtatttaatttaatgactgtcgtttacaagcgggtacgcatagaaggatttgtggttacagattattatgatcaatatcccaagttcctagactttgtattgccttgcataagagagggaaagataaagtacatggaagacatttctgaaggactcgagaatggccctgcagcactggtaggccttttcagtggacaaaatgttgggaaaaagctggttgtagttgctcgtgagtga

SEQ ID NO: 1941 - protein, 348 aa, Populus balsamifera subsp. trichocarpa
  misc_feature (1)..(348): Ceres ANNOT ID no. 1509015
  misc_feature (158)..(305): Pfam Name: ADH_zinc_N Pfam Description: Zinc-binding dehydrogenase
  misc_feature: SWISSPROT Homolog: P1_ARATH Probable NADP-dependent oxidoreductase P1 (EC 1.3.1.74) with e-value of 9.3e-151 and BLAST sequence identity of 78.6
  misc_feature: SWISSPROT Homolog: P2_ARATH Probable NADP-dependent oxidoreductase P2 (EC 1.3.1.74) with e-value of 1.2e-150 and BLAST sequence identity of 80.1
  misc_feature: SWISSPROT Homolog: LTB4D_MOUSE NADP-dependent leukotriene B4 12-hydroxydehydrogenase(EC 1.3.1.74) 15-oxoprostaglandin 13-reductase (EC 1.3.1.48) with e-value of 4.8e-60 and BLAST sequence identity of 41.0
  misc_feature: SWISSPROT Homolog: LTB4D_RAT NADP-dependent leukotriene B4 12-hydroxydehydrogenase with e-value of 1.3e-59 and BLAST sequence identity of 41.6
  misc_feature: SWISSPROT Homolog: LTB4D_RAT EC 1.3.1.74 (15-oxoprostaglandin 13-reductase) EC 1.3.1.48 (Dithiolethione-inducible gene 1 protein) ( D3T-inducible gene 1 protein) (DIG-1)
  misc_feature: SWISSPROT Homolog: YNCB_ECOLI Putative NADP-dependent oxidoreductase yncB (EC 1.-.-.-) with e-value of 2.4e-58 and BLAST sequence identity of 39.7
  misc_feature 216729:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(348): Functional Homolog of  Ceres CLONE ID no. 40824 at SEQ ID NO. 1983 with e-value of 2.19E-132 and BLAST sequence identity of 71.5
MAGRGETVSNKHVLFKNYVSGFPKESDMYVATTTTELKVPDGCNNGVLVKNLYLSCDPYMIILMKKSIDQRTFTSYTPGSPLRGYGVAKVLDSRHPGFKEGDFVWGTVGWEEYSLITSFQPFFKIQDTDVPLSYYTGILGMPGMTAYFGFYQVCSPKKGEHVYISAASGAVGQLVGQFAKLMGCYVVGSAGSKEKVDLLKNKFGFDEAFNYKEEPDLNAALGRYFPEGIDIYFENVGGKMLDAVLPNMRFRGRIAVCGMISQYNLDKPEGVFNLMTVVYKRVRIEGFVVTDYYDQYPKFLDFVLPCIREGKIKYMEDISEGLENGPAALVGLFSGQNVGKKLVVVARE

SEQ ID NO: 1942 - DNA, 1047 bp, Populus balsamifera subsp. trichocarpa
  misc_feature (1)..(1047): Ceres ANNOT ID no. 1535964
  misc_feature 216863:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggagagtgatgatggtgaagtggtgagcaacaagcaagtgatcttcaaggactacgtgtctggtgctcttaaagagtcagacatgtacatcactactagtactatcagactcaaggtcccagaagattgtactaatggtgttcttgtaaaaaatctttacttgtcttgtgatccttacatgagaatccaaatgagaaactttcagggctcttatttttctccctttaagcctggttcgcctataagtgggcgtggagtggctaaagttttggattcaaggcatccggattataaaaagggagacttcatttggggaatcactggatgggaagagtacagtctgattacagcaacagagacactatttaaaatccatgacaaagatgtgcccctttcctattatactggaattctcggaatgccgggtatgactgcttatgctggcttctatgaaatatgctctccaaagaaaggggagtttgttttcatatcagcagcctctggtgcggttggtcagcttgttgggcagtttgcaaagttgttaggttgctatgttgttggaagtgctggaagcaaagacaaggttgatttgttgaagaataagtttggctttgatgatgctttcaactacaaagaagagctggacttggatgcagctttgaaaaggtactttcctgatggcattgatatttactttgaaaatgttggaggaaaaattcttgatgcagtactactcaacatgagggtccgtgggcgaatttctgtttgtggaatggtctcacaatacaatctcgagcagccggaaggtgttcataacttgatgcatcttgtgctgaaacgcattcatatggagggtttcttggtctattatttctttcaccttttcccaaaatatctagacatggttctgccttacatcaaacaaggaaagattgtgtatgttgaagacatagcagaaggccttgaaaatgctccagcggctctaactggactcttcgccggtcgcaatattggaaaacaagtggttgcagtttctcgtgaatga

SEQ ID NO: 1943 - protein, 348 aa, Populus balsamifera subsp. trichocarpa
  misc_feature (1)..(348): Ceres ANNOT ID no. 1535964
  misc_feature (158)..(305): Pfam Name: ADH_zinc_N Pfam Description: Zinc-binding dehydrogenase
  misc_feature: SWISSPROT Homolog: P1_ARATH Probable NADP-dependent oxidoreductase P1 (EC 1.3.1.74) with e-value of 9.3e-151 and BLAST sequence identity of 78.6
  misc_feature: SWISSPROT Homolog: P2_ARATH Probable NADP-dependent oxidoreductase P2 (EC 1.3.1.74) with e-value of 1.2e-150 and BLAST sequence identity of 80.1
  misc_feature: SWISSPROT Homolog: LTB4D_MOUSE NADP-dependent leukotriene B4 12-hydroxydehydrogenase(EC 1.3.1.74) (15-oxoprostaglandin 13-reductase) (EC 1.3.1.48) with e-value of 4.8e-60 and BLAST sequence identity of 41.0
  misc_feature: SWISSPROT Homolog: LTB4D_RAT NADP-dependent leukotriene B4 12-hydroxydehydrogenase with e-value of 1.3e-59 and BLAST sequence identity of 41.6
  misc_feature: SWISSPROT Homolog: LTB4D_RAT EC 1.3.1.74 (15-oxoprostaglandin 13-reductase) EC 1.3.1.48 (Dithiolethione-inducible gene 1 protein) ( D3T-inducible gene 1 protein) (DIG-1)
  misc_feature: SWISSPROT Homolog: YNCB_ECOLI Putative NADP-dependent oxidoreductase yncB (EC 1.-.-.-) with e-value of 2.4e-58 and BLAST sequence identity of 39.7
  misc_feature 217013:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(348): Functional Homolog of  Ceres CLONE ID no. 40824 at SEQ ID NO. 1983 with e-value of 6.70E-131 and BLAST sequence identity of 70.0
MESDDGEVVSNKQVIFKDYVSGALKESDMYITTSTIRLKVPEDCTNGVLVKNLYLSCDPYMRIQMRNFQGSYFSPFKPGSPISGRGVAKVLDSRHPDYKKGDFIWGITGWEEYSLITATETLFKIHDKDVPLSYYTGILGMPGMTAYAGFYEICSPKKGEFVFISAASGAVGQLVGQFAKLLGCYVVGSAGSKDKVDLLKNKFGFDDAFNYKEELDLDAALKRYFPDGIDIYFENVGGKILDAVLLNMRVRGRISVCGMVSQYNLEQPEGVHNLMHLVLKRIHMEGFLVYYFFHLFPKYLDMVLPYIKQGKIVYVEDIAEGLENAPAALTGLFAGRNIGKQVVAVSRE

SEQ ID NO: 1944 - DNA, 1047 bp, Populus balsamifera subsp. trichocarpa
  misc_feature (1)..(1047): Ceres ANNOT ID no. 1535962
  misc_feature 217147:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggagagtgatgatggtgaagtggtgagcaacaagcaagtgatcttcaaggactacgtgcctggtgttcttaaagagtcagacatgtacatcactactagtactatcaaactcaaggtcccagaagattgtactaacggtgttcttgtgaaaaatctttacttgtcttgtgatccttacatgagaaaccgaatgagaaactttcagggctcttatatttctcccttgaagcctggttcgcctataagtgggcgtggagtggctaaagttttggattcaaggcatccggattataaaaagggggacttcatttggggaatgactggatgggaagagtacagtctgattacagcaacagagacactatttaaaatccatgacaaagatgtgcccctttcctattatactggaattcttggaatgccgggtttgactgcttatgctggcttctatgaaatatgctctcctaagaaaggggagtttgttttcatatcagcagcctctggtgcagttggtcaacttgttgggcagtttgcaaagttgttaggttgctatgttgttggaagtgctggaagcaaagacaaggttgatttgttgaagaataagtttggctttgatgatgctttcaactacaaagaagagctggacttggatgcagctttgaaaaggtactttcctgatggcattgatatttactttgaaaatgttggaggaaaaatgcttgatgcagtagtactcaacatgagggtccgtgggcgaatttctgtttgtggaatggtctcacagtacaatctcgagcagccggaaggtgttcataacttgatgcatcttgtgccgaaacgcattcatatggagggtttcttggtctatgatttctttcacctgttcccaaaatatctagacatggttctgccttacatcaaacaaggaaagattgtgtatgtggaagacatagcagaaggccttgaaaatgctccggcagctctaactggactcttcgcaggccgcaatattggaaaacaggtggttgcagtttctcatgaatga

SEQ ID NO: 1945 - protein, 348 aa, Populus balsamifera subsp. trichocarpa
  misc_feature (1)..(348): Ceres ANNOT ID no. 1535962
  misc_feature (158)..(305): Pfam Name: ADH_zinc_N Pfam Description: Zinc-binding dehydrogenase
  misc_feature: SWISSPROT Homolog: P1_ARATH Probable NADP-dependent oxidoreductase P1 (EC 1.3.1.74) with e-value of 9.3e-151 and BLAST sequence identity of 78.6
  misc_feature: SWISSPROT Homolog: P2_ARATH Probable NADP-dependent oxidoreductase P2 (EC 1.3.1.74) with e-value of 1.2e-150 and BLAST sequence identity of 80.1
  misc_feature: SWISSPROT Homolog: LTB4D_MOUSE NADP-dependent leukotriene B4 12-hydroxydehydrogenase(EC 1.3.1.74) (15-oxoprostaglandin 13-reductase) (EC 1.3.1.48) with e-value of 4.8e-60 and BLAST sequence identity of 41.0
  misc_feature: SWISSPROT Homolog: LTB4D_RAT NADP-dependent leukotriene B4 12-hydroxydehydrogenase with e-value of 1.3e-59 and BLAST sequence identity of 41.6
  misc_feature: SWISSPROT Homolog: LTB4D_RAT EC 1.3.1.74 (15-oxoprostaglandin 13-reductase) EC 1.3.1.48 (Dithiolethione-inducible gene 1 protein) ( D3T-inducible gene 1 protein) (DIG-1)
  misc_feature: SWISSPROT Homolog: YNCB_ECOLI Putative NADP-dependent oxidoreductase yncB (EC 1.-.-.-) with e-value of 2.4e-58 and BLAST sequence identity of 39.7
  misc_feature 217297:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(348): Functional Homolog of  Ceres CLONE ID no. 40824 at SEQ ID NO. 1983 with e-value of 3.69E-130 and BLAST sequence identity of 69.4
MESDDGEVVSNKQVIFKDYVPGVLKESDMYITTSTIKLKVPEDCTNGVLVKNLYLSCDPYMRNRMRNFQGSYISPLKPGSPISGRGVAKVLDSRHPDYKKGDFIWGMTGWEEYSLITATETLFKIHDKDVPLSYYTGILGMPGLTAYAGFYEICSPKKGEFVFISAASGAVGQLVGQFAKLLGCYVVGSAGSKDKVDLLKNKFGFDDAFNYKEELDLDAALKRYFPDGIDIYFENVGGKMLDAVVLNMRVRGRISVCGMVSQYNLEQPEGVHNLMHLVPKRIHMEGFLVYDFFHLFPKYLDMVLPYIKQGKIVYVEDIAEGLENAPAALTGLFAGRNIGKQVVAVSHE

SEQ ID NO: 1946 - DNA, 1059 bp, Populus balsamifera subsp. trichocarpa
  misc_feature (1)..(1059): Ceres ANNOT ID no. 1455815
  misc_feature 217431:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggcaagtagtggcgaagaagtgagcaacaagcaggtcatattgaagggctacgtcactggatttccaaaagaatcagacatgtacgtgaaaacaagtcccacaaaactcaaactaccagaagatgaaagtagcaataatgctgtgttggttaagaatctctacttgtcttgtgacccttacatgcgtggtcgcatggcaaatcgtccagttgatgaccccgacttctctcccttcactcttgactctccaatagatggacatggggtgtctgaaattgttgattctaggcaccctggcttcaagaaaggtgacttggtttgggggaggaaaatggggtgggaagagtacagtttaataaaagaacctgagaaactcttcagaattcacaatactgatgtacccctttcctactatactggaattcttggcatgcctggtatgactgcttattttggtttctatcaagtttgttctccaaagaaaggggagcgcgtctacatttcagcagcatctggtgctgttggtcagcttgttggccagtttgcaaagttgatgggttgctatgttgttggaagtgctggaagtaaagaaaaggttgaactactgaaaagcaagtttggttttgatgatgctttcaattataaagaggagcatgacttggttgcggctttgaaaaggtacttccctgaaggcattgacatttactttgagaatgttgggggtaaaatgcttgacgcagtccttcttaacatgagattccatggtcgcattgctgcttgtggaatgatctctcaatacaatcttcagcaacctgaaggccttcaaaacttaacgactgttgtttttaagcgaatccgtttggaagggtttataatattcgattactttgaccagtatcccaagttcctggattttgtgctgccttatatcagggaagggaagattgtttatgtggaagacataactgaaggtctcgagcatggtccttctgctttggttggccttttcagtggccgaaacgttggaaagcaagtagtgaaggttacaaatgagtga

SEQ ID NO: 1947 - protein, 352 aa, Populus balsamifera subsp. trichocarpa
  misc_feature (1)..(352): Ceres ANNOT ID no. 1455815
  misc_feature (162)..(309): Pfam Name: ADH_zinc_N Pfam Description: Zinc-binding dehydrogenase
  misc_feature: SWISSPROT Homolog: P1_ARATH Probable NADP-dependent oxidoreductase P1 (EC 1.3.1.74) with e-value of 9.3e-151 and BLAST sequence identity of 78.6
  misc_feature: SWISSPROT Homolog: P2_ARATH Probable NADP-dependent oxidoreductase P2 (EC 1.3.1.74) with e-value of 1.2e-150 and BLAST sequence identity of 80.1
  misc_feature: SWISSPROT Homolog: LTB4D_MOUSE NADP-dependent leukotriene B4 12-hydroxydehydrogenase(EC 1.3.1.74) (15-oxoprostaglandin 13-reductase) (EC 1.3.1.48) with e-value of 4.8e-60 and BLAST sequence identity of 41.0
  misc_feature: SWISSPROT Homolog: LTB4D_RAT NADP-dependent leukotriene B4 12-hydroxydehydrogenase with e-value of 1.3e-59 and BLAST sequence identity of 41.6
  misc_feature: SWISSPROT Homolog: LTB4D_RAT EC 1.3.1.74 (15-oxoprostaglandin 13-reductase) EC 1.3.1.48 (Dithiolethione-inducible gene 1 protein) ( D3T-inducible gene 1 protein) (DIG-1)
  misc_feature: SWISSPROT Homolog: YNCB_ECOLI Putative NADP-dependent oxidoreductase yncB (EC 1.-.-.-) with e-value of 2.4e-58 and BLAST sequence identity of 39.7
  misc_feature 217581:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(352): Functional Homolog of  Ceres CLONE ID no. 40824 at SEQ ID NO. 1983 with e-value of 4.30E-129 and BLAST sequence identity of 70.9
MASSGEEVSNKQVILKGYVTGFPKESDMYVKTSPTKLKLPEDESSNNAVLVKNLYLSCDPYMRGRMANRPVDDPDFSPFTLDSPIDGHGVSEIVDSRHPGFKKGDLVWGRKMGWEEYSLIKEPEKLFRIHNTDVPLSYYTGILGMPGMTAYFGFYQVCSPKKGERVYISAASGAVGQLVGQFAKLMGCYVVGSAGSKEKVELLKSKFGFDDAFNYKEEHDLVAALKRYFPEGIDIYFENVGGKMLDAVLLNMRFHGRIAACGMISQYNLQQPEGLQNLTTVVFKRIRLEGFIIFDYFDQYPKFLDFVLPYIREGKIVYVEDITEGLEHGPSALVGLFSGRNVGKQVVKVTNE

SEQ ID NO: 1948 - DNA, 1041 bp, Populus balsamifera subsp. trichocarpa
  misc_feature (1)..(1041): Ceres ANNOT ID no. 1455817
  misc_feature 217718:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggcaggtagaggtgaaacagtgagcaacaagcatgtgttattcaagaactatgtgtctggtttccccaaagaatcagacatgtatgttgccactactaccactgaactcaaagtaccagatggttgtaataatggggttcttgttaagaatctctatctttcttgtgacccgtatatgataattttgatgaagaagtccatagaccaaaggactttcacttcgtataccccaggctctccattacgtgggtatggagtggcgaaagtgttggattctaggcacccgggctttaaagaaggcgactttgtttgggggacagtaggctgggaagagtacagccttatcacttcattccaacccttctttaaaattcaggatactgatgtgcccctttcatactatacaggaattcttggtatgactggaatgactgcttatgctggtttctatgaggcatgcctgaaaggggagcacgtctacatttcagcagcttctggtgctgttggtcagcttgttgggcaatttgcaaagttaatgggttgttatgttgttggaagtgccggaagtaaagaaaaggttgatttattgaagaacaaatttgggtttgacgaagcttttaattacaaagaggagcctgacttaaatgctgctctgggaagatacttccctgaaggcattgacatatattttgaaaatgttgggggcaagatgcttgacgccgtgcttccaaacatgagatttcgtggccgcattgcggtatgtggaatgatctcccaatacaatcttgacaaacctgaaggtgtatttaatttaatgactgtcgtttacaagcgggtacgcatagaaggatttgtggttacagattattatgatcaatatcccaagttcctagactttgtattgccttgcataagagagggaaagataaagtacatggaagacatttctgaaggactcgagaatggccctgcagcactggtaggccttttcagtggacaaaatgttgggaaaaagctggttgtagttgctcgtgagtga

SEQ ID NO: 1949 - protein, 346 aa, Populus balsamifera subsp. trichocarpa
  misc_feature (1)..(346): Ceres ANNOT ID no. 1455817
  misc_feature (156)..(303): Pfam Name: ADH_zinc_N Pfam Description: Zinc-binding dehydrogenase
  misc_feature: SWISSPROT Homolog: P1_ARATH Probable NADP-dependent oxidoreductase P1 (EC 1.3.1.74) with e-value of 9.3e-151 and BLAST sequence identity of 78.6
  misc_feature: SWISSPROT Homolog: P2_ARATH Probable NADP-dependent oxidoreductase P2 (EC 1.3.1.74) with e-value of 1.2e-150 and BLAST sequence identity of 80.1
  misc_feature: SWISSPROT Homolog: LTB4D_MOUSE NADP-dependent leukotriene B4 12-hydroxydehydrogenase(EC 1.3.1.74) (15-oxoprostaglandin 13-reductase) (EC 1.3.1.48) with e-value of 4.8e-60 and BLAST sequence identity of 41.0
  misc_feature: SWISSPROT Homolog: LTB4D_RAT NADP-dependent leukotriene B4 12-hydroxydehydrogenase with e-value of 1.3e-59 and BLAST sequence identity of 41.6
  misc_feature: SWISSPROT Homolog: LTB4D_RAT EC 1.3.1.74 (15-oxoprostaglandin 13-reductase) EC 1.3.1.48 (Dithiolethione-inducible gene 1 protein) ( D3T-inducible gene 1 protein) (DIG-1)
  misc_feature: SWISSPROT Homolog: YNCB_ECOLI Putative NADP-dependent oxidoreductase yncB (EC 1.-.-.-) with e-value of 2.4e-58 and BLAST sequence identity of 39.7
  misc_feature 217868:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(346): Functional Homolog of  Ceres CLONE ID no. 40824 at SEQ ID NO. 1983 with e-value of 5.39E-129 and BLAST sequence identity of 71.0
MAGRGETVSNKHVLFKNYVSGFPKESDMYVATTTTELKVPDGCNNGVLVKNLYLSCDPYMIILMKKSIDQRTFTSYTPGSPLRGYGVAKVLDSRHPGFKEGDFVWGTVGWEEYSLITSFQPFFKIQDTDVPLSYYTGILGMTGMTAYAGFYEACLKGEHVYISAASGAVGQLVGQFAKLMGCYVVGSAGSKEKVDLLKNKFGFDEAFNYKEEPDLNAALGRYFPEGIDIYFENVGGKMLDAVLPNMRFRGRIAVCGMISQYNLDKPEGVFNLMTVVYKRVRIEGFVVTDYYDQYPKFLDFVLPCIREGKIKYMEDISEGLENGPAALVGLFSGQNVGKKLVVVARE

SEQ ID NO: 1950 - DNA, 1086 bp, Populus balsamifera subsp. trichocarpa
  misc_feature (1)..(1086): Ceres ANNOT ID no. 1482502
  misc_feature 218002:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggctagtgatcatagtgttggtggggtggaagtgatcagcaacaaacaagtgatcctcaaggactatgtgagtggttttccaagagaatcaaacctgtacctgacgacaagtaacatcaaactcaaagtgccagaagaagagagtggtaaagatgctgtgctggttaagaatctctacttgtcttgtgatcctttcatgcgtggatggatgcagagagatctgccacccgttactgtgaatttacttactcttgttggagacattgagcagccaattgttggatatggagtggctagagttgttgattccaggcactctgacttcaagaaaggcgatttggtctggggaacgacaatcggctgggaagaatacagtctaatgacaacacctgaatacctcttcaaaatcaaccatactgatgatatacccctttcatactacactggaattcttggaatgcctggcatgactgcttattttggcttctttgacattggttctcccaaggaaggagaccgtgtctacgtttcatcagcatcaggcgcaattggtcagcttgttgggcaatttgcaaagctgataggttgttatgttgttggaagtgctggaagtaaagaaaaggttgaactattgaagaccaagtttggatttgatgatgctttcaattataaagaggagcatgacttggatgcagccttgaaaaggtacttccctgaaggcatcgacatttactttgagaatgttggaggaaaaatgcttgatgctgtccttctaaacatgagacaccatggccgtattgcattgtgtggaatgatctctcaatacaatctcgagcagcctgaaagtgtgcataacttaatcgctgtactctttaagcagatccggatggaagggtttgcggttgccgattactatgaccaatactccaagttcttggattttgttctgccttatattaaagaagggaagattgtttatgtggaagacataactgaaggactcgagagtggccctgctgcattgataggcctattcagcggccgaaatgtaggcaagcaagtagtgaaggttgctcaggagtga

SEQ ID NO: 1951 - protein, 361 aa, Populus balsamifera subsp. trichocarpa
  misc_feature (1)..(361): Ceres ANNOT ID no. 1482502
  misc_feature (171)..(318): Pfam Name: ADH_zinc_N Pfam Description: Zinc-binding dehydrogenase
  misc_feature: SWISSPROT Homolog: P1_ARATH Probable NADP-dependent oxidoreductase P1 (EC 1.3.1.74) with e-value of 9.3e-151 and BLAST sequence identity of 78.6
  misc_feature: SWISSPROT Homolog: P2_ARATH Probable NADP-dependent oxidoreductase P2 (EC 1.3.1.74) with e-value of 1.2e-150 and BLAST sequence identity of 80.1
  misc_feature: SWISSPROT Homolog: LTB4D_MOUSE NADP-dependent leukotriene B4 12-hydroxydehydrogenase(EC 1.3.1.74) (15-oxoprostaglandin 13-reductase) (EC 1.3.1.48) with e-value of 4.8e-60 and BLAST sequence identity of 41.0
  misc_feature: SWISSPROT Homolog: LTB4D_RAT NADP-dependent leukotriene B4 12-hydroxydehydrogenase with e-value of 1.3e-59 and BLAST sequence identity of 41.6
  misc_feature: SWISSPROT Homolog: LTB4D_RAT EC 1.3.1.74 (15-oxoprostaglandin 13-reductase) EC 1.3.1.48 (Dithiolethione-inducible gene 1 protein) ( D3T-inducible gene 1 protein) (DIG-1)
  misc_feature: SWISSPROT Homolog: YNCB_ECOLI Putative NADP-dependent oxidoreductase yncB (EC 1.-.-.-) with e-value of 2.4e-58 and BLAST sequence identity of 39.7
  misc_feature 218154:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(361): Functional Homolog of  Ceres CLONE ID no. 40824 at SEQ ID NO. 1983 with e-value of 9.99E-128 and BLAST sequence identity of 69.0
MASDHSVGGVEVISNKQVILKDYVSGFPRESNLYLTTSNIKLKVPEEESGKDAVLVKNLYLSCDPFMRGWMQRDLPPVTVNLLTLVGDIEQPIVGYGVARVVDSRHSDFKKGDLVWGTTIGWEEYSLMTTPEYLFKINHTDDIPLSYYTGILGMPGMTAYFGFFDIGSPKEGDRVYVSSASGAIGQLVGQFAKLIGCYVVGSAGSKEKVELLKTKFGFDDAFNYKEEHDLDAALKRYFPEGIDIYFENVGGKMLDAVLLNMRHHGRIALCGMISQYNLEQPESVHNLIAVLFKQIRMEGFAVADYYDQYSKFLDFVLPYIKEGKIVYVEDITEGLESGPAALIGLFSGRNVGKQVVKVAQE

SEQ ID NO: 1952 - DNA, 1038 bp, Populus balsamifera subsp. trichocarpa
  misc_feature (1)..(1038): Ceres ANNOT ID no. 1509035
  misc_feature 218291:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atgtctgatcaggaagtgagcaacaagcaagtggctttgaaaaactatgtcacagggtttccaaaggagtctgacatgcaaattattacaactaatactataaaacttagagtaccagaagggactaaagatgcagttcttgtcaagaatctttacctgtcttgtgatccatatatgcgtgaacgcatgtctgctggtgatggcggtttttcctccttcgaacttggaaagcctctaactggatatggagtggctaaaatcttggattctactcatcctaactacaagaaaggagacttagcttggggttttactggctgggaagagtacagtctcattgtatcaccacgaattttgatcaaaatcgagcacgctgacgtgcccctatcatactatacaggaattctaggtatgcctggtatgactgcttatgctggtttttatgaaatttgcactccaaagaaaggagagtatgtttacatatctgcagcatctggagctgttggccagattgttggccaatttgcaaaattgtcaggttgctatgttgtgggtagtgccggatctaaagagaaggttgatctgcttaagaacaagtttggatttgatgaggctttcaactacaaggaagagccagacttgaccgcagctcttaaaaggtatttccctgaaggcattgatatttactttgagaatgttgggggtaaaatgctcgatgcggtgttagcaaacatgaggacccttggtcgcattgctgcgtgtggaatgatttctcagtacaatctcgaaaagcatgaaggtgtccataacttgacgcttatcgtgtggaaacaaattcgcatgcagggattcctagctgctagctattatcacctctatcccaagtttctggaaatggctttaccttacatcaagcaagggaagatagtatatgtggaagataaagcagaaggccttgaaagtggtccaacatctctactaagcttattcaccggccaaaatgtaggaaagaagttgctagttgttgctcgtgagtga

SEQ ID NO: 1953 - protein, 345 aa, Populus balsamifera subsp. trichocarpa
  misc_feature (1)..(345): Ceres ANNOT ID no. 1509035
  misc_feature (155)..(302): Pfam Name: ADH_zinc_N Pfam Description: Zinc-binding dehydrogenase
  misc_feature: SWISSPROT Homolog: P1_ARATH Probable NADP-dependent oxidoreductase P1 (EC 1.3.1.74) with e-value of 9.3e-151 and BLAST sequence identity of 78.6
  misc_feature: SWISSPROT Homolog: P2_ARATH Probable NADP-dependent oxidoreductase P2 (EC 1.3.1.74) with e-value of 1.2e-150 and BLAST sequence identity of 80.1
  misc_feature: SWISSPROT Homolog: LTB4D_MOUSE NADP-dependent leukotriene B4 12-hydroxydehydrogenase(EC 1.3.1.74) (15-oxoprostaglandin 13-reductase) (EC 1.3.1.48) with e-value of 4.8e-60 and BLAST sequence identity of 41.0
  misc_feature: SWISSPROT Homolog: LTB4D_RAT NADP-dependent leukotriene B4 12-hydroxydehydrogenase with e-value of 1.3e-59 and BLAST sequence identity of 41.6
  misc_feature: SWISSPROT Homolog: LTB4D_RAT EC 1.3.1.74 (15-oxoprostaglandin 13-reductase) EC 1.3.1.48 (Dithiolethione-inducible gene 1 protein) ( D3T-inducible gene 1 protein) (DIG-1)
  misc_feature: SWISSPROT Homolog: YNCB_ECOLI Putative NADP-dependent oxidoreductase yncB (EC 1.-.-.-) with e-value of 2.4e-58 and BLAST sequence identity of 39.7
  misc_feature 218441:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(345): Functional Homolog of  Ceres CLONE ID no. 40824 at SEQ ID NO. 1983 with e-value of 1.30E-127 and BLAST sequence identity of 71.3
MSDQEVSNKQVALKNYVTGFPKESDMQIITTNTIKLRVPEGTKDAVLVKNLYLSCDPYMRERMSAGDGGFSSFELGKPLTGYGVAKILDSTHPNYKKGDLAWGFTGWEEYSLIVSPRILIKIEHADVPLSYYTGILGMPGMTAYAGFYEICTPKKGEYVYISAASGAVGQIVGQFAKLSGCYVVGSAGSKEKVDLLKNKFGFDEAFNYKEEPDLTAALKRYFPEGIDIYFENVGGKMLDAVLANMRTLGRIAACGMISQYNLEKHEGVHNLTLIVWKQIRMQGFLAASYYHLYPKFLEMALPYIKQGKIVYVEDKAEGLESGPTSLLSLFTGQNVGKKLLVVARE

SEQ ID NO: 1954 - DNA, 1086 bp, Populus balsamifera subsp. trichocarpa
  misc_feature (1)..(1086): Ceres ANNOT ID no. 1482477
  misc_feature 218575:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggagagtgatgatggtgaagtggtgagcaacaagcaagtgatcttcaaggactacgtgtctggtgctcttaaagagtcagacatgtacatcactactagtactatcagactcaaggtcccagaagattgtactaatggtgttcttgtaaaaaatctttacttgtcttgtgatccttacatgagaatccaaatgagaaactttcagggctcttatttttctccctttaagcctggttcgcctataagtgggcgtggagtggctaaagttttggattcaaggcatccggattataaaaagggagacttcatttggggaatcactggatgggaagagtacagtctgattacagcaacagagacactatttaaaatccatgacaaagatgtgcccctttcctattatactggaattctcggaatgccgggtatgactgcttatgctggcttctatgaaatatgctctccaaagaaaggggagtttgttttcatatcagcagcctctggtgcggttggtcagcttgttgggcagtttgcaaagttgttaggttgctatgttgttggaagtgctggaagcaaagacaagtctgaattttggggaaaaacatggatagcatgtagttcagttgatttgttgaagaataagtttggctttgatgatgctttcaactacaaagaagagctggacttggatgcagctttgaaaaggtactttcctgatggcattgatatttactttgaaaatgttggaggaaaaattcttgatgcagtactactcaacatgagggtccgtgggcgaatttctgtttgtggaatggtctcacaatacaatctcgagcagccggaaggtgttcataacttgatgcatcttgtgctgaaacgcattcatatggagggtttcttggtctattatttctttcaccttttcccaaaatatctagacatggttctgccttacatcaaacaaggaaagattgtgtatgttgaagacatagcagaaggccttgaaaatgctccagcggctctaactggactcttcgccggtcgcaatattggaaaacaagtggttgcagtttctcgtgaatga

SEQ ID NO: 1955 - protein, 361 aa, Populus balsamifera subsp. trichocarpa
  misc_feature (1)..(361): Ceres ANNOT ID no. 1482477
  misc_feature (215)..(318): Pfam Name: ADH_zinc_N Pfam Description: Zinc-binding dehydrogenase
  misc_feature: SWISSPROT Homolog: P1_ARATH Probable NADP-dependent oxidoreductase P1 (EC 1.3.1.74) with e-value of 9.3e-151 and BLAST sequence identity of 78.6
  misc_feature: SWISSPROT Homolog: P2_ARATH Probable NADP-dependent oxidoreductase P2 (EC 1.3.1.74) with e-value of 1.2e-150 and BLAST sequence identity of 80.1
  misc_feature: SWISSPROT Homolog: LTB4D_MOUSE NADP-dependent leukotriene B4 12-hydroxydehydrogenase(EC 1.3.1.74) (15-oxoprostaglandin 13-reductase) (EC 1.3.1.48) with e-value of 4.8e-60 and BLAST sequence identity of 41.0
  misc_feature: SWISSPROT Homolog: LTB4D_RAT NADP-dependent leukotriene B4 12-hydroxydehydrogenase with e-value of 1.3e-59 and BLAST sequence identity of 41.6
  misc_feature: SWISSPROT Homolog: LTB4D_RAT EC 1.3.1.74 (15-oxoprostaglandin 13-reductase) EC 1.3.1.48 (Dithiolethione-inducible gene 1 protein) ( D3T-inducible gene 1 protein) (DIG-1)
  misc_feature: SWISSPROT Homolog: YNCB_ECOLI Putative NADP-dependent oxidoreductase yncB (EC 1.-.-.-) with e-value of 2.4e-58 and BLAST sequence identity of 39.7
  misc_feature 218727:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(361): Functional Homolog of  Ceres CLONE ID no. 40824 at SEQ ID NO. 1983 with e-value of 2.10E-127 and BLAST sequence identity of 70.0
MESDDGEVVSNKQVIFKDYVSGALKESDMYITTSTIRLKVPEDCTNGVLVKNLYLSCDPYMRIQMRNFQGSYFSPFKPGSPISGRGVAKVLDSRHPDYKKGDFIWGITGWEEYSLITATETLFKIHDKDVPLSYYTGILGMPGMTAYAGFYEICSPKKGEFVFISAASGAVGQLVGQFAKLLGCYVVGSAGSKDKSEFWGKTWIACSSVDLLKNKFGFDDAFNYKEELDLDAALKRYFPDGIDIYFENVGGKILDAVLLNMRVRGRISVCGMVSQYNLEQPEGVHNLMHLVLKRIHMEGFLVYYFFHLFPKYLDMVLPYIKQGKIVYVEDIAEGLENAPAALTGLFAGRNIGKQVVAVSRE

SEQ ID NO: 1956 - DNA, 1008 bp, Populus balsamifera subsp. trichocarpa
  misc_feature (1)..(1008): Ceres ANNOT ID no. 1509013
  misc_feature 218864:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggcaagtagtggcgaagaagtgagcaacaagcaggtcatattgaagggctacgtcactggatttccaaaagaatcagacatgtacgtgaaaacaagtcccacaaaactcaaactaccagaagatgaaagtagcaataatgctgtgttggttaagaatctctacttgtcttgtgacccttacatgcgtggtcgcatgccaatagatggacatggggtgtctgaaattgttgattctaggcaccctggcttcaagaaaggtgacttggtttgggggaggaaaatggggtgggaagagtacagtttaataaaagaacctgagaaactcttcagaattcacaatactgatgtacccctttcctactatactggaattcttggcatgcctggtatgactgcttattttggtttctatcaagtttgttctccaaagaaaggggagcgcgtctacatttcagcagcatctggtgctgttggtcagcttgttggccagtttgcaaagttgatgggttgctatgttgttggaagtgctggaagtaaagaaaaggttgaactactgaaaagcaagtttggttttgatgatgctttcaattataaagaggagcatgacttggttgcggctttgaaaaggtacttccctgaaggcattgacatttactttgagaatgttgggggtaaaatgcttgacgcagtccttcttaacatgagattccatggtcgcattgctgcttgtggaatgatctctcaatacaatcttcagcaacctgaaggccttcaaaacttaacgactgttgtttttaagcgaatccgtttggaagggtttataatattcgattactttgaccagtatcccaagttcctggattttgtgctgccttatatcagggaagggaagattgtttatgtggaagacataactgaaggtctcgagcatggtccttctgctttggttggccttttcagtggccgaaacgttggaaagcaagtagtgaaggttacaaatgagtga

SEQ ID NO: 1957 - protein, 335 aa, Populus balsamifera subsp. trichocarpa
  misc_feature (1)..(335): Ceres ANNOT ID no. 1509013
  misc_feature (145)..(292): Pfam Name: ADH_zinc_N Pfam Description: Zinc-binding dehydrogenase
  misc_feature: SWISSPROT Homolog: P1_ARATH Probable NADP-dependent oxidoreductase P1 (EC 1.3.1.74) with e-value of 9.3e-151 and BLAST sequence identity of 78.6
  misc_feature: SWISSPROT Homolog: P2_ARATH Probable NADP-dependent oxidoreductase P2 (EC 1.3.1.74) with e-value of 1.2e-150 and BLAST sequence identity of 80.1
  misc_feature: SWISSPROT Homolog: LTB4D_MOUSE NADP-dependent leukotriene B4 12-hydroxydehydrogenase(EC 1.3.1.74) (15-oxoprostaglandin 13-reductase) (EC 1.3.1.48) with e-value of 4.8e-60 and BLAST sequence identity of 41.0
  misc_feature: SWISSPROT Homolog: LTB4D_RAT NADP-dependent leukotriene B4 12-hydroxydehydrogenase with e-value of 1.3e-59 and BLAST sequence identity of 41.6
  misc_feature: SWISSPROT Homolog: LTB4D_RAT EC 1.3.1.74 (15-oxoprostaglandin 13-reductase) EC 1.3.1.48 (Dithiolethione-inducible gene 1 protein) ( D3T-inducible gene 1 protein) (DIG-1)
  misc_feature: SWISSPROT Homolog: YNCB_ECOLI Putative NADP-dependent oxidoreductase yncB (EC 1.-.-.-) with e-value of 2.4e-58 and BLAST sequence identity of 39.7
  misc_feature 219012:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(335): Functional Homolog of  Ceres CLONE ID no. 40824 at SEQ ID NO. 1983 with e-value of 1.69E-125 and BLAST sequence identity of 74.0
MASSGEEVSNKQVILKGYVTGFPKESDMYVKTSPTKLKLPEDESSNNAVLVKNLYLSCDPYMRGRMPIDGHGVSEIVDSRHPGFKKGDLVWGRKMGWEEYSLIKEPEKLFRIHNTDVPLSYYTGILGMPGMTAYFGFYQVCSPKKGERVYISAASGAVGQLVGQFAKLMGCYVVGSAGSKEKVELLKSKFGFDDAFNYKEEHDLVAALKRYFPEGIDIYFENVGGKMLDAVLLNMRFHGRIAACGMISQYNLQQPEGLQNLTTVVFKRIRLEGFIIFDYFDQYPKFLDFVLPYIREGKIVYVEDITEGLEHGPSALVGLFSGRNVGKQVVKVTNE

SEQ ID NO: 1958 - DNA, 1056 bp, Populus balsamifera subsp. trichocarpa
  misc_feature (1)..(1056): Ceres ANNOT ID no. 1535990
  misc_feature 219143:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggctagtgatcatagtgtcggtggtgaggaagtgatcagcaacaaacaagtgatcctcaaggactatgtgagtggttttccaagagaatcaaacctgtacctgacgacaagtaacatcaaactcaaagtgccagaagaagagagtggtaaagatgctgtgctggttaagaatctctacttgtctagtgatcctttcatgcgtggacgcatgcagagagatctgccacccgacattgagcagccaattgttggatatggagtggctagagttgttgattccaggcactctgacttcaagaaaggcgatttggtctggggaaggacaatcggctgggaagaatacagtctaataacaacacctgaatacctcttcaaaatcaaccatactgatgatatacccctttcctactacactggaattcttggaatgcctggcatgactgcttatttttgcttctttgacattggttctcccaaggaaggagaccgtgtcttcgtttcatcagcatcaggcgcagttggtcagcttgttgggcaatttgcaaagctgataggttgttatgttgttggaagtgctggaagtaaagaaaaggttgaactattgaagaccaagtttggatttgatgatgctttcaattataaagaggagcatgacttggatgcagccttgaaaaggtacttccctgaaggcatcgacatttactttgagaatgttggaggaaaaatgcttgatgctgtccttctaaacatgagacaccatggccgtattgctttgtgtggaatgatctctcaatacaatctcgagcagcctgaaagtgtgcagaacttaatcgctctactctttaagcagatccggatggaagggtttgcggtttacgagtactatgaccaatactccaagttcttggattttgttctgccgtatattaaagaagggaagattgtttatgtggaagacataactgaaggactcgagagtggccctgctgcattgataggcctattcagcggccgaaatgtaggcaagcaagtagtgaaagttgctcaggagtga

SEQ ID NO: 1959 - protein, 351 aa, Populus balsamifera subsp. trichocarpa
  misc_feature (1)..(351): Ceres ANNOT ID no. 1535990
  misc_feature (161)..(308): Pfam Name: ADH_zinc_N Pfam Description: Zinc-binding dehydrogenase
  misc_feature: SWISSPROT Homolog: P1_ARATH Probable NADP-dependent oxidoreductase P1 (EC 1.3.1.74) with e-value of 9.3e-151 and BLAST sequence identity of 78.6
  misc_feature: SWISSPROT Homolog: P2_ARATH Probable NADP-dependent oxidoreductase P2 (EC 1.3.1.74) with e-value of 1.2e-150 and BLAST sequence identity of 80.1
  misc_feature: SWISSPROT Homolog: LTB4D_MOUSE NADP-dependent leukotriene B4 12-hydroxydehydrogenase(EC 1.3.1.74) (15-oxoprostaglandin 13-reductase) (EC 1.3.1.48) with e-value of 4.8e-60 and BLAST sequence identity of 41.0
  misc_feature: SWISSPROT Homolog: LTB4D_RAT NADP-dependent leukotriene B4 12-hydroxydehydrogenase with e-value of 1.3e-59 and BLAST sequence identity of 41.6
  misc_feature: SWISSPROT Homolog: LTB4D_RAT EC 1.3.1.74 (15-oxoprostaglandin 13-reductase) EC 1.3.1.48 (Dithiolethione-inducible gene 1 protein) ( D3T-inducible gene 1 protein) (DIG-1)
  misc_feature: SWISSPROT Homolog: YNCB_ECOLI Putative NADP-dependent oxidoreductase yncB (EC 1.-.-.-) with e-value of 2.4e-58 and BLAST sequence identity of 39.7
  misc_feature 219293:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(351): Functional Homolog of  Ceres CLONE ID no. 40824 at SEQ ID NO. 1983 with e-value of 1.19E-124 and BLAST sequence identity of 70.3
MASDHSVGGEEVISNKQVILKDYVSGFPRESNLYLTTSNIKLKVPEEESGKDAVLVKNLYLSSDPFMRGRMQRDLPPDIEQPIVGYGVARVVDSRHSDFKKGDLVWGRTIGWEEYSLITTPEYLFKINHTDDIPLSYYTGILGMPGMTAYFCFFDIGSPKEGDRVFVSSASGAVGQLVGQFAKLIGCYVVGSAGSKEKVELLKTKFGFDDAFNYKEEHDLDAALKRYFPEGIDIYFENVGGKMLDAVLLNMRHHGRIALCGMISQYNLEQPESVQNLIALLFKQIRMEGFAVYEYYDQYSKFLDFVLPYIKEGKIVYVEDITEGLESGPAALIGLFSGRNVGKQVVKVAQE

SEQ ID NO: 1960 - DNA, 1074 bp, Populus balsamifera subsp. trichocarpa
  misc_feature (1)..(1074): Ceres ANNOT ID no. 1455837
  misc_feature 219427:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atgtctgatcaggaagtgagcaacaagcaagtggctttgaaaaactatgtcacagggtttccaaaggagtctgacatgcaaattattacaactaatactataaaacttagagtaccagaagggactaaagatgcagttcttgtcaagaatctttacctgtcttgtgatccatatatgcgtgaacgcatgtctgctggtgatggcggtttttcctccttcgaacttggaaagcctctaactggatatggagtggctaaaatcttggattctactcatcctaactacaagaaaggagacttagcttggggttttactggctgggaagagtacagtctcattgtatcaccacgaattttgatcaaaatcgagcacgctgacgtgcccctatcatactatacaggaattctaggtatgcctggtatgactgcttatgctggtttttatgaaatttgcactccaaagaaaggagagtatgtttacatatctgcagcatctggagctgttggccagattgttggccaatttgcaaaattgtcaggttgctatgttgtgggtagtgccggatctaaagagaaggttgatctgcttaagaacaagtttggatttgatgaggctttcaactacaaggaagagccagacttgaccgcagctcttaaaagggtagaggagtacttattttgctttgattttggcaggtatttccctgaaggcattgatatttactttgagaatgttgggggtaaaatgctcgatgcggtgttagcaaacatgaggacccttggtcgcattgctgcgtgtggaatgatttctcagtacaatctcgaaaagcatgaaggtgtccataacttgacgcttatcgtgtggaaacaaattcgcatgcagggattcctagctgctagctattatcacctctatcccaagtttctggaaatggctttaccttacatcaagcaagggaagatagtatatgtggaagataaagcagaaggccttgaaagtggtccaacatctctactaagcttattcaccggccaaaatgtaggaaagaagttgctagttgttgctcgtgagtga

SEQ ID NO: 1961 - protein, 357 aa, Populus balsamifera subsp. trichocarpa
  misc_feature (1)..(357): Ceres ANNOT ID no. 1455837
  misc_feature (155)..(314): Pfam Name: ADH_zinc_N Pfam Description: Zinc-binding dehydrogenase
  misc_feature: SWISSPROT Homolog: P1_ARATH Probable NADP-dependent oxidoreductase P1 (EC 1.3.1.74) with e-value of 9.3e-151 and BLAST sequence identity of 78.6
  misc_feature: SWISSPROT Homolog: P2_ARATH Probable NADP-dependent oxidoreductase P2 (EC 1.3.1.74) with e-value of 1.2e-150 and BLAST sequence identity of 80.1
  misc_feature: SWISSPROT Homolog: LTB4D_MOUSE NADP-dependent leukotriene B4 12-hydroxydehydrogenase(EC 1.3.1.74) (15-oxoprostaglandin 13-reductase) (EC 1.3.1.48) with e-value of 4.8e-60 and BLAST sequence identity of 41.0
  misc_feature: SWISSPROT Homolog: LTB4D_RAT NADP-dependent leukotriene B4 12-hydroxydehydrogenase with e-value of 1.3e-59 and BLAST sequence identity of 41.6
  misc_feature: SWISSPROT Homolog: LTB4D_RAT EC 1.3.1.74 (15-oxoprostaglandin 13-reductase) EC 1.3.1.48 (Dithiolethione-inducible gene 1 protein) ( D3T-inducible gene 1 protein) (DIG-1)
  misc_feature: SWISSPROT Homolog: YNCB_ECOLI Putative NADP-dependent oxidoreductase yncB (EC 1.-.-.-) with e-value of 2.4e-58 and BLAST sequence identity of 39.7
  misc_feature 219577:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(357): Functional Homolog of  Ceres CLONE ID no. 40824 at SEQ ID NO. 1983 with e-value of 2.49E-124 and BLAST sequence identity of 71.3
MSDQEVSNKQVALKNYVTGFPKESDMQIITTNTIKLRVPEGTKDAVLVKNLYLSCDPYMRERMSAGDGGFSSFELGKPLTGYGVAKILDSTHPNYKKGDLAWGFTGWEEYSLIVSPRILIKIEHADVPLSYYTGILGMPGMTAYAGFYEICTPKKGEYVYISAASGAVGQIVGQFAKLSGCYVVGSAGSKEKVDLLKNKFGFDEAFNYKEEPDLTAALKRVEEYLFCFDFGRYFPEGIDIYFENVGGKMLDAVLANMRTLGRIAACGMISQYNLEKHEGVHNLTLIVWKQIRMQGFLAASYYHLYPKFLEMALPYIKQGKIVYVEDKAEGLESGPTSLLSLFTGQNVGKKLLVVARE

SEQ ID NO: 1962 - protein, 252 aa, Arabidopsis thaliana
  misc_feature (1)..(252): Ceres CLONE ID no. 41104
  misc_feature (1)..(252): Also Known As Ceres CDNA ID no. 23370269
  misc_feature (1)..(252): Also Known As Ceres GEMINI ID 534H2
  misc_feature (197)..(247): Pfam Name: PHD Pfam Description: PHD-finger
  misc_feature 219734:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
MEGIQHPIPRTVEEVFSDFRGRRAGLIKALSTDVQKFYHQCDPEKENLCLYGLPNETWEVNLPVEEVPPELPEPALGINFARDGMQEKDWISLVAVHSDSWLISVAFYFGARFGFGKNERKRLFQMINDLPTIFEVVTGNAKQSKDQSANHNSSRSKSSGGKPRHSESHTKASKMSPPPRKEDESGDEDEDDEQGAVCGACGDNYGGDEFWICCDACEKWFHGKCVKITPAKAEHIKHYKCPSCTTSKKMKA

SEQ ID NO: 1963 - DNA, 834 bp, Populus balsamifera subsp. trichocarpa; identical to SEQ ID NO: 1770
  misc_feature (1)..(834): Ceres ANNOT ID no. 1489751
  misc_feature 219815:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis

SEQ ID NO: 1964 - protein, 277 aa, Populus balsamifera subsp. trichocarpa; identical to SEQ ID NO: 1771
  misc_feature (1)..(277): Ceres ANNOT ID no. 1489751
  misc_feature (223)..(273): Pfam Name: PHD Pfam Description: PHD-finger
  misc_feature: SWISSPROT Homolog: Y5621_ARATH PHD finger protein At5g26210 with e-value of 3.1e-95 and BLAST sequence identity of 70.9
  misc_feature 219889:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature (1)..(277): Functional Homolog of  Ceres CLONE ID no. 41104 at SEQ ID NO. 2006 with e-value of 4.09E-108 and BLAST sequence identity of 82.4

SEQ ID NO: 1965 - DNA, 930 bp, Populus balsamifera subsp. trichocarpa; identical to SEQ ID NO: 1772
  misc_feature (1)..(930): Ceres ANNOT ID no. 1446209
  misc_feature 219984:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis

SEQ ID NO: 1966 - protein, 309 aa, Populus balsamifera subsp. trichocarpa; identical to SEQ ID NO: 1773
  misc_feature (1)..(309): Ceres ANNOT ID no. 1446209
  misc_feature (255)..(305): Pfam Name: PHD Pfam Description: PHD-finger
  misc_feature: SWISSPROT Homolog: Y5621_ARATH PHD finger protein At5g26210 with e-value of 3.1e-95 and BLAST sequence identity of 70.9
  misc_feature 220062:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature (1)..(309): Functional Homolog of  Ceres CLONE ID no. 41104 at SEQ ID NO. 2006 with e-value of 1.19E-101 and BLAST sequence identity of 83.6

SEQ ID NO: 1967 - protein, 425 aa, Arabidopsis thaliana
  misc_feature (1)..(425): Ceres CLONE ID no. 41105
  misc_feature (1)..(425): Also Known As Ceres CDNA ID no. 23374668
  misc_feature (1)..(425): Also Known As Ceres GEMINI ID 555A10
  misc_feature (171)..(249): Pfam Name: SBP Pfam Description: SBP domain
  misc_feature 220183:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
MECNAKPPFQWELENLISFGTSTAEVPRKLKPMEWEIDGFDCTSLYSSSFDAVAYGGSSGSDIAHAFSKSSKSTSISSSSAEVRTHNFTSETGESLPGEFAKGIDTSPTLELSFGSGDPVLGLKLGKRTYFEDFWEVENAKGLGLPVSLASSSVSPVKKSKSIPQRLQTPHCQVEGCNLDLSSAKDYHRKHRICENHSKFPKVVVSGVERRFCQQCSRFHCLSEFDEKKRSCRRRLSDHNARRRKPNPGRTYDGKPQVDFVWNRFALIHPRSEEKFLWPSSKPVPSRVLMPQPAKTEISNKLFTEHSRFGLLDPKTKSARAELFSKEKVTISSHMGASQDLDGALSLLSNSTTWVSSSDQPRRFTLDHHPSSNLQPVANRSAAQLSSVSGYWQPDPPAVEGPTALHRNGAGQFNENYFSLNQFYN

SEQ ID NO: 1968 - DNA, 1488 bp, Populus balsamifera subsp. trichocarpa
  misc_feature (1)..(1488): Ceres ANNOT ID no. 1500974
  misc_feature 220290:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
atggagtggaatggcaaaccccacttgcagtgggactgggaaaacctgataatgttcaatgcaataacaaatgaaaattcaaagcagttaagcctaacagatttggaaactgatggagaaaaaggaaatgattctgggtttttctattcatctgggagtgtaagcagaagccgtggatctatctctgacttagaacttgcttctttctcaaagagctcgaagtcagcttccaccaattcttcatcagctggggaagttaaaacatccaaattcactttgggggcctctaaaacaaatccatcagattacaataaggaagaacttgtgaaggctaaggcaactgatacttctcccacgcttgaagcttcagttggttcaggtgaccagctgcttggtttgaagcttggtaaaagaacttactttgaagatgcttgtgctgggagcaatgctcagtcttcatcaatatctacgattcctgtgccttcttttactccagcaaagaaattgaagtccagtaatcatagtcagcgtgctccacgctgtcaagtagaaggctgtaaccttgacctctcatcagctaaagattaccatcgcaaacatagagtttgtgaaagccattcaaagtgcccaaaggtcattgtagctggtttggaacgcaggttttgccagcagtgtagcaggttccatggtctgtcagagtttgatgaaaagaagaaaagctgccgcaggcgactttctgatcacaatgcaagacgccgcaaacagccaggatctgtccatttgaatccttcaagactttcttcatcattatatgatgagaggcaacagatgagtcatgtttgggacaaggcgccacttgttcattccaggcccaatgcaaatttgacatgggaaagcacatccacctccaagttcacaataacaaaagagtatatagcaaagcctgcagaaataggtggtagtgataggaggctccacttgcctggcattgatctgacaaatagcattgctattcagcaccatcataagtctaatggcttcttaccatccaaggccaagggcactgcaggtgaggttctcaaccaaggattggactactctctcgttccttccaaagtggaagcaacaccagaatttcatcgtgcaacaccagaatttctctctcttctgtcaaccgattcatggggttcatgtgagccacaatctatttcatttgaacagcccatgcatgcaaatcacaccagcatgcctcagtcggtgctacacactgtaccccaaagctcaccacttgcttcatcagagtactggaggactgagcaacagtcaaatgaccctcaagtgcataccttgagttcacgcactgatggtgatgtcctgcatgttgcaagcacaggctgtaattacaggagagctcacgctctctcaaatgagagagtgcccaaacagataattttttgggggctcgtggtaacctgtcatggcatttga

SEQ ID NO: 1969 - protein, 495 aa, Populus balsamifera subsp. trichocarpa
  misc_feature (1)..(495): Ceres ANNOT ID no. 1500974
  misc_feature (180)..(258): Pfam Name: SBP Pfam Description: SBP domain
  misc_feature: SWISSPROT Homolog: SPL2_ARATH Squamosa promoter-binding-like protein 2 with e-value of 5.0e-223 and BLAST sequence identity of 96.0
  misc_feature: SWISSPROT Homolog: SPL10_ARATH Squamosa promoter-binding-like protein 10 with e-value of 5.7e-64 and BLAST sequence identity of 43.0
  misc_feature: SWISSPROT Homolog: SPL11_ARATH Squamosa promoter-binding-like protein 11 with e-value of 7.5e-62 and BLAST sequence identity of 43.0
  misc_feature: SWISSPROT Homolog: SPL9_ARATH Squamosa promoter-binding-like protein 9 with e-value of 4.5e-32 and BLAST sequence identity of 39.6
  misc_feature: SWISSPROT Homolog: SPL6_ARATH Squamosa promoter-binding-like protein 6 with e-value of 9.4e-32 and BLAST sequence identity of 39.6
  misc_feature 220407:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (1)..(495): Functional Homolog of  Ceres CLONE ID no. 41105 at SEQ ID NO. 2011 with e-value of 6.20E-73 and BLAST sequence identity of 48.2
MEWNGKPHLQWDWENLIMFNAITNENSKQLSLTDLETDGEKGNDSGFFYSSGSVSRSRGSISDLELASFSKSSKSASTNSSSAGEVKTSKFTLGASKTNPSDYNKEELVKAKATDTSPTLEASVGSGDQLLGLKLGKRTYFEDACAGSNAQSSSISTIPVPSFTPAKKLKSSNHSQRAPRCQVEGCNLDLSSAKDYHRKHRVCESHSKCPKVIVAGLERRFCQQCSRFHGLSEFDEKKKSCRRRLSDHNARRRKQPGSVHLNPSRLSSSLYDERQQMSHVWDKAPLVHSRPNANLTWESTSTSKFTITKEYIAKPAEIGGSDRRLHLPGIDLTNSIAIQHHHKSNGFLPSKAKGTAGEVLNQGLDYSLVPSKVEATPEFHRATPEFLSLLSTDSWGSCEPQSISFEQPMHANHTSMPQSVLHTVPQSSPLASSEYWRTEQQSNDPQVHTLSSRTDGDVLHVASTGCNYRRAHALSNERVPKQIIFWGLVVTCHGI

SEQ ID NO: 1970 - DNA, 1341 bp, Populus balsamifera subsp. trichocarpa
  misc_feature (1)..(1341): Ceres ANNOT ID no. 1490929
  misc_feature 220534:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
atggagtggaatggcaaaccccacttacagtgggactgggagagcctgataatgttcaatggaataacaactgaaaattctaagcagttaagcccaacagatttggaaactgatggagaaaaaggaaccgactctgggtttttctattcatctgggagtgcaagcagaagcggtggttctagctctgatttggaacttgcttctttctcaaagtgctcgaagtcagcttccatcaattcttcatcagctggggaagttaaaacatccaaattcactttggaggcctctaaagcaaatccatctgattacaataagaaagaaattggaaaggctaagacagctagtatgtcttccacaattgaggctgcaggtggttcaggtgaccagctgcttggtttgaagcttggtaaacgaatatactttgaagatgcttgtgctggcaacaatgttcagtcgtcatcattttctacagttcctgtgccctcttttacttcagcaaagaaattgaagtccactattcagagtcagcgtgctccatgctgtcaagtggaaggctgtaaccttgacctctcatcagctaaagattatcatcgcaaacatagagtttgtgaaagccattcaaagtgccagaaggtcattgtagctggtttggaacgcaggttttgccagcagtgtagcaggttccatggcctgtcagagttcgatgaaaagaagaaaagctgtcgcaggcgactttctgatcacaatgcaagacgccgcaaacaaccaggatcggtccatttaaattcaagagtgtcttcatcattatatgatgaaaggcaacagatgagtcttgcttgggacagggcaccacttgttcatgccaggcctaatgcaaatttgacgtgggaaggcacatacatctccaagttcacaataacaaaagattatatagcaaagcctgcagaaataggtggtaatgatgggcagtttcacttgcctggctttgatctgacaaatggcattgatattcagcaccatcataagtctaatagctccttaccatctaaaggtaagggcactgcagctgagattctcaaccaaggtttggaagaatacatcattccttccaaagcggaagcagcaccagaatctcatcgtgctctctctcttctgtcaaacaattcatggggttcacgtgagccgcaatctatttcatttgaacaacccgtgcatacaaatcacaccactcagtctgtgctgcaagttataccccaaaactcaccacttgcttcatcagagtattggaggactgagcaaccgtcaactgactctcaagtgcataccttgacgtctcactga

SEQ ID NO: 1971 - protein, 446 aa, Populus balsamifera subsp. trichocarpa
  misc_feature (1)..(446): Ceres ANNOT ID no. 1490929
  misc_feature (180)..(258): Pfam Name: SBP Pfam Description: SBP domain
  misc_feature: SWISSPROT Homolog: SPL2_ARATH Squamosa promoter-binding-like protein 2 with e-value of 5.0e-223 and BLAST sequence identity of 96.0
  misc_feature: SWISSPROT Homolog: SPL10_ARATH Squamosa promoter-binding-like protein 10 with e-value of 5.7e-64 and BLAST sequence identity of 43.0
  misc_feature: SWISSPROT Homolog: SPL11_ARATH Squamosa promoter-binding-like protein 11 with e-value of 7.5e-62 and BLAST sequence identity of 43.0
  misc_feature: SWISSPROT Homolog: SPL9_ARATH Squamosa promoter-binding-like protein 9 with e-value of 4.5e-32 and BLAST sequence identity of 39.6
  misc_feature: SWISSPROT Homolog: SPL6_ARATH Squamosa promoter-binding-like protein 6 with e-value of 9.4e-32 and BLAST sequence identity of 39.6
  misc_feature 220647:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (1)..(446): Functional Homolog of  Ceres CLONE ID no. 41105 at SEQ ID NO. 2011 with e-value of 5.00E-71 and BLAST sequence identity of 47.5
MEWNGKPHLQWDWESLIMFNGITTENSKQLSPTDLETDGEKGTDSGFFYSSGSASRSGGSSSDLELASFSKCSKSASINSSSAGEVKTSKFTLEASKANPSDYNKKEIGKAKTASMSSTIEAAGGSGDQLLGLKLGKRIYFEDACAGNNVQSSSFSTVPVPSFTSAKKLKSTIQSQRAPCCQVEGCNLDLSSAKDYHRKHRVCESHSKCQKVIVAGLERRFCQQCSRFHGLSEFDEKKKSCRRRLSDHNARRRKQPGSVHLNSRVSSSLYDERQQMSLAWDRAPLVHARPNANLTWEGTYISKFTITKDYIAKPAEIGGNDGQFHLPGFDLTNGIDIQHHHKSNSSLPSKGKGTAAEILNQGLEEYIIPSKAEAAPESHRALSLLSNNSWGSREPQSISFEQPVHTNHTTQSVLQVIPQNSPLASSEYWRTEQPSTDSQVHTLTSH

SEQ ID NO: 1972 - DNA, 1461 bp, Populus balsamifera subsp. trichocarpa
  misc_feature (1)..(1461): Ceres ANNOT ID no. 1438118
  misc_feature 220765:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
atggttgtgtctaggagaggtttgcctggtattttgtctgagttctctgagctggggagttcagggctttcggaggcatcaagaggaattacttttgattctataagttctgactcactgatggagtggaatggcaaaccccacttacagtgggactgggagagcctgataatgttcaatggaataacaactgaaaattctaagcagttaagcccaacagatttggaaactgatggagaaaaaggaaccgactctgggtttttctattcatctgggagtgcaagcagaagcggtggttctagctctgatttggaacttgcttctttctcaaagtgctcgaagtcagcttccatcaattcttcatcagctggggaagttaaaacatccaaattcactttggaggcctctaaagcaaatccatctgattacaataagaaagaaattggaaaggctaagacagctagtatgtcttccacaattgaggctgcaggtggttcaggtgaccagctgcttggtttgaagcttggtaaacgaatatactttgaagatgcttgtgctggcaacaatgttcagtcgtcatcattttctacagttcctgtgccctcttttacttcagcaaagaaattgaagtccactattcagagtcagcgtgctccatgctgtcaagtggaaggctgtaaccttgacctctcatcagctaaagattatcatcgcaaacatagagtttgtgaaagccattcaaagtgccagaaggtcattgtagctggtttggaacgcaggttttgccagcagtgtagcaggttccatggcctgtcagagttcgatgaaaagaagaaaagctgtcgcaggcgactttctgatcacaatgcaagacgccgcaaacaaccaggatcggtccatttaaattcaagagtgtcttcatcattatatgatgaaaggcaacagatgagtcttgcttgggacagggcaccacttgttcatgccaggcctaatgcaaatttgacgtgggaaggcacatacatctccaagttcacaataacaaaagattatatagcaaagcctgcagaaataggtggtaatgatgggcagtttcacttgcctggctttgatctgacaaatggcattgatattcagcaccatcataagtctaatagctccttaccatctaaaggtaagggcactgcagctgagattctcaaccaaggtttggaagaatacatcattccttccaaagcggaagcagcaccagaatctcatcgtgctctctctcttctgtcaaacaattcatggggttcacgtgagccgcaatctatttcatttgaacaacccgtgcatacaaatcacaccactcagtctgtgctgcaagttataccccaaaactcaccacttgcttcatcagagtattggaggactgagcaaccgtcaactgactctcaagtgcataccttgacgtctcactga

SEQ ID NO: 1973 - protein, 446 aa, Populus balsamifera subsp. trichocarpa; identical to SEQ ID NO: 1971
  misc_feature (1)..(446): Ceres ANNOT ID no. 1438118
  misc_feature (180)..(258): Pfam Name: SBP Pfam Description: SBP domain
  misc_feature: SWISSPROT Homolog: SPL2_ARATH Squamosa promoter-binding-like protein 2 with e-value of 5.0e-223 and BLAST sequence identity of 96.0
  misc_feature: SWISSPROT Homolog: SPL10_ARATH Squamosa promoter-binding-like protein 10 with e-value of 5.7e-64 and BLAST sequence identity of 43.0
  misc_feature: SWISSPROT Homolog: SPL11_ARATH Squamosa promoter-binding-like protein 11 with e-value of 7.5e-62 and BLAST sequence identity of 43.0
  misc_feature: SWISSPROT Homolog: SPL9_ARATH Squamosa promoter-binding-like protein 9 with e-value of 4.5e-32 and BLAST sequence identity of 39.6
  misc_feature: SWISSPROT Homolog: SPL6_ARATH Squamosa promoter-binding-like protein 6 with e-value of 9.4e-32 and BLAST sequence identity of 39.6
  misc_feature 220882:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (1)..(446): Functional Homolog of  Ceres CLONE ID no. 41105 at SEQ ID NO. 2011 with e-value of 5.00E-71 and BLAST sequence identity of 47.5

SEQ ID NO: 1974 - DNA, 1419 bp, Populus balsamifera subsp. trichocarpa
  misc_feature (1)..(1419): Ceres ANNOT ID no. 1482024
  misc_feature 221000:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
atggactggaactccactgcatctgaggggaactgggagaacatagcagggttaagtgccaaggctagtgacattccaaaacaagtaccattggcataccatgagacagagggagatggagcaattgataaagcaataacttattcgtctggtggtggtttatcaagctctgatttgtggcattgctcttcatccaagagctcagtttcaccctctgtcgactcttcattgaagggggggatcaagacttatagcactgcagatggttttcctggagttatcattagaaaggacttgactagggtagaaagtactgagaatattccatctctgggtgcttctgctagctctggtgaaccagtaattggcttgaagcttggtaaacggatgtactttgaagacatttgtactaccagcactgccaaatcatcgtcttcatctattgtttccacttcctgtactgctacaacaaagagatctagggcatcatatccaagtacacagtctccacgttgccaagtggaaggatgcaaccttgatctcaagtcagctaaagattaccatcgcaggcatagaatctgtgaaaaacattccaaaagcccaaaggttattgttgctggcatggaacgccgattttgccaacagtgcagcaggttccatgaattatcagagtttgatgacaagaagcgaagctgtcgtagacgtctctctgatcacaatgcaaggcgacggaggccacaacctgaggcaatccggttcaattcagcaaggccatcatcatcaccatcatcattttatggttgtcatttcaatttcaaagatggtagacagcagatgaatgttgtattgaatagggtgcctttcctggcaggaaattcaacttggcaaagcgagtgcggctttaaagtcactcacgccggagatttttttattaggcctgcaaaagcagggggcatccataggcagcttagctatccctgcaatgaagtgccagatgcagcttcaacaataccaacagactcggataaaattatctcttttgagagaagtacaccccaggtctttagtcaaggtttcgaggggtctgcattaacttctaacattgaggtagcaccagatcttcggcgtgctctctctcttctgtcaaccacttcttggggctcgaatgagcatggatccacctctctggatcaactgatgcttgcaaaccaaacaagcatgacacagccaatgataaatgctgaactccaaaattgtccagttgcttcatcagaaaatgcacggatggaacaagcatcccttgagtctcgggtgcattctttggatttacatgacaatggaaacgtccagttgcaagagtttcagctgctcaaagcaccctatgctaccggctgcttttattccaatcaattcagctaa

SEQ ID NO: 1975 - protein, 472 aa, Populus balsamifera subsp. trichocarpa
  misc_feature (1)..(472): Ceres ANNOT ID no. 1482024
  misc_feature (171)..(249): Pfam Name: SBP Pfam Description: SBP domain
  misc_feature: SWISSPROT Homolog: SPL2_ARATH Squamosa promoter-binding-like protein 2 with e-value of 5.0e-223 and BLAST sequence identity of 96.0
  misc_feature: SWISSPROT Homolog: SPL10_ARATH Squamosa promoter-binding-like protein 10 with e-value of 5.7e-64 and BLAST sequence identity of 43.0
  misc_feature: SWISSPROT Homolog: SPL11_ARATH Squamosa promoter-binding-like protein 11 with e-value of 7.5e-62 and BLAST sequence identity of 43.0
  misc_feature: SWISSPROT Homolog: SPL9_ARATH Squamosa promoter-binding-like protein 9 with e-value of 4.5e-32 and BLAST sequence identity of 39.6
  misc_feature: SWISSPROT Homolog: SPL6_ARATH Squamosa promoter-binding-like protein 6 with e-value of 9.4e-32 and BLAST sequence identity of 39.6
  misc_feature 221115:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (1)..(472): Functional Homolog of  Ceres CLONE ID no. 41105 at SEQ ID NO. 2011 with e-value of 3.50E-57 and BLAST sequence identity of 54.2
MDWNSTASEGNWENIAGLSAKASDIPKQVPLAYHETEGDGAIDKAITYSSGGGLSSSDLWHCSSSKSSVSPSVDSSLKGGIKTYSTADGFPGVIIRKDLTRVESTENIPSLGASASSGEPVIGLKLGKRMYFEDICTTSTAKSSSSSIVSTSCTATTKRSRASYPSTQSPRCQVEGCNLDLKSAKDYHRRHRICEKHSKSPKVIVAGMERRFCQQCSRFHELSEFDDKKRSCRRRLSDHNARRRRPQPEAIRFNSARPSSSPSSFYGCHFNFKDGRQQMNVVLNRVPFLAGNSTWQSECGFKVTHAGDFFIRPAKAGGIHRQLSYPCNEVPDAASTIPTDSDKIISFERSTPQVFSQGFEGSALTSNIEVAPDLRRALSLLSTTSWGSNEHGSTSLDQLMLANQTSMTQPMINAELQNCPVASSENARMEQASLESRVHSLDLHDNGNVQLQEFQLLKAPYATGCFYSNQFS

SEQ ID NO: 1976 - protein, 353 aa, Arabidopsis thaliana
  misc_feature (1)..(353): Ceres CLONE ID no. 41306
  misc_feature (23)..(204): Pfam Name: Lectin_legB Pfam Description: Legume lectins beta domain
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Strong Useful for making stronger plants
MAVFKTLAFLFVLSIVIYQSVAVTDVNSSFSFNGFVKAPSFDNNVALFGDSKLVHGGPSIQLTDSVSRSEGRVIYKKPIRLFQGKERNFSGSFSTSFSFSMSDEIGSVLAFIMVPRGLDLRLFGRKGNNSSSGLGFLLKHKVVAVEFGISKRGNHVGILVGRPESGKVRKLSSFGHHFNEEKRLNCWIDYEASSKRIEVRLSLSAALKPVDPFVSYSVDLAKLWKDGKFMVGLTSANGNTSKPVYLHSWSFKLIHPSMRIHSQPLDPNDVSKTVKEGEKTVEVKGKGKCIWRILGALVLGAVCGTLGAMFALYLWTICGNRQSMAIVPEECADEKADILVTKADVVVEEEVKK

SEQ ID NO: 1977 - DNA, 1068 bp, Populus balsamifera subsp. trichocarpa
  misc_feature (1)..(1068): Ceres ANNOT ID no. 1475806
  misc_feature 221350:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Strong Useful for making stronger plants
atggccaagttcaacattcccgcctgcttaacggtgcttactttcatgatttctcacttgaaaatgctaaatgctggctcaagttactccttttcctttgaaacttttgataaaaatccaaactttcagtccaacattgctctttatggtgatgcgaaggtcgttggtaatggttctcttcaactcactcgcgcagggagttcaagtgctggacgagtcatgtacaagcaacccatcaagcttgtcgaaggtatttctggaaatatggtttccttttccaccaatttctcattcttgatgtcaactgatgatggagatggtttggctttttttttggttcctagtggtttttatgtgaggatgtttgataacagcccatttgggctatatttaggatcagagaaaagtagtcctaaatttgttgctgttgaatttgacacgtcgagggatgctaaatttggtgatttgaatgataaccatgtgggaattgacgtgggtggttttgtgtcagtcaaagtgagaaatgtttcgtccaataatatggttttgaatagtggaaaaagattgcattcttggattgattatgaagcgggttcgaaaagattagaggttagattgagtcaatctggtgatataaagccaattgatccactgctctcttacccaattgacttatcaaaaatgctcaatgatgagagggttttgataggcttgagctcatcaaatggaaattcgtctcagacttgcttcctctattcatggagcttaaagctaaggcatgtcccccattggatgcattctgagccactggaccctcgggcttttgctaaacgtgtgaaaccagtggtagttcaaaagaagagtgattgtattttaaaaatccttgctgcaatgatttttggaactgcttgtggagctctgggggcattcatggtgttatatctttggaccatatttggcaataggcgcccagttgtgccagaagagtgttctgcccaccctggggattttgaatacaagaaagtcaaagtagttgtagataaagccgtccaagatggcaagcattag

SEQ ID NO: 1978 - protein, 355 aa, Populus balsamifera subsp. trichocarpa
  misc_feature (1)..(355): Ceres ANNOT ID no. 1475806
  misc_feature (26)..(209): Pfam Name: Lectin_legB Pfam Description: Legume lectins beta domain
  misc_feature: SWISSPROT Homolog: LECS_SOPJA Seed lectin precursor (LECSJASG) with e-value of 1.7e-08 and BLAST sequence identity of 27.8
  misc_feature: SWISSPROT Homolog: LECB_SOPJA Bark lectin precursor (LECSJABG) (Fragment) with e-value of 3.7e-08 and BLAST sequence identity of 29.8
  misc_feature: SWISSPROT Homolog: LCB2_ROBPS Bark agglutinin I, polypeptide B precursor (RPbAI) (LECRPA2) with e-value of 2.2e-07 and BLAST sequence identity of 30.0
  misc_feature: SWISSPROT Homolog: LECS_VATMA Seed lectin (VML) with e-value of 6.2e-07 and BLAST sequence identity of 30.5
  misc_feature: SWISSPROT Homolog: LECS_VATMA Contains: Seed lectin alpha chain; Seed lectin gamma chain; Seed lectin beta chain;
  misc_feature: SWISSPROT Homolog: LEC_BOWMI Lectin (Agglutinin) (BMA) [Contains: Lectin beta chain; Lectin alpha chain] with e-value of 6.2e-07 and BLAST sequence identity of 28.2
  misc_feature 221479:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Strong Useful for making stronger plants
  misc_feature (1)..(355): Functional Homolog of  Ceres CLONE ID no. 41306 at SEQ ID NO. 2020 with e-value of 1.70E-70 and BLAST sequence identity of 50.1
MAKFNIPACLTVLTFMISHLKMLNAGSSYSFSFETFDKNPNFQSNIALYGDAKVVGNGSLQLTRAGSSSAGRVMYKQPIKLVEGISGNMVSFSTNFSFLMSTDDGDGLAFFLVPSGFYVRMFDNSPFGLYLGSEKSSPKFVAVEFDTSRDAKFGDLNDNHVGIDVGGFVSVKVRNVSSNNMVLNSGKRLHSWIDYEAGSKRLEVRLSQSGDIKPIDPLLSYPIDLSKMLNDERVLIGLSSSNGNSSQTCFLYSWSLKLRHVPHWMHSEPLDPRAFAKRVKPVVVQKKSDCILKILAAMIFGTACGALGAFMVLYLWTIFGNRRPVVPEECSAHPGDFEYKKVKVVVDKAVQDGKH

SEQ ID NO: 1979 - DNA, 1071 bp, Populus balsamifera subsp. trichocarpa
  misc_feature (1)..(1071): Ceres ANNOT ID no. 1454125
  misc_feature 221595:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Strong Useful for making stronger plants
atggccaagctctccatttctacctgcttaacagtgttaactttcatgattttccacttgaaaatgctacatgctgtctcaagttactccttttcatttggaagttttgataaagatccaaactttgagtccagcattgctctttatggtgatgcaaaggttgttggtaatagttcttctcttcaactcactcgccctgtgagcttaagtgctggacgagtcatgtacaagcaacccatcaagcttgttgaaggtaatcctggaaatttggtttccttttccacttatttttcattcttgatgtcacctgataatggagatggtttagcttttgtagtggttcctagtggttttaatgcaagtgtgtttgataacaccccatttgggctttatttaggacccgagaaaagtagtcctaaatttgttgctgttgaatttgatacgatgagggatgctaagtttggtgatttgaatgataaccatgtgggaattgatgtgggtggttttgtatcagttaaagtgagagacgtttcatctaataatatggtgttgaatagtggaaaaagattgcattcttggattgattatgaagctggttcgaaaacattagaggttagattgagtcattctggtgatataaagccaattgacccattgctctctcacccaattgacctgtcaaaaacgtggaatgatgagaaagtgttgataggcttgacctcatcaaatggtaattcttcccagacatgtttcctccattcatggaactttaagctaaggcgagtcccgctttggatgcattctcagccactggaccctcaggattttgctaaacatgagaaaccaatggtggttcagaagaagagtggttgtattttaaaaatgcttactgcaatgatctttggcactgcttgtggagcaatgggggcgttcatggtgttgtatctttggaccatttttggcaataggcgccctgtcatgccagaagagtgttctgtccccccagtggatttcgaatacaagaaagtcaaagttattgtagataaagccatcgaagatggcaagcattag

SEQ ID NO: 1980 - protein, 356 aa, Populus balsamifera subsp. trichocarpa
  misc_feature (1)..(356): Ceres ANNOT ID no. 1454125
  misc_feature (137)..(166): Pfam Name: Lectin_legB Pfam Description: Legume lectins beta domain
  misc_feature: SWISSPROT Homolog: LECS_SOPJA Seed lectin precursor (LECSJASG) with e-value of 1.7e-08 and BLAST sequence identity of 27.8
  misc_feature: SWISSPROT Homolog: LECB_SOPJA Bark lectin precursor (LECSJABG) (Fragment) with e-value of 3.7e-08 and BLAST sequence identity of 29.8
  misc_feature: SWISSPROT Homolog: LCB2_ROBPS Bark agglutinin I, polypeptide B precursor (RPbAI) (LECRPA2) with e-value of 2.2e-07 and BLAST sequence identity of 30.0
  misc_feature: SWISSPROT Homolog: LECS_VATMA Seed lectin (VML) with e-value of 6.2e-07 and BLAST sequence identity of 30.5
  misc_feature: SWISSPROT Homolog: LECS_VATMA Contains: Seed lectin alpha chain; Seed lectin gamma chain; Seed lectin beta chain;
  misc_feature: SWISSPROT Homolog: LEC_BOWMI Lectin (Agglutinin) (BMA) [Contains: Lectin beta chain; Lectin alpha chain] with e-value of 6.2e-07 and BLAST sequence identity of 28.2
  misc_feature 221724:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Strong Useful for making stronger plants
  misc_feature (1)..(356): Functional Homolog of  Ceres CLONE ID no. 41306 at SEQ ID NO. 2020 with e-value of 2.80E-70 and BLAST sequence identity of 48.2
MAKLSISTCLTVLTFMIFHLKMLHAVSSYSFSFGSFDKDPNFESSIALYGDAKVVGNSSSLQLTRPVSLSAGRVMYKQPIKLVEGNPGNLVSFSTYFSFLMSPDNGDGLAFVVVPSGFNASVFDNTPFGLYLGPEKSSPKFVAVEFDTMRDAKFGDLNDNHVGIDVGGFVSVKVRDVSSNNMVLNSGKRLHSWIDYEAGSKTLEVRLSHSGDIKPIDPLLSHPIDLSKTWNDEKVLIGLTSSNGNSSQTCFLHSWNFKLRRVPLWMHSQPLDPQDFAKHEKPMVVQKKSGCILKMLTAMIFGTACGAMGAFMVLYLWTIFGNRRPVMPEECSVPPVDFEYKKVKVIVDKAIEDGKH

SEQ ID NO: 1981 - protein, 307 aa, Arabidopsis thaliana
  misc_feature (1)..(307): Ceres CLONE ID no. 41320
  misc_feature (72)..(297): Pfam Name: Cytochrom_C1 Pfam Description: Cytochrome C1 family
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
MVGGGVIQQILRRKLHSQSLATPVLSWFSSKKAHEDAGSSGVRALALLGAGVSGLLSFSTVASADEAEHGLESPEYPWPHDGILSSYDHASIRRGHQVYQQVCASCHSMSLISYRDLVGVAYTEEEAKAMAAEIEVVDGPNDEGEMFTRPGKLSDRFPQPYANESAARFANGGAYPPDLSLITKARHNGPNYVFALLTGYRDPPAGISIREGLHYNPYFPGGAIAMPKMLNDEAVEYEDGVPATEAQMGKDIVSFLAWAAEPEMEERKLMGFKWIFLLSLALLQAAYYRRLKWSVLKSRKLVLDVVN

SEQ ID NO: 1982 - DNA, 933 bp, Populus balsamifera subsp. trichocarpa
  misc_feature (1)..(933): Ceres ANNOT ID no. 1541929
  misc_feature 221942:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
atggctggaggaggggtgatccaccagcttctgaggagaaaactccagtcacactctggggtccctccagtcttatcttcctttacttcaaagaaatttcatgatgatgctggatctttgggtatgaaatccctaagagcatttgcattactcggagccggactttcagggtttctgagttttgcatcagtagcatctgctgatgaggctgaacatgggttagagtgtccaagctatccttggcctcacaatgggattctaagctcatatgaccatgcttcgattcgtcgtggtcaccaggtttaccagcaagtatgtgcatcttgccactccatgtccttgatttcataccgtgatttggtgggtgttgcatatacagaagaggagaccaaggctatggcggcagaaattgaggtggttgatggacctaatgatgagggtgagatgtttacacgtccgggtaaacttagtgaccgttttcctcagccatattcaaatgaacaagcagctagatttgctaatggaggagcatatcctccagatttaagtcttattacaaaagctcgtcacaatggtcaaaactatgtgttttctctcttaactggttatcgtgatcctcctgctggtgtttcgatccgagagggtctgcactacaatccttactttcccgggggagctattgccatgcctaaaatgctcattgacggtgctgttgagtatgaagatggtatccctgcaactgaagctcagatgggaaaagacgttgtgtcgtttctgtcatgggctgcagaaccagaaatggaagagaggaaactgatgggttttaagtggatattcgtactctccttggcgttgcttcaagctgcttattaccggcgtttgaagtggtcggttctcaagtctcgcaagctggtccttgatgttgtcaattag

SEQ ID NO: 1983 - protein, 310 aa, Populus balsamifera subsp. trichocarpa
  misc_feature (1)..(310): Ceres ANNOT ID no. 1541929
  misc_feature (75)..(300): Pfam Name: Cytochrom_C1 Pfam Description: Cytochrome C1 family
  misc_feature: SWISSPROT Homolog: CY11_SOLTU Cytochrome c1, heme protein, (Clone PC13III) with e-value of 1.7e-135 and BLAST sequence identity of 91.5
  misc_feature: SWISSPROT Homolog: CY12_SOLTU Cytochrome c1, heme protein,  (Clone PC18I) (Fragment) with e-value of 2.3e-131 and BLAST sequence identity of 92.7
  misc_feature: SWISSPROT Homolog: CY1_MOUSE Cytochrome c1, heme protein, (Cytochrome c-1) with e-value of 3.0e-83 and BLAST sequence identity of 57.4
  misc_feature: SWISSPROT Homolog: CY1_HUMAN Cytochrome c1, heme protein, (Cytochrome c-1) with e-value of 1.1e-81 and BLAST sequence identity of 56.0
  misc_feature: SWISSPROT Homolog: CY1_BOVIN Cytochrome c1, heme protein, mitochondrial (Cytochrome c-1) with e-value of 1.4e-78 and BLAST sequence identity of 62.5
  misc_feature 222059:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature (1)..(310): Functional Homolog of  Ceres CLONE ID no. 41320 at SEQ ID NO. 2025 with e-value of 2.29E-146 and BLAST sequence identity of 88.9
MAGGGVIHQLLRRKLQSHSGVPPVLSSFTSKKFHDDAGSLGMKSLRAFALLGAGLSGFLSFASVASADEAEHGLECPSYPWPHNGILSSYDHASIRRGHQVYQQVCASCHSMSLISYRDLVGVAYTEEETKAMAAEIEVVDGPNDEGEMFTRPGKLSDRFPQPYSNEQAARFANGGAYPPDLSLITKARHNGQNYVFSLLTGYRDPPAGVSIREGLHYNPYFPGGAIAMPKMLIDGAVEYEDGIPATEAQMGKDVVSFLSWAAEPEMEERKLMGFKWIFVLSLALLQAAYYRRLKWSVLKSRKLVLDVVN

SEQ ID NO: 1984 - DNA, 933 bp, Populus balsamifera subsp. trichocarpa
  misc_feature (1)..(933): Ceres ANNOT ID no. 1460282
  misc_feature 222166:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
atggctggaggaggggtgatccaccagcttctgaggagaaaacttcagtcacactctggtgccacttcagttttatcttccttcacttcaaaaaaagttcatggtgatgctggatctgtgggtatgaagtccctaagagcgtttgcattatttggagctggactttcagggtttctgagttttgcatcagtagcatccgcggatgaggctgaacatgggttagagtgtccaagctatccttggccacacaaagggattctaagttcatatgaccactcttcgattcgtcgtggtcagcaggtgtaccagcaagtatgtgcatcttgccactccatgtccctgatttcatatcgtgatttggtgggtgttgcatatacagaagaggagaccaaggctatggcggcagagattgaggtggttgatggacctaatgatgagggtgagatgtttactcgtccgggtaaactcagtgaccgttttcctcagccatatgcgaatgaacaagcagctagatttgctaatggaggagcatatcctccagatttaagtcttattacaaaagctcgtcacaatggtcaaaactatgtgtttgctcttttaactggttatcgtgatcctcctgctggtgtttcgatccgagagggtttgcactacaatccttactttcctgggggagctattgccatgccaaagatgctcattgatggtgctgttgagtatgaagatggtacccctgcaacagaagctcagatgggaaaagatgttgtgtcgtttttgtcatgggctgcagaaccagaaatggaagagaggaaactgatgggttttaagtggatatttgtactttccttggcgttgcttcaagctgcatattaccggcgtttgaagtggtctgttctcaagtctcgcaagctggttcttgatgttgtcaattag

SEQ ID NO: 1985 - protein, 310 aa, Populus balsamifera subsp. trichocarpa
  misc_feature (1)..(310): Ceres ANNOT ID no. 1460282
  misc_feature (75)..(300): Pfam Name: Cytochrom_C1 Pfam Description: Cytochrome C1 family
  misc_feature: SWISSPROT Homolog: CY11_SOLTU Cytochrome c1, heme protein, (Clone PC13III) with e-value of 1.7e-135 and BLAST sequence identity of 91.5
  misc_feature: SWISSPROT Homolog: CY12_SOLTU Cytochrome c1, heme protein,  (Clone PC18I) (Fragment) with e-value of 2.3e-131 and BLAST sequence identity of 92.7
  misc_feature: SWISSPROT Homolog: CY1_MOUSE Cytochrome c1, heme protein, (Cytochrome c-1) with e-value of 3.0e-83 and BLAST sequence identity of 57.4
  misc_feature: SWISSPROT Homolog: CY1_HUMAN Cytochrome c1, heme protein, (Cytochrome c-1) with e-value of 1.1e-81 and BLAST sequence identity of 56.0
  misc_feature: SWISSPROT Homolog: CY1_BOVIN Cytochrome c1, heme protein, mitochondrial (Cytochrome c-1) with e-value of 1.4e-78 and BLAST sequence identity of 62.5
  misc_feature 222283:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature (1)..(310): Functional Homolog of  Ceres CLONE ID no. 41320 at SEQ ID NO. 2025 with e-value of 6.90E-145 and BLAST sequence identity of 88.9
MAGGGVIHQLLRRKLQSHSGATSVLSSFTSKKVHGDAGSVGMKSLRAFALFGAGLSGFLSFASVASADEAEHGLECPSYPWPHKGILSSYDHSSIRRGQQVYQQVCASCHSMSLISYRDLVGVAYTEEETKAMAAEIEVVDGPNDEGEMFTRPGKLSDRFPQPYANEQAARFANGGAYPPDLSLITKARHNGQNYVFALLTGYRDPPAGVSIREGLHYNPYFPGGAIAMPKMLIDGAVEYEDGTPATEAQMGKDVVSFLSWAAEPEMEERKLMGFKWIFVLSLALLQAAYYRRLKWSVLKSRKLVLDVVN

SEQ ID NO: 1986 - DNA, 870 bp, Populus balsamifera subsp. trichocarpa
  misc_feature (1)..(870): Ceres ANNOT ID no. 1488507
  misc_feature 222390:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
atggctggaggaggggtgatccaccagcttctgaggagaaaactccagtcacactctggggtccctccagtcttatcttcctttacttcaaagaaatttcatgatgatgctggatctttgggtatgaaatccctaagagcatttgcattactcggagccggactttcagggtttctgagttttgcatcagtagcatctgctgatgaggctgaacatgggttagagtgtccaagctatccttggcctcacaatgggattctaagctcatatgaccatgcttcgattcgtcgtggtcaccaggtttaccagcaagtatgtgcatcttgccactccatgtccttgatttcataccgtgatttggtgggtgttgcatatacagaagaggagaccaaggctatggcggcagaaattgaggtggttgatggacctaatgatgagggtgagatgtttacacgtccggaaatatcttacactttgttctttcaggctcgtcacaatggtcaaaactatgtgttttctctcttaactggttatcgtgatcctcctgctggtgtttcgatccgagagggtctgcactacaatccttactttcccgggggagctattgccatgcctaaaatgctcattgacggtgctgttgagtatgaagatggtatccctgcaactgaagctcaggttggtttcttcattatttttgtcgctaggttttcaggagaggcattaactgcaagactggaatgtactttctatcagatgggttttaagtggatattcgtactctccttggcgttgcttcaagctgcttattaccggcgtttgaagtggtcggttctcaagtctcgcaagctggtccttgatgttgtcaattag

SEQ ID NO: 1987 - protein, 289 aa, Populus balsamifera subsp. trichocarpa
  misc_feature (1)..(289): Ceres ANNOT ID no. 1488507
  misc_feature (75)..(279): Pfam Name: Cytochrom_C1 Pfam Description: Cytochrome C1 family
  misc_feature: SWISSPROT Homolog: CY11_SOLTU Cytochrome c1, heme protein, (Clone PC13III) with e-value of 1.7e-135 and BLAST sequence identity of 91.5
  misc_feature: SWISSPROT Homolog: CY12_SOLTU Cytochrome c1, heme protein,  (Clone PC18I) (Fragment) with e-value of 2.3e-131 and BLAST sequence identity of 92.7
  misc_feature: SWISSPROT Homolog: CY1_MOUSE Cytochrome c1, heme protein, (Cytochrome c-1) with e-value of 3.0e-83 and BLAST sequence identity of 57.4
  misc_feature: SWISSPROT Homolog: CY1_HUMAN Cytochrome c1, heme protein, (Cytochrome c-1) with e-value of 1.1e-81 and BLAST sequence identity of 56.0
  misc_feature: SWISSPROT Homolog: CY1_BOVIN Cytochrome c1, heme protein, mitochondrial (Cytochrome c-1) with e-value of 1.4e-78 and BLAST sequence identity of 62.5
  misc_feature 222505:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature (1)..(289): Functional Homolog of  Ceres CLONE ID no. 41320 at SEQ ID NO. 2025 with e-value of 1.30E-109 and BLAST sequence identity of 80.4
MAGGGVIHQLLRRKLQSHSGVPPVLSSFTSKKFHDDAGSLGMKSLRAFALLGAGLSGFLSFASVASADEAEHGLECPSYPWPHNGILSSYDHASIRRGHQVYQQVCASCHSMSLISYRDLVGVAYTEEETKAMAAEIEVVDGPNDEGEMFTRPEISYTLFFQARHNGQNYVFSLLTGYRDPPAGVSIREGLHYNPYFPGGAIAMPKMLIDGAVEYEDGIPATEAQVGFFIIFVARFSGEALTARLECTFYQMGFKWIFVLSLALLQAAYYRRLKWSVLKSRKLVLDVVN

SEQ ID NO: 1988 - protein, 393 aa, Arabidopsis thaliana
  misc_feature (1)..(393): Ceres CLONE ID no. 41337
  misc_feature (68)..(365): Pfam Name: E1_dh Pfam Description: Dehydrogenase E1 component
  misc_feature: Phenotype: WHOLE PLANT - Dark Green Useful for increasing chlorophyll and photosynthetic capacity
  misc_feature: Phenotype: INFLORESCENCE - Early Flowering Useful for modulating flowering time
  misc_feature: Phenotype: INFLORESCENCE - Short Useful for modulating plant height
  misc_feature: Phenotype: FLOWER - Other Useful for making ornamental plants with modified flowers
  misc_feature: Phenotype: INFLORESCENCE - Other Useful for making ornamental plants with modified flowers
  misc_feature (107)..(107): Xaa is any aa, unknown, or other
MALSRLSSRSNTFLKPAITALPSSIRRHVSTDSSPITIETAVPFTSHLCESPSRSVETSSEEILAFFRDMARMRRMEIAADSLYKAKLIRGFCHLYDGQEALAVGMXAAITKKDAIITSYRDHCTFIGRGGKLVDAFSELMGRKTGCSHGKGGSMHFYKKDASFYGGHGIVGAQIPLGCGLAFAQKYNKDEAVTFALYGDGAANQGQLFEALNISALWDLPAILVCENNHYGMGTATWRSAKSPAYFKRGDYVPGLKVDGMDALAVKQACKFAKEHALKNGPIILEMDTYRYHGHSMSDPGSTYRTRDEISGVRQVRDPIERVRKLLLTHDIATEKELKDMEKEIRKEVDDAVAQAKESPIPDASELFTNMYVKDCGVESFGADRKELKVTLP

SEQ ID NO: 1989 - DNA, 1182 bp, Populus balsamifera subsp. trichocarpa
  misc_feature (1)..(1182): Ceres ANNOT ID no. 1516613
  misc_feature 222745:<222: Transcription Factor
  misc_feature: Phenotype: WHOLE PLANT - Dark Green Useful for increasing chlorophyll and photosynthetic capacity
  misc_feature: Phenotype: INFLORESCENCE - Early Flowering Useful for modulating flowering time
  misc_feature: Phenotype: INFLORESCENCE - Short Useful for modulating plant height
  misc_feature: Phenotype: FLOWER - Other Useful for making ornamental plants with modified flowers
  misc_feature: Phenotype: INFLORESCENCE - Other Useful for making ornamental plants with modified flowers
atggccttatcacacctaaaatcatcttcctccggatccaatttcctcaaacctctcgccaccgccttttctctccgccgtccgatctctacctcaactgatcccctcacaatcgagacctccattcccttcactactcacagatgcgatccaccatcgcgcaccgtcgataccagtccccaagaactcctctccttcttccgcgacatggccaccatgcgccgtatggagatcgccgccgactctctatacaaggccaagctcatccgcggattctgccacctctacgacggtcaagaagccgtggccgttggtatggaggctgcaattaccaaaaaagacagcatcataactgcctaccgtgaccactgcacgtttctggggagaggtgggaccctcctggagatattttcggagctgatgggacgacagggcggttgttcgagtgggaaaggtgggtccatgcatttctataagaaaaatagtggattttatggagggcatggtattgtaggagctcaagtgccgttaggttgtggattggcatttgctcataagtataacaaggacgatgccgtcgcctttgctttgtatggagatggtgctgctaatcaaggacagttgttcgaggctcttaatatctcagctctttgggatcttccaatcattttggtctgcgagaataatcattatggaatggggacagccgagtggagagccgccaagagtccagcatactataagcgtggagattatgttcctggtttgaaggtagatggcatggatgcttttgctgtgaaacaagcatgcaaatttgcaaaggagcacgccttaaagagtggacccattatacttgaaatggatacctataggtatcatggtcactctatgtctgatcctgggagcacctaccgtacccgtgacgagatcagtggcgtgagacaggaacgtgatccaattgaaagaataagaaagttgatagtgacccatgatctagctactgagaaagagctgaaggatattgaaaaagaagtgagaaaacaagtagatgaagccattgctcaagccaaggaaagtcctatgccagaaccttcagaacttttcacaaacgtatacgcgaagggtatgggagttgaggcatatggagctgataggaaagaagttagagctgtgcttccctga

SEQ ID NO: 1990 - protein, 393 aa, Populus balsamifera subsp. trichocarpa
  misc_feature (1)..(393): Ceres ANNOT ID no. 1516613
  misc_feature (68)..(365): Pfam Name: E1_dh Pfam Description: Dehydrogenase E1 component
  misc_feature: SWISSPROT Homolog: ODPA_ARATH Pyruvate dehydrogenase E1 component alpha subunit, (EC 1.2.4.1) (PDHE1-A) with e-value of 9.1e-176 and BLAST sequence identity of 80.7
  misc_feature: SWISSPROT Homolog: ODPA_PEA Pyruvate dehydrogenase E1 component alpha subunit, (EC 1.2.4.1) (PDHE1-A) with e-value of 4.2e-171 and BLAST sequence identity of 79.2
  misc_feature: SWISSPROT Homolog: ODPA_SOLTU Pyruvate dehydrogenase E1 component alpha subunit, (EC 1.2.4.1) (PDHE1-A) with e-value of 4.6e-165 and BLAST sequence identity of 76.4
  misc_feature: SWISSPROT Homolog: ODPA_YEAST Pyruvate dehydrogenase E1 component alpha subunit, (EC 1.2.4.1) (PDHE1-A) with e-value of 8.1e-97 and BLAST sequence identity of 55.8
  misc_feature: SWISSPROT Homolog: ODPA_KLULA Pyruvate dehydrogenase E1 component alpha subunit, (EC 1.2.4.1) (PDHE1-A) with e-value of 9.3e-96 and BLAST sequence identity of 56.8
  misc_feature 222884:<222: Transcription Factor
  misc_feature: Phenotype: WHOLE PLANT - Dark Green Useful for increasing chlorophyll and photosynthetic capacity
  misc_feature: Phenotype: INFLORESCENCE - Early Flowering Useful for modulating flowering time
  misc_feature: Phenotype: INFLORESCENCE - Short Useful for modulating plant height
  misc_feature: Phenotype: FLOWER - Other Useful for making ornamental plants with modified flowers
  misc_feature: Phenotype: INFLORESCENCE - Other Useful for making ornamental plants with modified flowers
  misc_feature (1)..(393): Functional Homolog of  Ceres CLONE ID no. 41337 at SEQ ID NO. 2032 with e-value of 1.60E-175 and BLAST sequence identity of 80.5
MALSHLKSSSSGSNFLKPLATAFSLRRPISTSTDPLTIETSIPFTTHRCDPPSRTVDTSPQELLSFFRDMATMRRMEIAADSLYKAKLIRGFCHLYDGQEAVAVGMEAAITKKDSIITAYRDHCTFLGRGGTLLEIFSELMGRQGGCSSGKGGSMHFYKKNSGFYGGHGIVGAQVPLGCGLAFAHKYNKDDAVAFALYGDGAANQGQLFEALNISALWDLPIILVCENNHYGMGTAEWRAAKSPAYYKRGDYVPGLKVDGMDAFAVKQACKFAKEHALKSGPIILEMDTYRYHGHSMSDPGSTYRTRDEISGVRQERDPIERIRKLIVTHDLATEKELKDIEKEVRKQVDEAIAQAKESPMPEPSELFTNVYAKGMGVEAYGADRKEVRAVLP

SEQ ID NO: 1991 - DNA, 1182 bp, Populus balsamifera subsp. trichocarpa
  misc_feature (1)..(1182): Ceres ANNOT ID no. 1513097
  misc_feature 223020:<222: Transcription Factor
  misc_feature: Phenotype: WHOLE PLANT - Dark Green Useful for increasing chlorophyll and photosynthetic capacity
  misc_feature: Phenotype: INFLORESCENCE - Early Flowering Useful for modulating flowering time
  misc_feature: Phenotype: INFLORESCENCE - Short Useful for modulating plant height
  misc_feature: Phenotype: FLOWER - Other Useful for making ornamental plants with modified flowers
  misc_feature: Phenotype: INFLORESCENCE - Other Useful for making ornamental plants with modified flowers
atggccttatctcacctaaaatcgttttcatccagatccaatctagtcaaacctctagccaccgccttttctctccgccgtcagatctccacctccaccgatcccatcacaattgagacctccgttcccttcgccactcacagatgcgatcctccatcacgcaccgtcgagaccaatccccaggagctccagtccttcttccgcgtcatggccacgatgcgccgtatggagatagccgccgactctctctacaaggccaaactcatccgtggattttgccacctctacgatggtcaagaagccgtggccgttggaatggaggctgcaattaccaaaaatgacagcatcattactgcctaccgcgaccactgcacgtttctcgggagaggtgggaccctcctggaggtgttttcggagctgatgggacgacagggcggttgttcgaaggggaaaggtggatccatgcatttctataagaaggatagcgggttttatggagggcatggtatagtgggagctcaagtacccttaggctgtggattggcatttgcccacaagtataacaaggacgacgccgtcgcttttgctttgtatggagatggtgctgctaatcaaggacagttgttcgaggcccttaatatctccgctctttgggatcttcctatcattttggtctgcgagaataatcattatggaatggggacagctgagtggagagccgccaagagtccagcatactacaagcgtggagactatgttcctggcttgaaggtagatggcatggatgcttttgctgtgaaacaagcatgcaaatttgcaaaggagcatgccttaaagagtggacctattatacttgaaatggatacctacaggtatcatggtcattctatgtctgatcctgggagcacctatcgtacccgtgatgagattagtggcgtgagacaggaacgtgatccaattgaacgaataagaaaattgatattgactcatgatctagctactgagaaagagctaaaggatattgaaaaagaagtgagaaaacaagtagacgaagccattgctcaagctaaggaaagtcccatgccagatccttcagaacttttcaccaatgtatacgtgaaaggtctgggagttgaggcatatggagctgataggaaagaagttagagctgtgcttccctaa

SEQ ID NO: 1992 - protein, 393 aa, Populus balsamifera subsp. trichocarpa
  misc_feature (1)..(393): Ceres ANNOT ID no. 1513097
  misc_feature (68)..(365): Pfam Name: E1_dh Pfam Description: Dehydrogenase E1 component
  misc_feature: SWISSPROT Homolog: ODPA_ARATH Pyruvate dehydrogenase E1 component alpha subunit, (EC 1.2.4.1) (PDHE1-A) with e-value of 9.1e-176 and BLAST sequence identity of 80.7
  misc_feature: SWISSPROT Homolog: ODPA_PEA Pyruvate dehydrogenase E1 component alpha subunit, (EC 1.2.4.1) (PDHE1-A) with e-value of 4.2e-171 and BLAST sequence identity of 79.2
  misc_feature: SWISSPROT Homolog: ODPA_SOLTU Pyruvate dehydrogenase E1 component alpha subunit, (EC 1.2.4.1) (PDHE1-A) with e-value of 4.6e-165 and BLAST sequence identity of 76.4
  misc_feature: SWISSPROT Homolog: ODPA_YEAST Pyruvate dehydrogenase E1 component alpha subunit, (EC 1.2.4.1) (PDHE1-A) with e-value of 8.1e-97 and BLAST sequence identity of 55.8
  misc_feature: SWISSPROT Homolog: ODPA_KLULA Pyruvate dehydrogenase E1 component alpha subunit, (EC 1.2.4.1) (PDHE1-A) with e-value of 9.3e-96 and BLAST sequence identity of 56.8
  misc_feature 223159:<222: Transcription Factor
  misc_feature: Phenotype: WHOLE PLANT - Dark Green Useful for increasing chlorophyll and photosynthetic capacity
  misc_feature: Phenotype: INFLORESCENCE - Early Flowering Useful for modulating flowering time
  misc_feature: Phenotype: INFLORESCENCE - Short Useful for modulating plant height
  misc_feature: Phenotype: FLOWER - Other Useful for making ornamental plants with modified flowers
  misc_feature: Phenotype: INFLORESCENCE - Other Useful for making ornamental plants with modified flowers
  misc_feature (1)..(393): Functional Homolog of  Ceres CLONE ID no. 41337 at SEQ ID NO. 2032 with e-value of 1.19E-174 and BLAST sequence identity of 81.5
MALSHLKSFSSRSNLVKPLATAFSLRRQISTSTDPITIETSVPFATHRCDPPSRTVETNPQELQSFFRVMATMRRMEIAADSLYKAKLIRGFCHLYDGQEAVAVGMEAAITKNDSIITAYRDHCTFLGRGGTLLEVFSELMGRQGGCSKGKGGSMHFYKKDSGFYGGHGIVGAQVPLGCGLAFAHKYNKDDAVAFALYGDGAANQGQLFEALNISALWDLPIILVCENNHYGMGTAEWRAAKSPAYYKRGDYVPGLKVDGMDAFAVKQACKFAKEHALKSGPIILEMDTYRYHGHSMSDPGSTYRTRDEISGVRQERDPIERIRKLILTHDLATEKELKDIEKEVRKQVDEAIAQAKESPMPDPSELFTNVYVKGLGVEAYGADRKEVRAVLP

SEQ ID NO: 1993 - DNA, 1305 bp, Populus balsamifera subsp. trichocarpa
  misc_feature (1)..(1305): Ceres ANNOT ID no. 1463324
  misc_feature 223295:<222: Transcription Factor
  misc_feature: Phenotype: WHOLE PLANT - Dark Green Useful for increasing chlorophyll and photosynthetic capacity
  misc_feature: Phenotype: INFLORESCENCE - Early Flowering Useful for modulating flowering time
  misc_feature: Phenotype: INFLORESCENCE - Short Useful for modulating plant height
  misc_feature: Phenotype: FLOWER - Other Useful for making ornamental plants with modified flowers
  misc_feature: Phenotype: INFLORESCENCE - Other Useful for making ornamental plants with modified flowers
atggccttatcacacctaaaatcatcttcctccggatccaatttcctcaaacctctcgccaccgccttttctctccgccgtccgatctctacctcaactgatcccctcacaatcgagacctccattcccttcactactcacagatgcgatccaccatcgcgcaccgtcgataccagtccccaagaactcctctccttcttccgcgacatggccaccatgcgccgtatggagatcgccgccgactctctatacaaggccaagctcatccgcggattctgccacctctacgacggtcaagaagccgtggccgttggtatggaggctgcaattaccaaaaaagacagcatcataactgcctaccgtgaccactgcacgtttctggggagaggtgggaccctcctggagatattttcggagctgatgggacgacagggcggttgttcgagtgggaaaggtgggtccatgcatttctataagaaaaatagtggattttatggagggcatggtattgtaggagctcaagtgccgttaggttgtggattggcatttgctcataagtataacaaggacgatgccgtcgcctttgctttgtatggagatggtgctgctaatcaaggacagttgttcgaggctcttaatatctcagctctttgggatcttccaatcattttggtctgcgagaataatcattatggaatggggacagccgagtggagagccgccaagagtccagcatactataagcgtggagattatgttcctggtttgaagagaaatgggaatgttatctgtgttgttattttggaagtatccatgcctattctgttctattgtttaaatgtagatggcatggatgcttttgctgtgaaacaagcatgcaaatttgcaaaggagcacgccttaaagagtggacccattatacttgaaatggatacctataggtatcatggtcactctatgtctgatcctgggagcacctaccgtacccgtgacgagatcagtggcgtgagacaggaacgtgatccaattgaaagaataagaaagttgatagtgacccatgatctagctactgagaaagagctgaaggatattgaaaaagaagtgagaaaacaagtagatgaagccattgctcaagccaaggaaagtcctatgccagaaccttcagaacttttcacaaacgtatacgcgaagggtatgggagttgaggatagttctgaacatctaaaaaccttctcaagtactgtcagtacgagtttcttggcatatggagctgataggaaagaagttagagctgtgcttccctga

SEQ ID NO: 1994 - protein, 434 aa, Populus balsamifera subsp. trichocarpa
  misc_feature (1)..(434): Ceres ANNOT ID no. 1463324
  misc_feature (279)..(388): Pfam Name: E1_dh Pfam Description: Dehydrogenase E1 component
  misc_feature: SWISSPROT Homolog: ODPA_ARATH Pyruvate dehydrogenase E1 component alpha subunit, (EC 1.2.4.1) (PDHE1-A) with e-value of 9.1e-176 and BLAST sequence identity of 80.7
  misc_feature: SWISSPROT Homolog: ODPA_PEA Pyruvate dehydrogenase E1 component alpha subunit, (EC 1.2.4.1) (PDHE1-A) with e-value of 4.2e-171 and BLAST sequence identity of 79.2
  misc_feature: SWISSPROT Homolog: ODPA_SOLTU Pyruvate dehydrogenase E1 component alpha subunit, (EC 1.2.4.1) (PDHE1-A) with e-value of 4.6e-165 and BLAST sequence identity of 76.4
  misc_feature: SWISSPROT Homolog: ODPA_YEAST Pyruvate dehydrogenase E1 component alpha subunit, (EC 1.2.4.1) (PDHE1-A) with e-value of 8.1e-97 and BLAST sequence identity of 55.8
  misc_feature: SWISSPROT Homolog: ODPA_KLULA Pyruvate dehydrogenase E1 component alpha subunit, (EC 1.2.4.1) (PDHE1-A) with e-value of 9.3e-96 and BLAST sequence identity of 56.8
  misc_feature 223438:<222: Transcription Factor
  misc_feature: Phenotype: WHOLE PLANT - Dark Green Useful for increasing chlorophyll and photosynthetic capacity
  misc_feature: Phenotype: INFLORESCENCE - Early Flowering Useful for modulating flowering time
  misc_feature: Phenotype: INFLORESCENCE - Short Useful for modulating plant height
  misc_feature: Phenotype: FLOWER - Other Useful for making ornamental plants with modified flowers
  misc_feature: Phenotype: INFLORESCENCE - Other Useful for making ornamental plants with modified flowers
  misc_feature (1)..(434): Functional Homolog of  Ceres CLONE ID no. 41337 at SEQ ID NO. 2032 with e-value of 2.39E-165 and BLAST sequence identity of 80.5
MALSHLKSSSSGSNFLKPLATAFSLRRPISTSTDPLTIETSIPFTTHRCDPPSRTVDTSPQELLSFFRDMATMRRMEIAADSLYKAKLIRGFCHLYDGQEAVAVGMEAAITKKDSIITAYRDHCTFLGRGGTLLEIFSELMGRQGGCSSGKGGSMHFYKKNSGFYGGHGIVGAQVPLGCGLAFAHKYNKDDAVAFALYGDGAANQGQLFEALNISALWDLPIILVCENNHYGMGTAEWRAAKSPAYYKRGDYVPGLKRNGNVICVVILEVSMPILFYCLNVDGMDAFAVKQACKFAKEHALKSGPIILEMDTYRYHGHSMSDPGSTYRTRDEISGVRQERDPIERIRKLIVTHDLATEKELKDIEKEVRKQVDEAIAQAKESPMPEPSELFTNVYAKGMGVEDSSEHLKTFSSTVSTSFLAYGADRKEVRAVLP

SEQ ID NO: 1995 - protein, 347 aa, Arabidopsis thaliana
  misc_feature (1)..(347): Ceres CLONE ID no. 41359
  misc_feature (166)..(338): Pfam Name: TMPIT Pfam Description: TMPIT-like protein
  misc_feature: Utility: MSX Useful for making plants tolerant to low nitrogen
  misc_feature: Phenotype: WHOLE PLANT - MSX Useful for making plants tolerant to low nitrogen
MEVEEEVKQIIDEVKELHDSAASFISSSSQQELSLRQKASAVDSSIRRLHSTIVSNKNLDPKLVEKLEEDLHRARCMLVDGETSSFLPSKPQGRFVRMFCGPVNVRALRKDVQLKVKEEYNRYRDKTALLFLFFPATLLILRSYYWGGCLPAFPVQLYEAWLLFLYAGLAMRENILRANGSDIRPWWLYHHYCAMAMALVSLTWEIKGQPNCVQKQRGVHLFLQWAMMQGVAMLLQNRYQRQRLYTRIALGKAKRMDVVWGETAGVDGQLWLLCPILFILQVFEAYVGLLLLRKTVTGVVNEWQVMVCGILLVVMAVGNFINTVETLMAKSRVKAKMKRSKSRAELN

SEQ ID NO: 1996 - DNA, 1092 bp, Populus balsamifera subsp. trichocarpa
  misc_feature (1)..(1092): Ceres ANNOT ID no. 1520442
  misc_feature: Utility: MSX Useful for making plants tolerant to low nitrogen
  misc_feature 223689:<222: Transcription Factor
  misc_feature: Phenotype: WHOLE PLANT - MSX Useful for making plants tolerant to low nitrogen
atggctgcgccggcgaataataacaacaacaataatagtccggcggcggcggcggcggaggatactgtggaggaagaggtagctcgagtggtggaacaagcgaaggagttgcaagaaaccgcagcttctttaattgctaaatcttcacatgatgaacaatctcttcgacagaaagctctctctctcgaatcttctgttcgccgttgccgttctctccttaaccgcaacaatggcctcgctcctaaattacttgaagaagatttacagaaagcaagatgtattataactgatggagatgcttccgcttttcttccttcaaagcctcaagggcgttttctaaaaatgtttttgggaccgattaatgtgcgggcgtctcgcaaagatgtgcagtggaaggttaaagaggagtataacagctacagggataggactgcgcttttgtttcttcttttcccatcggttttactgtgtttaagatcttgggtttggaatgggtgcttgcctacgtttccggttcaattgtatcaggcctggctattgtttctctacactggattggctttgagagagaacatattgagagccaatggaagtgatattcgtccatggtggatataccatcactattgtgcgatgattatggcccttgttagtctcacttgggacatcaaaggacaaccaaattgtgctcagaagcagagaggggttgaactgttcttgcaatgggctatgatgcaaggagtagcaatgcttttgcaaaatagatatcaacgccagagactctatactcgtattgcgttgggaaaggctaagcgaatggatgttgtatggggagaaacagctggggtggatgggcaattgtggctgttgtatcctattctcttcattctgcagggttttgaggcatatgttggactacagctgctgaggactgcattcaaaggggtcacctctgaatggcaggttattttctgcggtatccttctggtcttcatggcggttgggaacttcttaaacacagtacagacactaatggcaaagtcaaggtttaaggctaaaatgaaaagtaagagcaagcaggaattggattga

SEQ ID NO: 1997 - protein, 363 aa, Populus balsamifera subsp. trichocarpa
  misc_feature (1)..(363): Ceres ANNOT ID no. 1520442
  misc_feature (14)..(355): Pfam Name: TMPIT Pfam Description: TMPIT-like protein
  misc_feature: SWISSPROT Homolog: Y33B_DROME Hypothetical protein CG32795 in chromosome 1 with e-value of 4.5e-19 and BLAST sequence identity of 26.9
  misc_feature: Utility: MSX Useful for making plants tolerant to low nitrogen
  misc_feature 223771:<222: Transcription Factor
  misc_feature: Phenotype: WHOLE PLANT - MSX Useful for making plants tolerant to low nitrogen
  misc_feature (1)..(363): Functional Homolog of  Ceres CLONE ID no. 41359 at SEQ ID NO. 2039 with e-value of 4.10E-140 and BLAST sequence identity of 76.5
MAAPANNNNNNNSPAAAAAEDTVEEEVARVVEQAKELQETAASLIAKSSHDEQSLRQKALSLESSVRRCRSLLNRNNGLAPKLLEEDLQKARCIITDGDASAFLPSKPQGRFLKMFLGPINVRASRKDVQWKVKEEYNSYRDRTALLFLLFPSVLLCLRSWVWNGCLPTFPVQLYQAWLLFLYTGLALRENILRANGSDIRPWWIYHHYCAMIMALVSLTWDIKGQPNCAQKQRGVELFLQWAMMQGVAMLLQNRYQRQRLYTRIALGKAKRMDVVWGETAGVDGQLWLLYPILFILQGFEAYVGLQLLRTAFKGVTSEWQVIFCGILLVFMAVGNFLNTVQTLMAKSRFKAKMKSKSKQELD

SEQ ID NO: 1998 - protein, 273 aa, Arabidopsis thaliana
  misc_feature (1)..(273): Ceres CLONE ID no. 41439
  misc_feature (106)..(128): Pfam Name: zf-C2H2 Pfam Description: Zinc finger, C2H2 type
  misc_feature: Phenotype: ROSETTE LEAVES - Cup-shaped Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Oval Shaped Useful for making plants with increased biomass and foliage
MALEAMNTPTSSFTRIETKEDLMNDAVFIEPWLKRKRSKRQRSHSPSSSSSSPPRSRPKSQNQDLTEEEYLALCLLMLAKDQPSQTRFHQQSQSLTPPPESKNLPYKCNVCEKAFPSYQALGGHKASHRIKPPTVISTTADDSTAPTISIVAGEKHPIAASGKIHECSICHKVFPTGQALGGHKRCHYEGNLGGGGGGGSKSISHSGSVSSTVSEERSHRGFIDLNLPALPELSLHHNPIVDEEILSPLTGKKPLLLTDHDQVIKKEDLSLKI

SEQ ID NO: 1999 - protein, 330 aa, Arabidopsis thaliana
  misc_feature (1)..(330): Ceres CLONE ID no. 41446
  misc_feature (48)..(294): Pfam Name: peroxidase Pfam Description: Peroxidase
  misc_feature: Phenotype: WHOLE PLANT - Dark Green Useful for increasing chlorophyll and photosynthetic capacity
  misc_feature: Phenotype: ROSETTE LEAVES - Glossy Useful for making plants with enhanced abiotic stress tolerance
TLQHFLQKQDEDCKVFCSTLAFIYFPRGISAVKFKFYSESCPNAETIVENLVRQQFARDPSITAALTRMHFHDCFVQGCDASLLIDPTTSQLSEKNAGPNFSVRGFELIDEIKTALEAQCPSTVSCSDIVTLATRDAVFLGGGPSYVVPTGRRDGFVSNPEDANEILPPPFISVEGMLSFFGNKGMNVFDSVALLGAHTVGIASCGNFVDRVTNFQGTGLPDPSMDPTLAGRLRNTCAVPGGFAALDQSMPVTPVSFDNLFFGQIRERKGILLIDQLIASDPATSGVVLQYASNNELFKRQFAIAMVKMGAVDVLTGSAGEIRTNCRAFN

SEQ ID NO: 2000 - DNA, 1062 bp, Populus balsamifera subsp. trichocarpa
  misc_feature (1)..(1062): Ceres ANNOT ID no. 1469832
  misc_feature 224095:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Glossy Useful for making plants with enhanced abiotic stress tolerance
atgggaatgaaatcttcatttctgctcattctcttcattgttccggctgtattagccgatctaagagttgggttttacaaaccaacatgccctgacgcagaatctatcatttttcaggcagtgcaaaagcggttcaacacagataaatccgtaaccgcagccttgcttcgcatgcattttcacgattgcttcgttagaggatgtgatgcatctattcttatagattcaaccactcaaaaccaagcagagaaagatgcaggaccgaaccagactgtccgtgaatacgagcttattgatgagatcaagaaagccttagaggctaaatgcccttcaaaagtctcatgtgcagacatcataacagttgcaaccagagatgctgtagttcttgctggaggaccaaactacactgtacctacaggaagacgtgacgggctagtctctagagcgggtgatgtgaacttgcctggaccacaagtggacgtgtctcaagcatttcaaattttcagagcaaaaggtctaacccttgaagaaatggtgatcctgttaggagcacatactgttggtgttgcacattgtagtttcttcagtgaacgtcttcaaaatgatccatcaatggatgctaatttagctgccaacctgagtaatgtctgtgctaatccaaatactgatcctactgtattgttggaccaaggcacaggttttgtggttgataatgagttctacaaacagctccttttgaagagaggaataatgcatattgaccaggaacttgccatagatagctctacttctggtttcgtttcacgttttgcgagagatgggaatggatttaagcagagctttggaaaagcaatggtgaagatggggagcgttggggttcttgttggaaatggtggagaagtgaggaaaaattgtagagttttcaatccgaaaaacaaacctactgtcccaagtcccccaaagaaagacaaggtttcacctcccagcaaaaaagccaataataaaaagcaaaagaaacctaagggtaacgggaagaagaataagaacacaagagcactgtag

SEQ ID NO: 2001 - protein, 351 aa, Populus balsamifera subsp. trichocarpa
  misc_feature (1)..(351): Ceres ANNOT ID no. 1469832
  misc_feature (35)..(271): Pfam Name: peroxidase Pfam Description: Peroxidase
  misc_feature: SWISSPROT Homolog: PER28_ARATH Peroxidase 28 precursor (EC 1.11.1.7) (Atperox P28) (ATP39) with e-value of 2.7e-160 and BLAST sequence identity of 97.4
  misc_feature: SWISSPROT Homolog: PER57_ARATH Peroxidase 57 precursor (EC 1.11.1.7) (Atperox P57) (PRXR10) (ATP13a) with e-value of 7.4e-103 and BLAST sequence identity of 65.8
  misc_feature: SWISSPROT Homolog: PER44_ARATH Peroxidase 44 precursor (EC 1.11.1.7) (Atperox P44) (ATP35) with e-value of 1.1e-78 and BLAST sequence identity of 53.4
  misc_feature: SWISSPROT Homolog: PER8_ARATH Peroxidase 8 precursor (EC 1.11.1.7) (Atperox P8) with e-value of 2.9e-69 and BLAST sequence identity of 48.7
  misc_feature: SWISSPROT Homolog: PERA2_ARMRU Peroxidase A2 (EC 1.11.1.7) with e-value of 6.2e-67 and BLAST sequence identity of 47.8
  misc_feature 224209:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Glossy Useful for making plants with enhanced abiotic stress tolerance
  misc_feature (1)..(351): Functional Homolog of  Ceres CLONE ID no. 41446 at SEQ ID NO. 2043 with e-value of 1.19E-76 and BLAST sequence identity of 54.1
MKSSFLLILFIVPAVLADLRVGFYKPTCPDAESIIFQAVQKRFNTDKSVTAALLRMHFHDCFVRGCDASILIDSTTQNQAEKDAGPNQTVREYELIDEIKKALEAKCPSKVSCADIITVATRDAVVLAGGPNYTVPTGRRDGLVSRAGDVNLPGPQVDVSQAFQIFRAKGLTLEEMVILLGAHTVGVAHCSFFSERLQNDPSMDANLAANLSNVCANPNTDPTVLLDQGTGFVVDNEFYKQLLLKRGIMHIDQELAIDSSTSGFVSRFARDGNGFKQSFGKAMVKMGSVGVLVGNGGEVRKNCRVFNPKNKPTVPSPPKKDKVSPPSKKANNKKQKKPKGNGKKNKNTRAL

SEQ ID NO: 2002 - protein, 150 aa, Arabidopsis thaliana
  misc_feature (1)..(150): Ceres CLONE ID no. 41471
  misc_feature (28)..(146): Pfam Name: Ribosomal_S11 Pfam Description: Ribosomal protein S11
  misc_feature: Utility: MSX Useful for making plants tolerant to low nitrogen
  misc_feature: Phenotype: WHOLE PLANT - MSX Useful for making plants tolerant to low nitrogen
  misc_feature (128)..(128): Xaa is any aa, unknown, or other
MSKRKTKEPKVDVVTLGPSVREGEQVFGVVHIFASFNDTFIHVTDLSGRETLVRITGGMKVKADRDESSPYAAMLAAQDVAQRCKELGITAMHVKLRATGGNKTKTPGPGAQSALRALARSGMKIGRXEDVTPIPTDSTRRKGGRRGRRL

SEQ ID NO: 2003 - DNA, 453 bp, Populus balsamifera subsp. trichocarpa
  misc_feature (1)..(453): Ceres ANNOT ID no. 1515268
  misc_feature: Utility: MSX Useful for making plants tolerant to low nitrogen
  misc_feature 224390:<222: Transcription Factor
  misc_feature: Phenotype: WHOLE PLANT - MSX Useful for making plants tolerant to low nitrogen
atgtcgaggagaaagacaagagagccaaaggaagagaatgttacacttggcccaactgtaagggagggagagcatgttttcggggtggctcacatttttgcttcctttaatgatacctttattcatgtgactgatttatctgggagggaaactctggttcgtattactggtggaatgaaggttaaagctgacagggatgaatcttcaccatatgctgctatgcttgctgcacaggatgtttcacagagatgcaaggaacttggcattactgctcttcacatcaagctgcgtgctacaggaggtaacaaaactaagacccctggtccaggtgctcagtctgctctgagggcattggctcgttctggaatgaaaattggtcgtattgaggacgtcacaccaattcctactgacagcacccgcagaaagggtggaagaaggggtagaaggctgtaa

SEQ ID NO: 2004 - protein, 150 aa, Populus balsamifera subsp. trichocarpa
  misc_feature (1)..(150): Ceres ANNOT ID no. 1515268
  misc_feature (28)..(146): Pfam Name: Ribosomal_S11 Pfam Description: Ribosomal protein S11
  misc_feature: SWISSPROT Homolog: RS141_ARATH 40S ribosomal protein S14-1 with e-value of 7.0e-75 and BLAST sequence identity of 99.3
  misc_feature: SWISSPROT Homolog: RS142_ARATH 40S ribosomal protein S14-2 with e-value of 4.9e-74 and BLAST sequence identity of 98.0
  misc_feature: SWISSPROT Homolog: RS143_ARATH 40S ribosomal protein S14-3 with e-value of 7.2e-73 and BLAST sequence identity of 96.0
  misc_feature: SWISSPROT Homolog: RS141_MAIZE 40S ribosomal protein S14 (Clone MCH1) with e-value of 7.6e-69 and BLAST sequence identity of 91.3
  misc_feature: SWISSPROT Homolog: RS142_MAIZE 40S ribosomal protein S14 (Clone MCH2) with e-value of 1.4e-67 and BLAST sequence identity of 89.9
  misc_feature: Utility: MSX Useful for making plants tolerant to low nitrogen
  misc_feature 224480:<222: Transcription Factor
  misc_feature: Phenotype: WHOLE PLANT - MSX Useful for making plants tolerant to low nitrogen
  misc_feature (1)..(150): Functional Homolog of  Ceres CLONE ID no. 41471 at SEQ ID NO. 2046 with e-value of 1.70E-70 and BLAST sequence identity of 92.0
MSRRKTREPKEENVTLGPTVREGEHVFGVAHIFASFNDTFIHVTDLSGRETLVRITGGMKVKADRDESSPYAAMLAAQDVSQRCKELGITALHIKLRATGGNKTKTPGPGAQSALRALARSGMKIGRIEDVTPIPTDSTRRKGGRRGRRL

SEQ ID NO: 2005 - DNA, 657 bp, Populus balsamifera subsp. trichocarpa
  misc_feature (1)..(657): Ceres ANNOT ID no. 1461975
  misc_feature: Utility: MSX Useful for making plants tolerant to low nitrogen
  misc_feature 224549:<222: Transcription Factor
  misc_feature: Phenotype: WHOLE PLANT - MSX Useful for making plants tolerant to low nitrogen
atgtcgaggagaaagacaagagagccaaaggaagagaatgttacacttggcccaactgtaagggagggagagcatgttttcggggtggctcacatttttgcttcctttaatgatacctttattcatgtgactgatttatctgggagggaaactctggttcgtattactggtggaatgaaggttaaagctgacagggatgaatcttcaccatatgctgctatgcttgctgcacaggatgtttcacagagatgcaaggaacttggcattactgctcttcacatcaagctgcgtgctacaggaggtaacaaaactaagacccctggtccaggtgctcagtctgctctgagggcattggctcgttctggaatgaaaattggtcgtattgaggacgtcacaccaattcctactgacagcacccgcagaaagggtggaagaaggggtagaaggctgagacaagaagaaatggtggtaactattaatgaaccttacggtgtgggtgcaagaccagaacttagacctagaatggtgtcaacaccagccttgaagttcttagccaggatgttatcatcaatgccagcggcgaaaagggcggtgggaagttatacggtccccgcactagtactcacgaaggcaggaattgctaaagctggctcttga

SEQ ID NO: 2006 - protein, 218 aa, Populus balsamifera subsp. trichocarpa
  misc_feature (1)..(218): Ceres ANNOT ID no. 1461975
  misc_feature (28)..(146): Pfam Name: Ribosomal_S11 Pfam Description: Ribosomal protein S11
  misc_feature: SWISSPROT Homolog: RS141_ARATH 40S ribosomal protein S14-1 with e-value of 7.0e-75 and BLAST sequence identity of 99.3
  misc_feature: SWISSPROT Homolog: RS142_ARATH 40S ribosomal protein S14-2 with e-value of 4.9e-74 and BLAST sequence identity of 98.0
  misc_feature: SWISSPROT Homolog: RS143_ARATH 40S ribosomal protein S14-3 with e-value of 7.2e-73 and BLAST sequence identity of 96.0
  misc_feature: SWISSPROT Homolog: RS141_MAIZE 40S ribosomal protein S14 (Clone MCH1) with e-value of 7.6e-69 and BLAST sequence identity of 91.3
  misc_feature: SWISSPROT Homolog: RS142_MAIZE 40S ribosomal protein S14 (Clone MCH2) with e-value of 1.4e-67 and BLAST sequence identity of 89.9
  misc_feature: Utility: MSX Useful for making plants tolerant to low nitrogen
  misc_feature 224645:<222: Transcription Factor
  misc_feature: Phenotype: WHOLE PLANT - MSX Useful for making plants tolerant to low nitrogen
  misc_feature (1)..(218): Functional Homolog of  Ceres CLONE ID no. 41471 at SEQ ID NO. 2046 with e-value of 1.70E-70 and BLAST sequence identity of 92.0
MSRRKTREPKEENVTLGPTVREGEHVFGVAHIFASFNDTFIHVTDLSGRETLVRITGGMKVKADRDESSPYAAMLAAQDVSQRCKELGITALHIKLRATGGNKTKTPGPGAQSALRALARSGMKIGRIEDVTPIPTDSTRRKGGRRGRRLRQEEMVVTINEPYGVGARPELRPRMVSTPALKFLARMLSSMPAAKRAVGSYTVPALVLTKAGIAKAGS

SEQ ID NO: 2007 - DNA, 456 bp, Populus balsamifera subsp. trichocarpa
  misc_feature (1)..(456): Ceres ANNOT ID no. 1449897
  misc_feature: Utility: MSX Useful for making plants tolerant to low nitrogen
  misc_feature 224726:<222: Transcription Factor
  misc_feature: Phenotype: WHOLE PLANT - MSX Useful for making plants tolerant to low nitrogen
atgtcatcaaggagaaagactagagagccaaaggaagaaaatgtgacccttggacccactgtgagggaaggggagcatgcttttggagttgctcacatctttgcatcatttaacgatacattcattcatgtgactgatctctctggaagagaaacccttgtacgcataactggtggaatgaaagtgaaagctgacagagatgagtcttcaccatatgcagccatgcttgctgcccaggatgtgtcacagagatgcaaggaacttggcattactgcccttcatattaagcttcgtgctactggtgggaacaagacaaagacacctggtccaggtgcacagtctgcccttcgtgccctttctcgttctggaatgagaattggtcgcatagaggatgtgactccaattccaacggatagcactcgtagaaagggtggtagaagagggagaaggctttaa

SEQ ID NO: 2008 - protein, 151 aa, Populus balsamifera subsp. trichocarpa
  misc_feature (1)..(151): Ceres ANNOT ID no. 1449897
  misc_feature (29)..(147): Pfam Name: Ribosomal_S11 Pfam Description: Ribosomal protein S11
  misc_feature: SWISSPROT Homolog: RS141_ARATH 40S ribosomal protein S14-1 with e-value of 7.0e-75 and BLAST sequence identity of 99.3
  misc_feature: SWISSPROT Homolog: RS142_ARATH 40S ribosomal protein S14-2 with e-value of 4.9e-74 and BLAST sequence identity of 98.0
  misc_feature: SWISSPROT Homolog: RS143_ARATH 40S ribosomal protein S14-3 with e-value of 7.2e-73 and BLAST sequence identity of 96.0
  misc_feature: SWISSPROT Homolog: RS141_MAIZE 40S ribosomal protein S14 (Clone MCH1) with e-value of 7.6e-69 and BLAST sequence identity of 91.3
  misc_feature: SWISSPROT Homolog: RS142_MAIZE 40S ribosomal protein S14 (Clone MCH2) with e-value of 1.4e-67 and BLAST sequence identity of 89.9
  misc_feature: Utility: MSX Useful for making plants tolerant to low nitrogen
  misc_feature 224816:<222: Transcription Factor
  misc_feature: Phenotype: WHOLE PLANT - MSX Useful for making plants tolerant to low nitrogen
  misc_feature (1)..(151): Functional Homolog of  Ceres CLONE ID no. 41471 at SEQ ID NO. 2046 with e-value of 6.59E-69 and BLAST sequence identity of 89.9
MSSRRKTREPKEENVTLGPTVREGEHAFGVAHIFASFNDTFIHVTDLSGRETLVRITGGMKVKADRDESSPYAAMLAAQDVSQRCKELGITALHIKLRATGGNKTKTPGPGAQSALRALSRSGMRIGRIEDVTPIPTDSTRRKGGRRGRRL

SEQ ID NO: 2009 - DNA, 513 bp, Populus balsamifera subsp. trichocarpa
  misc_feature (1)..(513): Ceres ANNOT ID no. 1439694
  misc_feature: Utility: MSX Useful for making plants tolerant to low nitrogen
  misc_feature 224885:<222: Transcription Factor
  misc_feature: Phenotype: WHOLE PLANT - MSX Useful for making plants tolerant to low nitrogen
atgtcaaagagaaggacaagagagccaaaggaagaaaatgtcactcttggcccaactgtccgggagggagagcatgttttcggggtggctcacatttttgcttcattcaatgacacattcattcatgtgactgatttgtctgggagggaaaccctagttcgcattactggtggaatgaaggttaaagctgacagggatgaatcctcaccatatgctgctatgcttgctgcacaggatgtttcacagagatgcaaggaacttggcattactgctcttcatatcaagcttcgtgctacaggagggaacaaaactaagacacctgggcctggtgcccagtctgctctgagggcattggctcgttctggaatgaaaattggtcgcattggcaaaggatgtgacaccaattccaacagacagcacccgcagaaagggtggcagaaggggaagaaggctgtaagctgtctctcatcagagaaattccatttcggtggtgctgctttggttgcttggtga

SEQ ID NO: 2010 - protein, 170 aa, Populus balsamifera subsp. trichocarpa
  misc_feature (1)..(170): Ceres ANNOT ID no. 1439694
  misc_feature (28)..(128): Pfam Name: Ribosomal_S11 Pfam Description: Ribosomal protein S11
  misc_feature: SWISSPROT Homolog: RS141_ARATH 40S ribosomal protein S14-1 with e-value of 7.0e-75 and BLAST sequence identity of 99.3
  misc_feature: SWISSPROT Homolog: RS142_ARATH 40S ribosomal protein S14-2 with e-value of 4.9e-74 and BLAST sequence identity of 98.0
  misc_feature: SWISSPROT Homolog: RS143_ARATH 40S ribosomal protein S14-3 with e-value of 7.2e-73 and BLAST sequence identity of 96.0
  misc_feature: SWISSPROT Homolog: RS141_MAIZE 40S ribosomal protein S14 (Clone MCH1) with e-value of 7.6e-69 and BLAST sequence identity of 91.3
  misc_feature: SWISSPROT Homolog: RS142_MAIZE 40S ribosomal protein S14 (Clone MCH2) with e-value of 1.4e-67 and BLAST sequence identity of 89.9
  misc_feature: Utility: MSX Useful for making plants tolerant to low nitrogen
  misc_feature 224977:<222: Transcription Factor
  misc_feature: Phenotype: WHOLE PLANT - MSX Useful for making plants tolerant to low nitrogen
  misc_feature (1)..(170): Functional Homolog of  Ceres CLONE ID no. 41471 at SEQ ID NO. 2046 with e-value of 4.69E-59 and BLAST sequence identity of 82.9
MSKRRTREPKEENVTLGPTVREGEHVFGVAHIFASFNDTFIHVTDLSGRETLVRITGGMKVKADRDESSPYAAMLAAQDVSQRCKELGITALHIKLRATGGNKTKTPGPGAQSALRALARSGMKIGRIGKGCDTNSNRQHPQKGWQKGKKAVSCLSSEKFHFGGAALVAW

SEQ ID NO: 2011 - DNA, 576 bp, Populus balsamifera subsp. trichocarpa
  misc_feature (1)..(576): Ceres ANNOT ID no. 1519353
  misc_feature: Utility: MSX Useful for making plants tolerant to low nitrogen
  misc_feature 225049:<222: Transcription Factor
  misc_feature: Phenotype: WHOLE PLANT - MSX Useful for making plants tolerant to low nitrogen
atgtcaaagagaaggactagagaaccaaaggaagaaaatgtgacccttggacccaccgtgagggaaggggagcatgcttttggggttgctcacatcttcgcatcttttaatgacacattcattcatgtgactgatctctctggaagagaaacccttgtccgcataactggttttgagaaatacatgcatgcacatgaatcaataaactctaattgtatggataacaaagttgataatcattttgttacaggtggaatgaaggtgaaagctgatagagatgaatcttcaccatatgctgccatgcttgctgcacaagatgtttcacagagatgcaaggagattgctttcatttttggtatatggactcctgtagccaaaaccaagcttggtgcttcacctattgcttatgtgatgtttttcattcctatcaagcaggaactcggtatcactgcccttcatattaagcttcgtgctactggtgggaacaagacaaagacacctggtccagaagatgttactccaattccaacggatagcactcgtagaaagggtggcagaagaggtagaaggctgtga

SEQ ID NO: 2012 - protein, 191 aa, Populus balsamifera subsp. trichocarpa
  misc_feature (1)..(191): Ceres ANNOT ID no. 1519353
  misc_feature (170)..(187): Pfam Name: Ribosomal_S11 Pfam Description: Ribosomal protein S11
  misc_feature: SWISSPROT Homolog: RS141_ARATH 40S ribosomal protein S14-1 with e-value of 7.0e-75 and BLAST sequence identity of 99.3
  misc_feature: SWISSPROT Homolog: RS142_ARATH 40S ribosomal protein S14-2 with e-value of 4.9e-74 and BLAST sequence identity of 98.0
  misc_feature: SWISSPROT Homolog: RS143_ARATH 40S ribosomal protein S14-3 with e-value of 7.2e-73 and BLAST sequence identity of 96.0
  misc_feature: SWISSPROT Homolog: RS141_MAIZE 40S ribosomal protein S14 (Clone MCH1) with e-value of 7.6e-69 and BLAST sequence identity of 91.3
  misc_feature: SWISSPROT Homolog: RS142_MAIZE 40S ribosomal protein S14 (Clone MCH2) with e-value of 1.4e-67 and BLAST sequence identity of 89.9
  misc_feature: Utility: MSX Useful for making plants tolerant to low nitrogen
  misc_feature 225143:<222: Transcription Factor
  misc_feature: Phenotype: WHOLE PLANT - MSX Useful for making plants tolerant to low nitrogen
  misc_feature (1)..(191): Functional Homolog of  Ceres CLONE ID no. 41471 at SEQ ID NO. 2046 with e-value of 2.59E-42 and BLAST sequence identity of 90.8
MSKRRTREPKEENVTLGPTVREGEHAFGVAHIFASFNDTFIHVTDLSGRETLVRITGFEKYMHAHESINSNCMDNKVDNHFVTGGMKVKADRDESSPYAAMLAAQDVSQRCKEIAFIFGIWTPVAKTKLGASPIAYVMFFIPIKQELGITALHIKLRATGGNKTKTPGPEDVTPIPTDSTRRKGGRRGRRL

SEQ ID NO: 2013 - DNA, 810 bp, Populus balsamifera subsp. trichocarpa
  misc_feature (1)..(810): Ceres ANNOT ID no. 1466018
  misc_feature: Utility: MSX Useful for making plants tolerant to low nitrogen
  misc_feature 225218:<222: Transcription Factor
  misc_feature: Phenotype: WHOLE PLANT - MSX Useful for making plants tolerant to low nitrogen
atgtcaaagagaaggactagagaaccaaaggaagaaaatgtgacccttggacccaccgtgagggaaggggagcatgcttttggggttgctcacatcttcgcatcttttaatgacacattcattcatgtgactgatctctctggaagagaaacccttgtccgcataactggttttgagaaatacatgcatgcacatgaatcaataaactctaattgtatggataacaaagttgataatcattttgttacaggtggaatgaaggtgaaagctgatagagatgaatcttcaccatatgctgccatgcttgctgcacaagatgtttcacagagatgcaaggagattgctttcatttttggtatatggactcctgtagccaaaaccaagcttggtgcttcacctattgcttatgtgatgtttttcattcctatcaagcaggaactcggtatcactgcccttcatattaagcttcgtgctactggtgggaacaagacaaagacacctggtccagaagatgttactccaattccaacggatagcactcgtagaaagggtggcagaagagcttcgttaaaacgataccttttcttcctgcaaatagcaataacatttctcggcagcctatttccgccacttaatacgattgtgatgatggtggtcgcctcggacgagatgggtgccagagcagggttattctggtgccttgactggttgaagtggagagttctggccttattgtcatgcatcagtccttttcaaatcaaatttagttcaacgaagctacatcattccaaggacaaggagtttggttga

SEQ ID NO: 2014 - protein, 269 aa, Populus balsamifera subsp. trichocarpa
  misc_feature (1)..(269): Ceres ANNOT ID no. 1466018
  misc_feature (170)..(187): Pfam Name: Ribosomal_S11 Pfam Description: Ribosomal protein S11
  misc_feature: SWISSPROT Homolog: RS141_ARATH 40S ribosomal protein S14-1 with e-value of 7.0e-75 and BLAST sequence identity of 99.3
  misc_feature: SWISSPROT Homolog: RS142_ARATH 40S ribosomal protein S14-2 with e-value of 4.9e-74 and BLAST sequence identity of 98.0
  misc_feature: SWISSPROT Homolog: RS143_ARATH 40S ribosomal protein S14-3 with e-value of 7.2e-73 and BLAST sequence identity of 96.0
  misc_feature: SWISSPROT Homolog: RS141_MAIZE 40S ribosomal protein S14 (Clone MCH1) with e-value of 7.6e-69 and BLAST sequence identity of 91.3
  misc_feature: SWISSPROT Homolog: RS142_MAIZE 40S ribosomal protein S14 (Clone MCH2) with e-value of 1.4e-67 and BLAST sequence identity of 89.9
  misc_feature: Utility: MSX Useful for making plants tolerant to low nitrogen
  misc_feature 225320:<222: Transcription Factor
  misc_feature: Phenotype: WHOLE PLANT - MSX Useful for making plants tolerant to low nitrogen
  misc_feature (1)..(269): Functional Homolog of  Ceres CLONE ID no. 41471 at SEQ ID NO. 2046 with e-value of 3.40E-40 and BLAST sequence identity of 90.5
MSKRRTREPKEENVTLGPTVREGEHAFGVAHIFASFNDTFIHVTDLSGRETLVRITGFEKYMHAHESINSNCMDNKVDNHFVTGGMKVKADRDESSPYAAMLAAQDVSQRCKEIAFIFGIWTPVAKTKLGASPIAYVMFFIPIKQELGITALHIKLRATGGNKTKTPGPEDVTPIPTDSTRRKGGRRASLKRYLFFLQIAITFLGSLFPPLNTIVMMVVASDEMGARAGLFWCLDWLKWRVLALLSCISPFQIKFSSTKLHHSKDKEFG

SEQ ID NO: 2015 - protein, 532 aa, Arabidopsis thaliana
  misc_feature (1)..(532): Ceres CLONE ID no. 42141
  misc_feature (178)..(366): Pfam Name: RIO1 Pfam Description: RIO1 family
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
MEEVVVVVADPPPKITTVVEYEEELEDDDDDLSLSSDSDIAEALDWLDGKDDDELIGGGFSLHARRPNAHGGHGSRPNSSALQPISNKAQKLTSHVRASPLEGWEGRVKVGMSNSVTTAIRGSLRDTEIGRSRNTDKADRATVEQALDPRTRMVLFRMLNRGVFNDVNGCISTGKEANVYHATKSDGSELAIKVYKTSVLVFKDRDRYVQGDYRFRYGYCRHNPRKMVKTWAEKEQRNLKRLHAAGIRCPAVILLRLHVLVMEFIGRDGWAAPRLKDAALSLDKLRECYLELIIQMRVLYQKCKLVHGDLSEYNILYFEGHLYIIDVSQSVDLDHPLALNFLREDCDHVSDFFKKHGVAVMTIRELFDFIVDPTISDENVDSYLEEVQRKVIERGEISVEDEIADSVFMKSYIPKSLDAVNNPEADVAKITSGQDTGDMLYQTITGLKDALPKVDEQQIEVNAEEEEEEEEEGSGEESEEESEEELGPEDKKAARKEHKKKVKEEKRESRKTKTPKSVKKRKKKVSKPHKTR

SEQ ID NO: 2016 - DNA, 1680 bp, Populus balsamifera subsp. trichocarpa
  misc_feature (1)..(1680): Ceres ANNOT ID no. 1473839
  misc_feature 225555:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atgtcagatacacaacgaagtatcgatcaattagaacctctaacatcattaaatgaagccaagcccgaagttgaagaacaagtatccgaggaggaagattcttggtcatcagactctgaaattgccgacgcgttagactggttagataccagaaacgacgacgattcaattgacagctcgatcactctcaattcacgccgtcctaatgctcacggcggccttcactcgcgtcctaattcttcaactcttcaacctctctctaatcgcaatcagaagttctcgcatcatatccgcgcttctcctttagaggaatgggaagggagagtgaaagttggaatgtcgaattcagttacgactgccattcgccatagtgtgagagagatggctattgggaaaactagaaataccgagaaagccgatcgcgctactgttgagcaggctatcgatcctagaacgcgtatggttttatttaaaatgttgaatcgcggtgtgtttaatgatatcaatggctgcatttcaacaggaaaagaggcaaatgtttatcatgcaacaaaatctgatggtcaggaactagcaatcaaagtgtacaaaacttcggtcttggtttttaaagatcgagatcggtatgtacaaggtgactaccgtttccgacatggatattgcaagcacaatcccagaaaaatggtaaagacgtgggctgaaaaagaaatgaggaatcttttgaggctaaaagcagcaggaatcaggtgcccaacacccgtacttttgagacttcatgttctggtcatggaattcataggaaaaactggttgggccgctcctcgtctaaaggatgctgccttatctttggacaagttgcgtgaaggttatatggagatgattattaccatgcggagtttatatcagaagtgtaagctagtgcatggagacctcagtgagtacaacatcctttacttggagggtcgcttgtatataattgatgtctctcaagcagttgatcttgaccaccctcatgcccttgactttttgcgtgaagattgtcttcatgtttctgatttctttaagaaacatggtgtagcagtcatgactatccgggagctgtttgacttcatagtggatccgactattaatgatgaatccattgacagttacttggaagaggttcaacaaaaaattttgacaagagatttgactgcagaggatgaaattgctgactctgtatttgttcagtcatatattccgaagacattagatgatgtcaagcatgccgaggaggatgtaaaccggataacaagtggcaacgatactggagacatgtactataagactattactggactaaaggaggctctctctaactcttctgcagctcaacaagaaaggcagcaagtggatgcaaacccagtagaagagtcttcagtcattcaggatgggcattcaaactctcctgagagtgaatccgactctgggacagattcagaggaagagggctccggtgattcagatgggagtggttcatcatcagaaaccgagaaacaggatcctgttgataaaaaagccgcgagaaaagagaataagaagaaggtcaaggaggagaagagggaagctcgaaagactaaaactcccaaggctatgaagaaaagaaaaaagaaaatggccaaagccaaaaagactaggtaa

SEQ ID NO: 2017 - protein, 559 aa, Populus balsamifera subsp. trichocarpa
  misc_feature (1)..(559): Ceres ANNOT ID no. 1473839
  misc_feature (179)..(367): Pfam Name: RIO1 Pfam Description: RIO1 family
  misc_feature: SWISSPROT Homolog: RIOK1_HUMAN Serine/threonine-protein kinase RIO1 chloroplast precursor EC 2.7.11.1  (RIO kinase 1) with e-value of 1.6e-109 and BLAST sequence identity of 45.6
  misc_feature: SWISSPROT Homolog: RIO1_YEAST Serine/threonine-protein kinase RIO1 chloroplast precursor EC 2.7.11.1 (Ribosomal RNA-processing protein 10) with e-value of 7.2e-76 and BLAST sequence identity of 39.4
  misc_feature: SWISSPROT Homolog: RIOK3_MOUSE Serine/threonine-protein kinase RIO3 chloroplast precursor EC 2.7.11.1 (RIO kinase 3) with e-value of 3.2e-65 and BLAST sequence identity of 43.6
  misc_feature: SWISSPROT Homolog: RIOK3_HUMAN Serine/threonine-protein kinase RIO3 chloroplast precursor EC 2.7.11.1 (RIO kinase 3) (sudD homolog) with e-value of 3.6e-64 and BLAST sequence identity of 43.3
  misc_feature: SWISSPROT Homolog: YOT3_CAEEL Putative RIO-type serine/threonine-protein kinase ZK632.3 chloroplast precursor (EC 2.7.11.1) with e-value of 4.5e-50 and BLAST sequence identity of 38.1
  misc_feature 225705:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(559): Functional Homolog of  Ceres CLONE ID no. 42141 at SEQ ID NO. 2059 with e-value of 1.60E-202 and BLAST sequence identity of 76.4
MSDTQRSIDQLEPLTSLNEAKPEVEEQVSEEEDSWSSDSEIADALDWLDTRNDDDSIDSSITLNSRRPNAHGGLHSRPNSSTLQPLSNRNQKFSHHIRASPLEEWEGRVKVGMSNSVTTAIRHSVREMAIGKTRNTEKADRATVEQAIDPRTRMVLFKMLNRGVFNDINGCISTGKEANVYHATKSDGQELAIKVYKTSVLVFKDRDRYVQGDYRFRHGYCKHNPRKMVKTWAEKEMRNLLRLKAAGIRCPTPVLLRLHVLVMEFIGKTGWAAPRLKDAALSLDKLREGYMEMIITMRSLYQKCKLVHGDLSEYNILYLEGRLYIIDVSQAVDLDHPHALDFLREDCLHVSDFFKKHGVAVMTIRELFDFIVDPTINDESIDSYLEEVQQKILTRDLTAEDEIADSVFVQSYIPKTLDDVKHAEEDVNRITSGNDTGDMYYKTITGLKEALSNSSAAQQERQQVDANPVEESSVIQDGHSNSPESESDSGTDSEEEGSGDSDGSGSSSETEKQDPVDKKAARKENKKKVKEEKREARKTKTPKAMKKRKKKMAKAKKTR

SEQ ID NO: 2018 - protein, 141 aa, Arabidopsis thaliana
  misc_feature (1)..(141): Ceres CLONE ID no. 42336
  misc_feature (3)..(132): Pfam Name: UMP1 Pfam Description: Proteasome maturation factor UMP1
  misc_feature: Phenotype: WHOLE PLANT - Dark Green Useful for increasing chlorophyll and photosynthetic capacity
MESQKKIAHEIGGMKNDALRFGLHGVKSDILRSHPLETAYESGKQSQEEMKRRVITHTYGAALPLKMDLDRQILSRFQRPPGPIPSSMLGLEVYTGALDNFGFEDYLNDPRESETLKPVDFHHGMEVRLGLSKGPASPSFM

SEQ ID NO: 2019 - DNA, 576 bp, Populus balsamifera subsp. trichocarpa
  misc_feature (1)..(576): Ceres ANNOT ID no. 1455510
  misc_feature 225919:<222: Transcription Factor
  misc_feature: Phenotype: WHOLE PLANT - Dark Green Useful for increasing chlorophyll and photosynthetic capacity
atggaagcaccaaagacaatcgagcatcaaattggagaagtccatgattctcttcgtttcggccttgataccaagagaggcgacatcattggatctcaccctcttgaatctgccttgctctctgtaatcattccttgtggagaaaaatcaagaggacatgaagagaataacccttgcaaacgcttatgggtcagcttttcttgttcagatgggtatcgaaaggcagatgctttccagactaggggaaatttagctcaagtgctttgtttacatgagctaaggactttagattatcaatacaagggcataaaggctgaaatggggtggatcttgcttaacattgctttgcattttagttgtttgaagatgcttatcctattccagaggccaccaggaccaattccatcttcaatgctcgggctggaggctttgaccggaagtttggaagattttggttttgaggattatctgaatgatcctcgtgaatctgaaactttacgtccagtggacatgcatagtgggatggaagttcgtcttggaatatcaaaaggaccagcctgcaaaagcttcatgtga

SEQ ID NO: 2020 - protein, 191 aa, Populus balsamifera subsp. trichocarpa
  misc_feature (1)..(191): Ceres ANNOT ID no. 1455510
  misc_feature (3)..(41): Pfam Name: UMP1 Pfam Description: Proteasome maturation factor UMP1
  misc_feature 225970:<222: Transcription Factor
  misc_feature: Phenotype: WHOLE PLANT - Dark Green Useful for increasing chlorophyll and photosynthetic capacity
  misc_feature (1)..(191): Functional Homolog of  Ceres CLONE ID no. 42336 at SEQ ID NO. 2062 with e-value of 1.29E-26 and BLAST sequence identity of 63.5
MEAPKTIEHQIGEVHDSLRFGLDTKRGDIIGSHPLESALLSVIIPCGEKSRGHEENNPCKRLWVSFSCSDGYRKADAFQTRGNLAQVLCLHELRTLDYQYKGIKAEMGWILLNIALHFSCLKMLILFQRPPGPIPSSMLGLEALTGSLEDFGFEDYLNDPRESETLRPVDMHSGMEVRLGISKGPACKSFM

SEQ ID NO: 2021 - protein, 393 aa, Arabidopsis thaliana
  misc_feature (1)..(393): Ceres CLONE ID no. 42530
  misc_feature (1)..(393): Also Known As Ceres CDNA ID no. 23359888
  misc_feature (1)..(393): Also Known As Ceres GEMINI ID 531E8
  misc_feature (278)..(354): Pfam Name: Helicase_C Pfam Description: Helicase conserved C-terminal domain
  misc_feature (43)..(210): Pfam Name: DEAD Pfam Description: DEAD/DEAH box helicase
  misc_feature 226065:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MPFSARKERKHSTLTMTSLRHFDAMELQPDLLRGIYAYGFEKPSAIQQRGIIPFCKGLDVIQQAQSGTGKTATFCSGVLQQLDISLVQCQALVLAPTRELAQQIEKVMRALGDYLGVKAQACVGGTSVREDQRVLQSGVHVVVGTPGRVFDLLRRQSLRADAIKMFVLDEADEMLSRGFKDQIYDIFQLLPSKVQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFMTSEDERMMADIQRFYNVVVEELPSNVADLL

SEQ ID NO: 2022 - DNA, 1242 bp, Populus balsamifera subsp. trichocarpa; identical to SEQ ID NO: 183
  misc_feature (1)..(1242): Ceres ANNOT ID no. 1490273
  misc_feature 226166:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis

SEQ ID NO: 2023 - protein, 380 aa, Populus balsamifera subsp. trichocarpa
  misc_feature (1)..(380): Ceres ANNOT ID no. 1490273
  misc_feature (265)..(341): Pfam Name: Helicase_C Pfam Description: Helicase conserved C-terminal domain
  misc_feature (30)..(197): Pfam Name: DEAD Pfam Description: DEAD/DEAH box helicase
  misc_feature: SWISSPROT Homolog: IF4A1_ARATH Eukaryotic initiation factor 4A-1 (EC 3.6.1.-) (ATP-dependent RNA helicase eIF4A-1) (eIF-4A-1) with e-value of 3.4e-185 and BLAST sequence identity of 93.8
  misc_feature: SWISSPROT Homolog: IF410_TOBAC Eukaryotic initiation factor 4A-10 (EC 3.6.1.-) (ATP-dependent RNA helicase eIF4A-10) (eIF-4A-10) with e-value of 5.5e-185 and BLAST sequence identity of 93.3
  misc_feature: SWISSPROT Homolog: IF4A2_NICPL Eukaryotic initiation factor 4A-2 (EC 3.6.1.-) (ATP-dependent RNA helicase eIF4A-2) (eIF-4A-2) with e-value of 1.9e-184 and BLAST sequence identity of 93.5
  misc_feature: SWISSPROT Homolog: IF4A7_TOBAC Eukaryotic initiation factor 4A-7 (EC 3.6.1.-) (ATP-dependent RNA helicase eIF4A-7) (eIF-4A-7) with e-value of 2.4e-184 and BLAST sequence identity of 93.0
  misc_feature: SWISSPROT Homolog: IF414_TOBAC Eukaryotic initiation factor 4A-14 (EC 3.6.1.-) (ATP-dependent RNA helicase eIF4A-14) (eIF-4A-14) with e-value of 3.9e-184 and BLAST sequence identity of 93.0
  misc_feature 226286:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(380): Functional Homolog of  Ceres CLONE ID no. 42530 at SEQ ID NO. 2065 with e-value of 2.90E-185 and BLAST sequence identity of 93.8
MYEEVFETFDSMGLQENLLRGIYAYGFEKPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHVVVGTPGRVFDMLRRQSLRQDYIKMFVLDEADEMLSRGFKDQIYDIFQLLPSKVQVGVFSATMPPEALEITRKFMNKPVRILVKRDELTLEGIKQFYVNVDKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTSDDDRMLFDIQKFYNVVVEELPSNVADLL

SEQ ID NO: 2024 - DNA, 1242 bp, Populus balsamifera subsp. trichocarpa; identical to SEQ ID NO: 181
  misc_feature (1)..(1242): Ceres ANNOT ID no. 1446198
  misc_feature 226392:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis

SEQ ID NO: 2025 - protein, 413 aa, Populus balsamifera subsp. trichocarpa; identical to SEQ ID NO: 182
  misc_feature (1)..(413): Ceres ANNOT ID no. 1446198
  misc_feature (298)..(374): Pfam Name: Helicase_C Pfam Description: Helicase conserved C-terminal domain
  misc_feature (63)..(230): Pfam Name: DEAD Pfam Description: DEAD/DEAH box helicase
  misc_feature: SWISSPROT Homolog: IF4A1_ARATH Eukaryotic initiation factor 4A-1 (EC 3.6.1.-) (ATP-dependent RNA helicase eIF4A-1) (eIF-4A-1) with e-value of 3.4e-185 and BLAST sequence identity of 93.8
  misc_feature: SWISSPROT Homolog: IF410_TOBAC Eukaryotic initiation factor 4A-10 (EC 3.6.1.-) (ATP-dependent RNA helicase eIF4A-10) (eIF-4A-10) with e-value of 5.5e-185 and BLAST sequence identity of 93.3
  misc_feature: SWISSPROT Homolog: IF4A2_NICPL Eukaryotic initiation factor 4A-2 (EC 3.6.1.-) (ATP-dependent RNA helicase eIF4A-2) (eIF-4A-2) with e-value of 1.9e-184 and BLAST sequence identity of 93.5
  misc_feature: SWISSPROT Homolog: IF4A7_TOBAC Eukaryotic initiation factor 4A-7 (EC 3.6.1.-) (ATP-dependent RNA helicase eIF4A-7) (eIF-4A-7) with e-value of 2.4e-184 and BLAST sequence identity of 93.0
  misc_feature: SWISSPROT Homolog: IF414_TOBAC Eukaryotic initiation factor 4A-14 (EC 3.6.1.-) (ATP-dependent RNA helicase eIF4A-14) (eIF-4A-14) with e-value of 3.9e-184 and BLAST sequence identity of 93.0
  misc_feature 226512:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(413): Functional Homolog of  Ceres CLONE ID no. 42530 at SEQ ID NO. 2065 with e-value of 1.59E-184 and BLAST sequence identity of 93.2

SEQ ID NO: 2026 - DNA, 1242 bp, Populus balsamifera subsp. trichocarpa; identical to SEQ ID NO: 179
  misc_feature (1)..(1242): Ceres ANNOT ID no. 1455209
  misc_feature 226624:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis

SEQ ID NO: 2027 - protein, 413 aa, Populus balsamifera subsp. trichocarpa; identical to SEQ ID NO: 180
  misc_feature (1)..(413): Ceres ANNOT ID no. 1455209
  misc_feature (298)..(374): Pfam Name: Helicase_C Pfam Description: Helicase conserved C-terminal domain
  misc_feature (63)..(230): Pfam Name: DEAD Pfam Description: DEAD/DEAH box helicase
  misc_feature: SWISSPROT Homolog: IF4A1_ARATH Eukaryotic initiation factor 4A-1 (EC 3.6.1.-) (ATP-dependent RNA helicase eIF4A-1) (eIF-4A-1) with e-value of 3.4e-185 and BLAST sequence identity of 93.8
  misc_feature: SWISSPROT Homolog: IF410_TOBAC Eukaryotic initiation factor 4A-10 (EC 3.6.1.-) (ATP-dependent RNA helicase eIF4A-10) (eIF-4A-10) with e-value of 5.5e-185 and BLAST sequence identity of 93.3
  misc_feature: SWISSPROT Homolog: IF4A2_NICPL Eukaryotic initiation factor 4A-2 (EC 3.6.1.-) (ATP-dependent RNA helicase eIF4A-2) (eIF-4A-2) with e-value of 1.9e-184 and BLAST sequence identity of 93.5
  misc_feature: SWISSPROT Homolog: IF4A7_TOBAC Eukaryotic initiation factor 4A-7 (EC 3.6.1.-) (ATP-dependent RNA helicase eIF4A-7) (eIF-4A-7) with e-value of 2.4e-184 and BLAST sequence identity of 93.0
  misc_feature: SWISSPROT Homolog: IF414_TOBAC Eukaryotic initiation factor 4A-14 (EC 3.6.1.-) (ATP-dependent RNA helicase eIF4A-14) (eIF-4A-14) with e-value of 3.9e-184 and BLAST sequence identity of 93.0
  misc_feature 226744:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(413): Functional Homolog of  Ceres CLONE ID no. 42530 at SEQ ID NO. 2065 with e-value of 4.29E-184 and BLAST sequence identity of 92.7

SEQ ID NO: 2028 - DNA, 1224 bp, Populus balsamifera subsp. trichocarpa; identical to SEQ ID NO: 185
  misc_feature (1)..(1224): Ceres ANNOT ID no. 1530603
  misc_feature 226856:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis

SEQ ID NO: 2029 - protein, 407 aa, Populus balsamifera subsp. trichocarpa; identical to SEQ ID NO: 186
  misc_feature (1)..(407): Ceres ANNOT ID no. 1530603
  misc_feature (292)..(368): Pfam Name: Helicase_C Pfam Description: Helicase conserved C-terminal domain
  misc_feature (63)..(224): Pfam Name: DEAD Pfam Description: DEAD/DEAH box helicase
  misc_feature: SWISSPROT Homolog: IF4A1_ARATH Eukaryotic initiation factor 4A-1 (EC 3.6.1.-) (ATP-dependent RNA helicase eIF4A-1) (eIF-4A-1) with e-value of 3.4e-185 and BLAST sequence identity of 93.8
  misc_feature: SWISSPROT Homolog: IF410_TOBAC Eukaryotic initiation factor 4A-10 (EC 3.6.1.-) (ATP-dependent RNA helicase eIF4A-10) (eIF-4A-10) with e-value of 5.5e-185 and BLAST sequence identity of 93.3
  misc_feature: SWISSPROT Homolog: IF4A2_NICPL Eukaryotic initiation factor 4A-2 (EC 3.6.1.-) (ATP-dependent RNA helicase eIF4A-2) (eIF-4A-2) with e-value of 1.9e-184 and BLAST sequence identity of 93.5
  misc_feature: SWISSPROT Homolog: IF4A7_TOBAC Eukaryotic initiation factor 4A-7 (EC 3.6.1.-) (ATP-dependent RNA helicase eIF4A-7) (eIF-4A-7) with e-value of 2.4e-184 and BLAST sequence identity of 93.0
  misc_feature: SWISSPROT Homolog: IF414_TOBAC Eukaryotic initiation factor 4A-14 (EC 3.6.1.-) (ATP-dependent RNA helicase eIF4A-14) (eIF-4A-14) with e-value of 3.9e-184 and BLAST sequence identity of 93.0
  misc_feature 226976:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(407): Functional Homolog of  Ceres CLONE ID no. 42530 at SEQ ID NO. 2065 with e-value of 1.80E-178 and BLAST sequence identity of 92.6

SEQ ID NO: 2030 - protein, 284 aa, Arabidopsis thaliana
  misc_feature (1)..(284): Ceres CLONE ID no. 42533
  misc_feature (1)..(109): Pfam Name: HD-ZIP_N Pfam Description: HD-ZIP protein N terminus
  misc_feature (129)..(183): Pfam Name: Homeobox Pfam Description: Homeobox domain
  misc_feature (184)..(228): Pfam Name: HALZ Pfam Description: Homeobox associated leucine zipper
  misc_feature: Phenotype: WHOLE PLANT - Dark Green Useful for increasing chlorophyll and photosynthetic capacity
  misc_feature: Phenotype: ROSETTE LEAVES - Lanceolate Shaped Useful for making plants with increased biomass and foliage
MMLEKDDLGLSLGLNFPKKQINLKSNPSVSVTPSSSSFGLFRRSSWNESFTSSVPNSDSSQKETRTFIRGIDVNRPPSTAEYGDEDAGVSSPNSTISSSTGKRSEREEDTDPQGSRGISDDEDGDNSRKKLRLSKDQSAILEETFKDHSTLNPKQKQALAKQLGLRARQVEVWFQNRRARTKLKQTEVDCEFLRRCCENLTEENRRLQKEVTELRALKLSPQFYMHMSPPTTLTMCPSCEHVSVPPPQPQAATSAHHRTLPVNAWAPATRISHGLTFDALRPRS

SEQ ID NO: 2031 - DNA, 915 bp, Populus balsamifera subsp. trichocarpa; identical to SEQ ID NO: 1346
  misc_feature (1)..(915): Ceres ANNOT ID no. 1499810
  misc_feature 227189:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Lanceolate Shaped Useful for making plants with increased biomass and foliage

SEQ ID NO: 2032 - protein, 304 aa, Populus balsamifera subsp. trichocarpa; identical to SEQ ID NO: 1347
  misc_feature (1)..(304): Ceres ANNOT ID no. 1499810
  misc_feature (1)..(112): Pfam Name: HD-ZIP_N Pfam Description: HD-ZIP protein N terminus
  misc_feature (138)..(192): Pfam Name: Homeobox Pfam Description: Homeobox domain
  misc_feature (193)..(237): Pfam Name: HALZ Pfam Description: Homeobox associated leucine zipper
  misc_feature: SWISSPROT Homolog: HAT4_ARATH Homeobox-leucine zipper protein HAT4 (HD-ZIP protein 4) (HD-ZIP protein ATHB-2) with e-value of 1.9e-150 and BLAST sequence identity of 98.9
  misc_feature: SWISSPROT Homolog: HAT2_ARATH Homeobox-leucine zipper protein HAT2 (HD-ZIP protein 2) with e-value of 1.2e-68 and BLAST sequence identity of 54.3
  misc_feature: SWISSPROT Homolog: HAT1_ARATH Homeobox-leucine zipper protein HAT1 (HD-ZIP protein 1) with e-value of 9.6e-62 and BLAST sequence identity of 49.3
  misc_feature: SWISSPROT Homolog: ATHB4_ARATH Homeobox-leucine zipper protein ATHB-4 (HD-ZIP protein ATHB-4) with e-value of 2.6e-59 and BLAST sequence identity of 66.5
  misc_feature: SWISSPROT Homolog: HAT3_ARATH Homeobox-leucine zipper protein HAT3 (HD-ZIP protein 3) with e-value of 2.7e-57 and BLAST sequence identity of 52.7
  misc_feature 227311:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Lanceolate Shaped Useful for making plants with increased biomass and foliage
  misc_feature (1)..(304): Functional Homolog of  Ceres CLONE ID no. 42533 at SEQ ID NO. 2074 with e-value of 3.00E-96 and BLAST sequence identity of 71.3

SEQ ID NO: 2033 - DNA, 909 bp, Populus balsamifera subsp. trichocarpa; identical to SEQ ID NO: 1344
  misc_feature (1)..(909): Ceres ANNOT ID no. 1538733
  misc_feature 227411:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Lanceolate Shaped Useful for making plants with increased biomass and foliage

SEQ ID NO: 2034 - protein, 302 aa, Populus balsamifera subsp. trichocarpa; identical to SEQ ID NO: 1345
  misc_feature (1)..(302): Ceres ANNOT ID no. 1538733
  misc_feature (1)..(112): Pfam Name: HD-ZIP_N Pfam Description: HD-ZIP protein N terminus
  misc_feature (138)..(192): Pfam Name: Homeobox Pfam Description: Homeobox domain
  misc_feature (193)..(237): Pfam Name: HALZ Pfam Description: Homeobox associated leucine zipper
  misc_feature: SWISSPROT Homolog: HAT4_ARATH Homeobox-leucine zipper protein HAT4 (HD-ZIP protein 4) (HD-ZIP protein ATHB-2) with e-value of 1.9e-150 and BLAST sequence identity of 98.9
  misc_feature: SWISSPROT Homolog: HAT2_ARATH Homeobox-leucine zipper protein HAT2 (HD-ZIP protein 2) with e-value of 1.2e-68 and BLAST sequence identity of 54.3
  misc_feature: SWISSPROT Homolog: HAT1_ARATH Homeobox-leucine zipper protein HAT1 (HD-ZIP protein 1) with e-value of 9.6e-62 and BLAST sequence identity of 49.3
  misc_feature: SWISSPROT Homolog: ATHB4_ARATH Homeobox-leucine zipper protein ATHB-4 (HD-ZIP protein ATHB-4) with e-value of 2.6e-59 and BLAST sequence identity of 66.5
  misc_feature: SWISSPROT Homolog: HAT3_ARATH Homeobox-leucine zipper protein HAT3 (HD-ZIP protein 3) with e-value of 2.7e-57 and BLAST sequence identity of 52.7
  misc_feature 227533:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Lanceolate Shaped Useful for making plants with increased biomass and foliage
  misc_feature (1)..(302): Functional Homolog of  Ceres CLONE ID no. 42533 at SEQ ID NO. 2074 with e-value of 2.09E-95 and BLAST sequence identity of 70.2

SEQ ID NO: 2035 - DNA, 954 bp, Populus balsamifera subsp. trichocarpa; identical to SEQ ID NO: 1348
  misc_feature (1)..(954): Ceres ANNOT ID no. 1485323
  misc_feature 227630:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Lanceolate Shaped Useful for making plants with increased biomass and foliage

SEQ ID NO: 2036 - protein, 317 aa, Populus balsamifera subsp. trichocarpa; identical to SEQ ID NO: 1349
  misc_feature (1)..(317): Ceres ANNOT ID no. 1485323
  misc_feature (1)..(111): Pfam Name: HD-ZIP_N Pfam Description: HD-ZIP protein N terminus
  misc_feature (137)..(161): Pfam Name: Homeobox Pfam Description: Homeobox domain
  misc_feature (208)..(252): Pfam Name: HALZ Pfam Description: Homeobox associated leucine zipper
  misc_feature: SWISSPROT Homolog: HAT4_ARATH Homeobox-leucine zipper protein HAT4 (HD-ZIP protein 4) (HD-ZIP protein ATHB-2) with e-value of 1.9e-150 and BLAST sequence identity of 98.9
  misc_feature: SWISSPROT Homolog: HAT2_ARATH Homeobox-leucine zipper protein HAT2 (HD-ZIP protein 2) with e-value of 1.2e-68 and BLAST sequence identity of 54.3
  misc_feature: SWISSPROT Homolog: HAT1_ARATH Homeobox-leucine zipper protein HAT1 (HD-ZIP protein 1) with e-value of 9.6e-62 and BLAST sequence identity of 49.3
  misc_feature: SWISSPROT Homolog: ATHB4_ARATH Homeobox-leucine zipper protein ATHB-4 (HD-ZIP protein ATHB-4) with e-value of 2.6e-59 and BLAST sequence identity of 66.5
  misc_feature: SWISSPROT Homolog: HAT3_ARATH Homeobox-leucine zipper protein HAT3 (HD-ZIP protein 3) with e-value of 2.7e-57 and BLAST sequence identity of 52.7
  misc_feature 227752:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Lanceolate Shaped Useful for making plants with increased biomass and foliage
  misc_feature (1)..(317): Functional Homolog of  Ceres CLONE ID no. 42533 at SEQ ID NO. 2074 with e-value of 9.79E-91 and BLAST sequence identity of 70.1

SEQ ID NO: 2037 - protein, 593 aa, Arabidopsis thaliana
  misc_feature (1)..(593): Ceres CLONE ID no. 42654
  misc_feature (1)..(593): Also Known As Ceres CDNA ID no. 23380202
  misc_feature (1)..(593): Also Known As Ceres GEMINI ID 555E1
  misc_feature (328)..(360): Pfam Name: Ank Pfam Description: Ankyrin repeat
  misc_feature (53)..(194): Pfam Name: BTB Pfam Description: BTB/POZ domain
  misc_feature 227878:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
MDTTIDGFADSYEISSTSFVATDNTDSSIVYLAAEQVLTGPDVSALQLLSNSFESVFDSPDDFYSDAKLVLSDGREVSFHRCVLSARSSFFKSALAAAKKEKDSNNTAAVKLELKEIAKDYEVGFDSVVTVLAYVYSSRVRPPPKGVSECADENCCHVACRPAVDFMLEVLYLAFIFRIPELVTLYQRHLLDVVDKVVIEDTLVILKLANICGKACMKLLDRCKEIIVKSNVDMVSLEKSLPEELVKEIIDRRKELGLEVPKVKKHVSNVHKALDSDDIELVKLLLKEDHTNLDDACALHFAVAYCNVKTATDLLKLDLADVNHRNPRGYTVLHVAAMRKEPQLILSLLEKGASASEATLEGRTALMIAKQATMAVECNNIPEQCKHSLKGRLCVEILEQEDKREPIPRDVPPSFAVAADELKMTLLDLENRVALAQRLFPTEAQAAMEIAEMKGTCEFIVTSLEPDRLTGTKRTSPGVKIAPFRILEEHQSRLKALSKTVELGKRFFPRCSAVLDQIMNCEDLTQLACGEDDTAEKRLQKKQRYMEIQETLKKAFSEDNLELGNSSLTDSTSSTSKSTGGKRSNRKFSHRRR

SEQ ID NO: 2038 - DNA, 1770 bp, Populus balsamifera subsp. trichocarpa
  misc_feature (1)..(1770): Ceres ANNOT ID no. 1454375
  misc_feature 228025:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
atggataataggattggtttctctgattctaacgagatcagcaatggaagtagcacttgctgcatagaaactccctcaacttcaaagccttttacaaacccagaaattgtagctcttcaacaactatcaggaaaccttgaagccatctttgactcccaagattttgactactttgctgatgccaaaatcacaagctccaattacaaccgtgaagtcccagttcacaggtgcattttatctgcgagaagtccttttttcaagagtgttttctcgagtcctgtggctaaagacagaagtggggtagcaaagtttgaattgaaggaattggctaaggactatgatgttggatttgattcacttatgacagtcttgggttatttatattgtgggaaagtgaggccttggcctaaagatgtttgtgcttgtgtggatgatgattgttcccatattgcttgccggcctgcagttgatctcctgactgaggttctttatgcctcttttacattccaggttaatgagttggtggctctttatcagaggcacctattagacattcttgacaaggtttcaactgatgacatcttggtgattctagcagttgcaaacatatgtggtgaagcttgtgagagattgctaacaagatgcgttgagattattgtgaaatcaaatgttgatattgttactctggataaagccttgccgcaatacattgtgaagaaaatcatggattctcgtttggaacttggtttgaatgtgcctgagaacagtaacttactagataaacatgtaaagagaatacatcgggctctggactcggatgatgttgagctagttagaatgctactgaaagaggcacatactaatctagatgatgcgcatgcactccactatgctgtttcatactgtgatgcaaagactacaactgagattcttgatcttggattagctgatgttaactgcagaaattcaaggggttacaccgtgctgcatgtcgctgcaatgcggaaagatcctaagattatagtatctctcttaacgaagggagctcggctgtcagatcttactttagatggtaggaaggctctgcagatatcaaaacgacttacaagggccatggattatcataagtcaacagaggaaggaaaagcttctcccaaggagcgcttgtgtatagaaatattggaacaagcagaaaggagggatccattacttggagaggcttctctttctcttgctatggctggtgatgacctgcgaatgaaattgttgtacctcgaaaatagagttggactggcaaaactcctttttcccatggaagcaaaagttgcaatggatattgctcaggttgatggtacttctgagtttccattagctggcatcaggcccagcatcttgtctggggcacaaagaggagctgtggacttgaacgaggcacctttcagaatgcacgaggagcatctaaataggatgagagcactctctagaacagtggaacttgggaaacggtttttcccacgttgctcagacgtactcaacaagatcatggatgctgatgacctatcacagatagcttatttagggaatgaaacttcagaggaacgacttgtgaagagacagagacaccttgaactccaggatgctctaagcaaggcattcaatgaagataaacaagagttcgacaggtctgtcatatcatcttcatcatccaccaagtcaattggcacggcgaggtctaatgggaagcttattgacatgggtggtggtcattag

SEQ ID NO: 2039 - protein, 589 aa, Populus balsamifera subsp. trichocarpa
  misc_feature (1)..(589): Ceres ANNOT ID no. 1454375
  misc_feature (324)..(356): Pfam Name: Ank Pfam Description: Ankyrin repeat
  misc_feature (49)..(186): Pfam Name: BTB Pfam Description: BTB/POZ domain
  misc_feature: SWISSPROT Homolog: NPR1_ARATH Regulatory protein NPR1 (Nonexpresser of PR genes 1) with e-value of 3.9e-310 and BLAST sequence identity of 99.3
  misc_feature: SWISSPROT Homolog: NPR1_ARATH Noninducible immunity 1 (Nim1) Salicylic acid insensitive 1 (Sai1)
  misc_feature: SWISSPROT Homolog: ANK2_HUMAN Ankyrin-2 (Brain ankyrin) (Ankyrin-B) (Ankyrin, nonerythroid) with e-value of 1.6e-07 and BLAST sequence identity of 31.0
  misc_feature 228153:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(589): Functional Homolog of  Ceres CLONE ID no. 42654 at SEQ ID NO. 2081 with e-value of 2.50E-163 and BLAST sequence identity of 56.5
MDNRIGFSDSNEISNGSSTCCIETPSTSKPFTNPEIVALQQLSGNLEAIFDSQDFDYFADAKITSSNYNREVPVHRCILSARSPFFKSVFSSPVAKDRSGVAKFELKELAKDYDVGFDSLMTVLGYLYCGKVRPWPKDVCACVDDDCSHIACRPAVDLLTEVLYASFTFQVNELVALYQRHLLDILDKVSTDDILVILAVANICGEACERLLTRCVEIIVKSNVDIVTLDKALPQYIVKKIMDSRLELGLNVPENSNLLDKHVKRIHRALDSDDVELVRMLLKEAHTNLDDAHALHYAVSYCDAKTTTEILDLGLADVNCRNSRGYTVLHVAAMRKDPKIIVSLLTKGARLSDLTLDGRKALQISKRLTRAMDYHKSTEEGKASPKERLCIEILEQAERRDPLLGEASLSLAMAGDDLRMKLLYLENRVGLAKLLFPMEAKVAMDIAQVDGTSEFPLAGIRPSILSGAQRGAVDLNEAPFRMHEEHLNRMRALSRTVELGKRFFPRCSDVLNKIMDADDLSQIAYLGNETSEERLVKRQRHLELQDALSKAFNEDKQEFDRSVISSSSSTKSIGTARSNGKLIDMGGGH

SEQ ID NO: 2040 - protein, 357 aa, Arabidopsis thaliana
  misc_feature (1)..(357): Ceres CLONE ID no. 42713
  misc_feature (1)..(357): Also Known As Ceres CDNA ID no. 23375627
  misc_feature (1)..(357): Also Known As Ceres GEMINI ID 554B2
  misc_feature (54)..(168): Pfam Name: Mov34 Pfam Description: Mov34/MPN/PAD-1 family
  misc_feature 228325:<222: Transcription Factor
  misc_feature: Phenotype: Activates expression of the gene endogenous to the AtDXPR (SEQ ID NO 4143) regalutory region Useful for modulating Terpenoid Biosynthesis
MEGSSSAIARKTWELENNILPVEPTDSASDSIFHYDDASQAKIQQEKPWASDPNYFKRVHISALALLKMVVHARSGGTIEIMGLMQGKTEGDTIIVMDAFALPVEGTETRVNAQSDAYEYMVEYSQTSKLAGRLENVVGWYHSHPGYGCWLSGIDVSTQMLNQQYQEPFLAVVIDPTRTVSAGKVEIGAFRTYPEGHKISDDHVSEYQTIPLNKIEDFGVHCKQYYSLDITYFKSSLDSHLLDLLRNKYWVNTLSSSPLLGNGDYVAGQISDLAEKLEQAESQLANSRYGGIAPAGHQRRKEDEPQLAKITRDSAKITVEQVHGLMSQVIKDILFNSARQSKKSADDSSDPEPMITS

SEQ ID NO: 2041 - DNA, 1101 bp, Populus balsamifera subsp. trichocarpa
  misc_feature (1)..(1101): Ceres ANNOT ID no. 1477897
  misc_feature 228419:<222: Transcription Factor
  misc_feature: Phenotype: Activates expression of the gene endogenous to the AtDXPR (SEQ ID NO 4143) regalutory region Useful for modulating Terpenoid Biosynthesis
atggatccctatccttcttcttcttcctcgatagcccaaaaaacctgggagctcgaaaacaacattaaaaccatcgacacatcaaccccaacaatagcaacaggcacttcttttttatcggacgcgatttttcactacgatgatgcagcacaagcgaagttcctgcaagaaaaaccgtggtcgaacgatccgaattattttagacgagtgaggatctctgctcttgctttgttaaagatggttgtccatgctcgatcaggcgggactattgaagttatggggctaatgcaagggaaaactgatggggattctattattgttatggatgcttttgctcttcctgtcgaagggacggagacgagggttaatgctcaggctgatgcttatgagtatatggttgattattctcagactaataaacaggctggacgtttggagaatgttgttgggtggtatcactcacatcctggctatggatgctggctttcaggtattgatgtttcaacccaaatgcttaaccagcaatttcaggagccgtttttggcagttgttattgatccaacaaggactgtctcagcggggaaagttgagattggggcattcaggacatatccagaaggatacaaacctccagatgatcctgtttctgaataccaaactattcctcttaataagattgaggactttggagttcattgcaaacagtattatgctttggatataacttatttcaaatcttctctcgattgccacctcttggatcttttgtggaacaaatactgggtgaatacactttcatcttcacctctcttgggcaatggagactatgttgcggggcaaatttctgatctagctgagaagctggagcatgcagagaatcaattggcacattctcgattgggaccattaatggctcctcaaagaaagaaagatgaagaatctcaacttgcaaaaattactcgtgatagtgctaagataactgtggagcaggtccatggtctaatgtcacaggttatcaaggacatccttttcaactctgttcgtcaatcaaatagatctcgtgcagagacatccggccctgagccaatggttgaaacatga

SEQ ID NO: 2042 - protein, 366 aa, Populus balsamifera subsp. trichocarpa
  misc_feature (1)..(366): Ceres ANNOT ID no. 1477897
  misc_feature (65)..(179): Pfam Name: Mov34 Pfam Description: Mov34/MPN/PAD-1 family
  misc_feature: SWISSPROT Homolog: CSN5B_ARATH COP9 signalosome complex subunit 5b (EC 3.4.-.-) (Signalosome subunit 5b) (Jun activation domain-binding homolog 1) with e-value of 4.5e-190 and BLAST sequence identity of 99.7
  misc_feature: SWISSPROT Homolog: CSN5A_ARATH COP9 signalosome complex subunit 5a (EC 3.4.-.-) (Signalosome subunit 5a) (Jun activation domain-binding homolog 2) with e-value of 2.6e-162 and BLAST sequence identity of 85.4
  misc_feature: SWISSPROT Homolog: CSN5_XENTR COP9 signalosome complex subunit 5 (EC 3.4.-.-) (Signalosome subunit 5) with e-value of 9.4e-119 and BLAST sequence identity of 66.7
  misc_feature: SWISSPROT Homolog: CSN5_XENLA COP9 signalosome complex subunit 5 (EC 3.4.-.-) (Signalosome subunit 5) with e-value of 1.5e-118 and BLAST sequence identity of 66.4
  misc_feature: SWISSPROT Homolog: CSN5_BRARE COP9 signalosome complex subunit 5 (EC 3.4.-.-) (Signalosome subunit 5) with e-value of 4.1e-118 and BLAST sequence identity of 66.0
  misc_feature 228528:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(366): Functional Homolog of  Ceres CLONE ID no. 42713 at SEQ ID NO. 2084 with e-value of 5.19E-156 and BLAST sequence identity of 85.3
MDPYPSSSSSIAQKTWELENNIKTIDTSTPTIATGTSFLSDAIFHYDDAAQAKFLQEKPWSNDPNYFRRVRISALALLKMVVHARSGGTIEVMGLMQGKTDGDSIIVMDAFALPVEGTETRVNAQADAYEYMVDYSQTNKQAGRLENVVGWYHSHPGYGCWLSGIDVSTQMLNQQFQEPFLAVVIDPTRTVSAGKVEIGAFRTYPEGYKPPDDPVSEYQTIPLNKIEDFGVHCKQYYALDITYFKSSLDCHLLDLLWNKYWVNTLSSSPLLGNGDYVAGQISDLAEKLEHAENQLAHSRLGPLMAPQRKKDEESQLAKITRDSAKITVEQVHGLMSQVIKDILFNSVRQSNRSRAETSGPEPMVET

SEQ ID NO: 2043 - DNA, 1101 bp, Populus balsamifera subsp. trichocarpa
  misc_feature (1)..(1101): Ceres ANNOT ID no. 1480898
  misc_feature 228630:<222: Transcription Factor
  misc_feature: Phenotype: Activates expression of the gene endogenous to the AtDXPR (SEQ ID NO 4143) regalutory region Useful for modulating Terpenoid Biosynthesis
atggatccctacccttcttcttccatagccaaaaagacctgggaactcgaaaacaacataatacctatcgacacagcaaccccgacaacaacagacacttcttcttcttcttcttcatcggacgcgattttttacttcgatgaagcagcacaagcgaagttccagaaagaaaaaccgtggtctaatgatccgaattattttagaagagtgaagatatctgcacttgcgttgttgaagatggttgtacatgctcgatcaggtgggactattgaagttatgggattaatgcaagggaaaactgatggggattctataattgttatggatgcctttgctcttcctgttgaagggactgagacgagagttaatgctcaagctgatgcttatgagtatatggttgattattctcagactaataaacaggctggacgtttggagaatgtaattgggtggtatcattcacatcctggctatggatgctggctttcgggtattgatgtttcaacccaaatgcttaaccagcaatttcaggagccgtttttggcagttgttattgatccaacaagaactgtctcagctgggaaagtagagattggggcattcaggacatatccagaaggatacaaacctccagatgatcctgtttctgaatatcaaactattcctcttaataagatcgaagactttggagtccattgcaaacagtattattctttggacatcacatatttcaagtcttctcttgattgtcacctcttggatcttttgtggaacaaatactgggtgaatacgctttcatcttcacctctcttgggtaatggagactatgttgcaggacaaatttctgatttagctgagaagctggagcatgcagagaatcaattggcacattctcgattgggaccattaatgactcctcaaagaaagaaagatgaagaatctcaacttgctaaaattactcgtgatagtgctaagataactgtggagcaagttcatggcctaatgtcgcaggttatcaaggacatcttgttcaactccgttcatcaatcaaacagatctcagacggagccatctggccctgaaccaatggttgaaacctga

SEQ ID NO: 2044 - protein, 366 aa, Populus balsamifera subsp. trichocarpa
  misc_feature (1)..(366): Ceres ANNOT ID no. 1480898
  misc_feature (65)..(179): Pfam Name: Mov34 Pfam Description: Mov34/MPN/PAD-1 family
  misc_feature: SWISSPROT Homolog: CSN5B_ARATH COP9 signalosome complex subunit 5b (EC 3.4.-.-) (Signalosome subunit 5b) (Jun activation domain-binding homolog 1) with e-value of 4.5e-190 and BLAST sequence identity of 99.7
  misc_feature: SWISSPROT Homolog: CSN5A_ARATH COP9 signalosome complex subunit 5a (EC 3.4.-.-) (Signalosome subunit 5a) (Jun activation domain-binding homolog 2) with e-value of 2.6e-162 and BLAST sequence identity of 85.4
  misc_feature: SWISSPROT Homolog: CSN5_XENTR COP9 signalosome complex subunit 5 (EC 3.4.-.-) (Signalosome subunit 5) with e-value of 9.4e-119 and BLAST sequence identity of 66.7
  misc_feature: SWISSPROT Homolog: CSN5_XENLA COP9 signalosome complex subunit 5 (EC 3.4.-.-) (Signalosome subunit 5) with e-value of 1.5e-118 and BLAST sequence identity of 66.4
  misc_feature: SWISSPROT Homolog: CSN5_BRARE COP9 signalosome complex subunit 5 (EC 3.4.-.-) (Signalosome subunit 5) with e-value of 4.1e-118 and BLAST sequence identity of 66.0
  misc_feature 228739:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(366): Functional Homolog of  Ceres CLONE ID no. 42713 at SEQ ID NO. 2084 with e-value of 2.89E-155 and BLAST sequence identity of 83.9
MDPYPSSSIAKKTWELENNIIPIDTATPTTTDTSSSSSSSDAIFYFDEAAQAKFQKEKPWSNDPNYFRRVKISALALLKMVVHARSGGTIEVMGLMQGKTDGDSIIVMDAFALPVEGTETRVNAQADAYEYMVDYSQTNKQAGRLENVIGWYHSHPGYGCWLSGIDVSTQMLNQQFQEPFLAVVIDPTRTVSAGKVEIGAFRTYPEGYKPPDDPVSEYQTIPLNKIEDFGVHCKQYYSLDITYFKSSLDCHLLDLLWNKYWVNTLSSSPLLGNGDYVAGQISDLAEKLEHAENQLAHSRLGPLMTPQRKKDEESQLAKITRDSAKITVEQVHGLMSQVIKDILFNSVHQSNRSQTEPSGPEPMVET

SEQ ID NO: 2045 - protein, 156 aa, Arabidopsis thaliana
  misc_feature (1)..(156): Ceres CLONE ID no. 42925
  misc_feature (44)..(121): Pfam Name: 4HBT Pfam Description: Thioesterase superfamily
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: WHOLE PLANT - Yellow-Green Viable 2 Useful for making lethal plants for genetic confinement systems
  misc_feature: Phenotype: WHOLE PLANT - High Anthocyanin Useful for modulating anthocyanin content
  misc_feature: Phenotype: INFLORESCENCE - Reduced Apical Dominance Useful for modifying plant structure, ie increased branching
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Ovate Shaped Useful for making plants with increased biomass and foliage
  misc_feature: Phenotype: ROSETTE LEAVES - Serrate Margins Useful for making plants with increased biomass and foliage
  misc_feature: Phenotype: ROSETTE LEAVES - Trident Shaped Useful for making plants with increased biomass and foliage
MDSASSNTKAIDPPLHMLGFEFDELSPTRITGRLPVSPVCCQPFKVLHGGVSALIAESLASMGAHMASGFKRVAGIQLSINHLKSADLGDLVFAEATPVSTGKTIQVWEVKLWKTTQKDKANKILISSSRVTLICNLPIPDNAKDAANMLKMVAKL

SEQ ID NO: 2046 - DNA, 501 bp, Populus balsamifera subsp. trichocarpa
  misc_feature (1)..(501): Ceres ANNOT ID no. 1462354
  misc_feature 228976:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: WHOLE PLANT - Yellow-Green Viable 2 Useful for making lethal plants for genetic confinement systems
  misc_feature: Phenotype: WHOLE PLANT - High Anthocyanin Useful for modulating anthocyanin content
  misc_feature: Phenotype: INFLORESCENCE - Reduced Apical Dominance Useful for modifying plant structure, ie increased branching
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Ovate Shaped Useful for making plants with increased biomass and foliage
  misc_feature: Phenotype: ROSETTE LEAVES - Serrate Margins Useful for making plants with increased biomass and foliage
  misc_feature: Phenotype: ROSETTE LEAVES - Trident Shaped Useful for making plants with increased biomass and foliage
atggagcaatcatcatcttcctcctcctcttcctcctcctccaaaaaagaaagtcttgacgttcccctgcattcctttgggttccaaattgaagaattgtcccctcaaaaggtcactggtcgcctgcttgttactcccaagtgcgttcagccgttcaaggtattgcacggcggagtatcggcgttgatttcggaagcgatggctagcatgggggcccacatggcatcgggattgcaaagagtggctgggattcacctgagcatcaatcatgtgaaaagcgcccgccttggagaccttgtcctcgccgaagccactcccttcagtataggcaaaaccattcaggtgtgggaggtgcgaatctggaaattagcggatccttcaaacacagagtcctccaaatcattggtatcatcgtcaagggttactctcatgtgcaacttgcctgtgcctgaccatgctaaagaagccactgaaaatctcagaagccatgctaaattatga

SEQ ID NO: 2047 - protein, 166 aa, Populus balsamifera subsp. trichocarpa
  misc_feature (1)..(166): Ceres ANNOT ID no. 1462354
  misc_feature (52)..(129): Pfam Name: 4HBT Pfam Description: Thioesterase superfamily
  misc_feature: SWISSPROT Homolog: Y1161_HAEIN Hypothetical UPF0152 protein HI1161 with e-value of 7.6e-14 and BLAST sequence identity of 37.7
  misc_feature: SWISSPROT Homolog: Y3380_VIBCH Hypothetical UPF0152 protein VCA0580 with e-value of 4.8e-12 and BLAST sequence identity of 30.0
  misc_feature: SWISSPROT Homolog: YDII_ECOLI Esterase ydiI (EC 3.1.-.-) with e-value of 7.8e-12 and BLAST sequence identity of 30.1
  misc_feature: SWISSPROT Homolog: Y1618_PSEAE Hypothetical UPF0152 protein PA1618 with e-value of 1.3e-11 and BLAST sequence identity of 33.7
  misc_feature: SWISSPROT Homolog: Y788_PASMU Hypothetical UPF0152 protein PM0788 with e-value of 7.0e-11 and BLAST sequence identity of 33.6
  misc_feature 229138:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: WHOLE PLANT - Yellow-Green Viable 2 Useful for making lethal plants for genetic confinement systems
  misc_feature: Phenotype: WHOLE PLANT - High Anthocyanin Useful for modulating anthocyanin content
  misc_feature: Phenotype: INFLORESCENCE - Reduced Apical Dominance Useful for modifying plant structure, ie increased branching
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Ovate Shaped Useful for making plants with increased biomass and foliage
  misc_feature: Phenotype: ROSETTE LEAVES - Serrate Margins Useful for making plants with increased biomass and foliage
  misc_feature: Phenotype: ROSETTE LEAVES - Trident Shaped Useful for making plants with increased biomass and foliage
  misc_feature (1)..(166): Functional Homolog of  Ceres CLONE ID no. 42925 at SEQ ID NO. 2089 with e-value of 5.30E-51 and BLAST sequence identity of 66.2
MEQSSSSSSSSSSSKKESLDVPLHSFGFQIEELSPQKVTGRLLVTPKCVQPFKVLHGGVSALISEAMASMGAHMASGLQRVAGIHLSINHVKSARLGDLVLAEATPFSIGKTIQVWEVRIWKLADPSNTESSKSLVSSSRVTLMCNLPVPDHAKEATENLRSHAKL

SEQ ID NO: 2048 - protein, 307 aa, Arabidopsis thaliana
  misc_feature (1)..(307): Ceres CLONE ID no. 42955
  misc_feature: Phenotype: ROSETTE LEAVES - Cup-shaped Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Serrate Margins Useful for making plants with increased biomass and foliage
MGFTKDQLLDRLQELEIDYSKYEHPPVLTVEEQAKYVSSSKGALSKNLFLKDKKHRYYIVSAMVDTKVDMKVLSQRLGLGKGGIRMAPEEALGELLQVSLGCVTPFAVVNESARDVSLLLDQKFKNQTRCIFHPLSNDVSVSLNTLGLDKFLKSIGRDPVYVDLEANPVVGKDQAPDLAVYVPSNSVIVPEIPNQTSSTQNPLPKSVSAEVNPVASAKTSKPACKVKSVAENSAPSAYKNPEKFVQEILDKTSALLLSEAKGECVEALAETLRKRLTSELTHLSIMYKNSSYAEGFYAGTRHQPKRL

SEQ ID NO: 2049 - DNA, 1137 bp, Populus balsamifera subsp. trichocarpa
  misc_feature (1)..(1137): Ceres ANNOT ID no. 1505155
  misc_feature 229377:<222: Transcription Factor
  misc_feature: Phenotype: ROSETTE LEAVES - Cup-shaped Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Serrate Margins Useful for making plants with increased biomass and foliage
atgggttttacaaagcaacagttgcttgctcgcttgaaggagcttcaaattaatttttcgcagtatgaacatcctactgttttgactgttgaagcacaggcaaaatatgtcggggataagggaggtggcctcagtaaaaatttattcttgaagcccggtaattgtatgtcctcgtgtatgcaggacaagaaaagtcggttctatatcgtttctgctctggctgacacgaaagtagatatgaaagttttgtctcaaaggcttggtttggggaaaggaggtataagaatggctcctgaagaagcattgggtgagatacttcaggttcctttgggctgtgttactccatttgcacttgtaaatgagtcagcacggcatgtctcactcttgttggataaaggatttcaatctcaggagcattgctttttccatccactatctaatgatatgtcaattgctctaaatgcttgcgatcttgacaagtttcttaaatcaataggaagagatccctcatacattgacctcgaggctaacccaactgtagggaaggatcaacctccagatcttgcttcttttgttccatctggttcaactattcagccagatcagccagataaagcagctcccctgcaagatcctacagagaattctcttcctgtgaataagaagtctgtagctgcaacagattctggattgtttgtggaagagattctcaataagacatcagctctattactttcagagatcacagaggatgctgccaaggagaatggtgtaaatctaggaactgtggttgctgaaaatattagaaagcggcttaattcagatttgcaaagcattgctacgatgtttaagaacacagcctatacgcaagggtttcatgctggtgctcaccctttagctttggtttcaagctttcaaggaaagattatccaaagagtcatgaataaaaaatgcgagaagagattggctcacattgtaatgagggaacctgaagttggaaagattccccctgttgccatagcagttccaaagccatccttaattccttgtggagatgataaaggcattcctcctatttccatagcatttccttggtcatcgttcattgcttatggagatgacgggcttgaatcttaa

SEQ ID NO: 2050 - protein, 378 aa, Populus balsamifera subsp. trichocarpa
  misc_feature (1)..(378): Ceres ANNOT ID no. 1505155
  misc_feature 229454:<222: Transcription Factor
  misc_feature: Phenotype: ROSETTE LEAVES - Cup-shaped Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Serrate Margins Useful for making plants with increased biomass and foliage
  misc_feature (1)..(378): Functional Homolog of  Ceres CLONE ID no. 42955 at SEQ ID NO. 2092 with e-value of 1.69E-84 and BLAST sequence identity of 68.5
MGFTKQQLLARLKELQINFSQYEHPTVLTVEAQAKYVGDKGGGLSKNLFLKPGNCMSSCMQDKKSRFYIVSALADTKVDMKVLSQRLGLGKGGIRMAPEEALGEILQVPLGCVTPFALVNESARHVSLLLDKGFQSQEHCFFHPLSNDMSIALNACDLDKFLKSIGRDPSYIDLEANPTVGKDQPPDLASFVPSGSTIQPDQPDKAAPLQDPTENSLPVNKKSVAATDSGLFVEEILNKTSALLLSEITEDAAKENGVNLGTVVAENIRKRLNSDLQSIATMFKNTAYTQGFHAGAHPLALVSSFQGKIIQRVMNKKCEKRLAHIVMREPEVGKIPPVAIAVPKPSLIPCGDDKGIPPISIAFPWSSFIAYGDDGLES

SEQ ID NO: 2051 - protein, 358 aa, Arabidopsis thaliana
  misc_feature (1)..(358): Ceres CLONE ID no. 42960
  misc_feature (1)..(358): Also Known As Ceres CDNA ID no. 23374793
  misc_feature (1)..(358): Also Known As Ceres GEMINI ID 532F11
  misc_feature (123)..(186): Pfam Name: AP2 Pfam Description: AP2 domain
  misc_feature 229593:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
MCGGAIISDFIPPPRSRRVTSEFIWPDLKKNLKGSKKSSKNRSNFFDFDAEFEADFQGFKDDSSIDCDDDFDVGDVFADVKPFVFTSTPKPAVSAAAEGSVFGKKVTGLDGEAEKSANRKRKNQYRGIRQRPWGKWAAEIRDPREGARIWLGTFKTAEEAARAYDAAARRIRGSKAKVNFPEENLKANSQKRSVKANLQKPVAKPNPNPSPALVQNSNISFENMCFMEEKHQVSNNNNNQFGMTNSVDAGCNGYQYFSSDQGSNSFDCSEFGWSDQAPITPDISSAVINNNNSALFFEEANPAKKLKSMDFETPYNNTEWDASLDFLNEDAVTTQDNGANPMDLWSIDEIHSMIGGVF

SEQ ID NO: 2052 - DNA, 1137 bp, Populus balsamifera subsp. trichocarpa
  misc_feature (1)..(1137): Ceres ANNOT ID no. 1481711
  misc_feature 229688:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
atgtgtggcggtgctatcatctctgacttcatacctccgaccaccaccgctcgatcttctcggcggtttgcggagggattcgagtggtttggtatgaagaaacccttagacaacaagaagtactcgaagccagttgttattaatcttgacgatgatttcgaggctgactttcaagagtttaaggatgagtctgatgtcgatgagaattatgatgtctttgttgatgccaagcctttttctttctctgctactgcttctgcccctgctaagaaacgttctgcgcctgttaaatctgctgaattcagtgggcaagctgaaaaatcagcaaagaggaagagaaagaaccagtatagaggaatccggcagcgcccatggggaaaatgggctgccgagattcgtgaccccaggaaaggggtacgtgtctggctgggaacgttcaataccgcagaggaagctgcaagggcgtatgatgctgaggcgcgtagaattcgtggcaagaaagctaaggtgaactttcctgatgaagctccacttgcttcatcaaagcagtcaattaaggaaaactcacggaaaccacttccaaagacaaattcaagccagtctttcagttacttgagcaacccagaactgaattataataatatgggctttgtggaagagaaaccacttgttaatcagtttggatcaatgaattcttttccagtcaatggagattctgggatgaagaccttagctccatctgacagtgctcctatgtgtttcaattctgaccaggggagcaactcatttgattgtgactttgggtggggagaacaaaccccaatgactcctgaaagcttgactgttcttgcagctacaccagaagctgatgaatatctccttgccaatcctgaggagttggaatcatactccgagaatgcagtgcctgttgaagagaagaatggaaaatccctgtctgaagagttgctggcgtttgacagtcagttgaaataccttcagatgccagatgctgagggtagtagctgggaggcttctcttgatagcttccttaatgtagagacaactcaggatggcacaaatgcaatggacttgtggagcttcgatgacttcccctctatggttgggggagtttattga

SEQ ID NO: 2053 - protein, 378 aa, Populus balsamifera subsp. trichocarpa
  misc_feature (1)..(378): Ceres ANNOT ID no. 1481711
  misc_feature (115)..(178): Pfam Name: AP2 Pfam Description: AP2 domain
  misc_feature: SWISSPROT Homolog: AP23_ARATH AP2 domain transcription factor RAP2.3 (Related to AP2 protein 3) (Cadmium-induced protein AS30) with e-value of 5.0e-37 and BLAST sequence identity of 75.4
  misc_feature: SWISSPROT Homolog: ERF5_NICSY Ethylene-responsive transcription factor 5 EREBP-4 (NsERF4) with e-value of 2.0e-23 and BLAST sequence identity of 53.8
  misc_feature: SWISSPROT Homolog: ERF3_ARATH Ethylene-responsive transcription factor 3 EREBP-3 (AtERF3) with e-value of 1.2e-22 and BLAST sequence identity of 70.7
  misc_feature: SWISSPROT Homolog: ERF13_ARATH Ethylene-responsive transcription factor 13 EREBP-13 (AtERF13) with e-value of 2.0e-22 and BLAST sequence identity of 40.4
  misc_feature: SWISSPROT Homolog: ERF5_ARATH Ethylene-responsive transcription factor 5 EREBP-5 (AtERF5) with e-value of 3.2e-22 and BLAST sequence identity of 41.6
  misc_feature 229798:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature (1)..(378): Functional Homolog of  Ceres CLONE ID no. 42960 at SEQ ID NO. 2095 with e-value of 1.19E-76 and BLAST sequence identity of 57.7
MCGGAIISDFIPPTTTARSSRRFAEGFEWFGMKKPLDNKKYSKPVVINLDDDFEADFQEFKDESDVDENYDVFVDAKPFSFSATASAPAKKRSAPVKSAEFSGQAEKSAKRKRKNQYRGIRQRPWGKWAAEIRDPRKGVRVWLGTFNTAEEAARAYDAEARRIRGKKAKVNFPDEAPLASSKQSIKENSRKPLPKTNSSQSFSYLSNPELNYNNMGFVEEKPLVNQFGSMNSFPVNGDSGMKTLAPSDSAPMCFNSDQGSNSFDCDFGWGEQTPMTPESLTVLAATPEADEYLLANPEELESYSENAVPVEEKNGKSLSEELLAFDSQLKYLQMPDAEGSSWEASLDSFLNVETTQDGTNAMDLWSFDDFPSMVGGVY

SEQ ID NO: 2054 - DNA, 1143 bp, Populus balsamifera subsp. trichocarpa; identical to SEQ ID NO: 874
  misc_feature (1)..(1143): Ceres ANNOT ID no. 1446703
  misc_feature 229904:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis

SEQ ID NO: 2055 - protein, 380 aa, Populus balsamifera subsp. trichocarpa; identical to SEQ ID NO: 875
  misc_feature (1)..(380): Ceres ANNOT ID no. 1446703
  misc_feature (119)..(182): Pfam Name: AP2 Pfam Description: AP2 domain
  misc_feature: SWISSPROT Homolog: AP23_ARATH AP2 domain transcription factor RAP2.3 (Related to AP2 protein 3) (Cadmium-induced protein AS30) with e-value of 5.0e-37 and BLAST sequence identity of 75.4
  misc_feature: SWISSPROT Homolog: ERF5_NICSY Ethylene-responsive transcription factor 5 EREBP-4 (NsERF4) with e-value of 2.0e-23 and BLAST sequence identity of 53.8
  misc_feature: SWISSPROT Homolog: ERF3_ARATH Ethylene-responsive transcription factor 3 EREBP-3 (AtERF3) with e-value of 1.2e-22 and BLAST sequence identity of 70.7
  misc_feature: SWISSPROT Homolog: ERF13_ARATH Ethylene-responsive transcription factor 13 EREBP-13 (AtERF13) with e-value of 2.0e-22 and BLAST sequence identity of 40.4
  misc_feature: SWISSPROT Homolog: ERF5_ARATH Ethylene-responsive transcription factor 5 EREBP-5 (AtERF5) with e-value of 3.2e-22 and BLAST sequence identity of 41.6
  misc_feature 230016:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature (1)..(380): Functional Homolog of  Ceres CLONE ID no. 42960 at SEQ ID NO. 2095 with e-value of 7.69E-75 and BLAST sequence identity of 56.3

SEQ ID NO: 2056 - protein, 241 aa, Arabidopsis thaliana
  misc_feature (1)..(241): Ceres CLONE ID no. 92102
  misc_feature (1)..(241): Also Known As Ceres CDNA ID no. 23375846
  misc_feature (1)..(241): Also Known As Ceres GEMINI ID 532F1
  misc_feature (86)..(150): Pfam Name: AP2 Pfam Description: AP2 domain
  misc_feature 230142:<222: Transcription Factor
  misc_feature: Phenotype: Activates expression of the gene endogenous to the AtPES (SEQ ID NO 4142) regalutory region Useful for modulating Terpenoid Biosynthesis
MATKQEALAIDFISQHLLTDFVSMETDHPSLFTNQLHNFHSETGPRTITNQSPKPNSTLNQRKPPLPNLSVSRTVSTKTEKEEEERHYRGVRRRPWGKYAAEIRDPNKKGCRIWLGTYDTAVEAGRAYDQAAFQLRGRKAILNFPLDVRVTSETCSGEGVIGLGKRKRDKSSPPEEEKAARVKVEEEESNTSETTEAEVEPVVPLTPSSWMGFWDVGAGDGIFSIPPLSPTSPNFSVISVT

SEQ ID NO: 2057 - DNA, 867 bp, Populus balsamifera subsp. trichocarpa
  misc_feature (1)..(867): Ceres ANNOT ID no. 1484557
  misc_feature 230215:<222: Transcription Factor
  misc_feature: Phenotype: Activates expression of the gene endogenous to the AtPES (SEQ ID NO 4142) regalutory region Useful for modulating Terpenoid Biosynthesis
atggcatcttttgatgaagcttcagctttggaactcattagggagcacctcttgactgactttgcttccatggacagcttaatcaccaatcttgatgatctttgcagtacttccagctcctgtattactactgactacatcaagactgaatcaacagaattcgacccctttaatcaatcagagcacccacaacctaagctgcagagtcaatctagcatcgaatccaagccccaatcctcaccaaagtctccaagcactctaagccagagaaaaccatccatgatcaagaacatcgcaattcctccaccagcaaccttgaacatgaccccacaagtagtacagccagtggtgatcaaggcagatgtttcaagtgaacaagaaaggcattacaggggcgttaggcgtaggccatggggcaaatatgcagctgagatccgtgaccctaacaaaaaaggagctcgtgtatggcttggaacatttgatacagccattgaagctgcaaaagcttatgacagtgctgctttcaggctacgtggaagtaaagcaatcttgaatttccctcttgaagctggaaagtctaattctcagcaacctgaacaattcttggaaacttcaagcaagaaaagaaagattgaagaaatagagagtagtatggaaagtactggttctgtgatcactaataaggtggcgaagagggaaagttcttcgccggaaactgaggtcaaagcagcggctacggaaccattaacgccgtcaagttggaaggggttctgggatggtgaagtcatggggatatttaatgtgccaccattgtcaccgttatctccccatccttcatttgggtattcaaggctgatggttgtttga

SEQ ID NO: 2058 - protein, 288 aa, Populus balsamifera subsp. trichocarpa
  misc_feature (1)..(288): Ceres ANNOT ID no. 1484557
  misc_feature (128)..(192): Pfam Name: AP2 Pfam Description: AP2 domain
  misc_feature: SWISSPROT Homolog: ERF5_NICSY Ethylene-responsive transcription factor 5 EREBP-4 (NsERF4) with e-value of 1.1e-39 and BLAST sequence identity of 46.4
  misc_feature: SWISSPROT Homolog: ERF5_TOBAC Ethylene-responsive transcription factor 5 EREBP-4 (NtERF4) with e-value of 2.8e-39 and BLAST sequence identity of 42.7
  misc_feature: SWISSPROT Homolog: ERF5_ARATH Ethylene-responsive transcription factor 5 EREBP-5 (AtERF5) with e-value of 1.1e-35 and BLAST sequence identity of 49.4
  misc_feature: SWISSPROT Homolog: ERF6_ARATH Ethylene-responsive transcription factor 6 EREBP-6 (AtERF6) with e-value of 1.1e-30 and BLAST sequence identity of 38.7
  misc_feature: SWISSPROT Homolog: ERF2_TOBAC Ethylene-responsive transcription factor 2 EREBP-2 (NtERF2) with e-value of 5.7e-25 and BLAST sequence identity of 42.0
  misc_feature 230316:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(288): Functional Homolog of  Ceres CLONE ID no. 92102 at SEQ ID NO. 2100 with e-value of 1.69E-45 and BLAST sequence identity of 53.6
MASFDEASALELIREHLLTDFASMDSLITNLDDLCSTSSSCITTDYIKTESTEFDPFNQSEHPQPKLQSQSSIESKPQSSPKSPSTLSQRKPSMIKNIAIPPPATLNMTPQVVQPVVIKADVSSEQERHYRGVRRRPWGKYAAEIRDPNKKGARVWLGTFDTAIEAAKAYDSAAFRLRGSKAILNFPLEAGKSNSQQPEQFLETSSKKRKIEEIESSMESTGSVITNKVAKRESSSPETEVKAAATEPLTPSSWKGFWDGEVMGIFNVPPLSPLSPHPSFGYSRLMVV

SEQ ID NO: 2059 - DNA, 864 bp, Populus balsamifera subsp. trichocarpa
  misc_feature (1)..(864): Ceres ANNOT ID no. 1438401
  misc_feature 230406:<222: Transcription Factor
  misc_feature: Phenotype: Activates expression of the gene endogenous to the AtPES (SEQ ID NO 4142) regalutory region Useful for modulating Terpenoid Biosynthesis
atggcatcttttgatcatgaagcttcaacattggaactcattaggcaacacctcttgactgactttgcttccatggacagcttcatctccaatcttgatgatctttgcagcacttccaccaccagtactactgatgactactacatcaagtctgaatcaacagaatttgatccctttgatcaaccacaattcaagctgcaaactcaatctagcattgaatccaagcctcaatattcctcaccaaagtcttcaacttctctaagccagagaaaaccatccatgatcaaggacatagccatacctccaccagcaaccttgaacatgaacccacaagtagcacagccagtggtgaacaagacagatttgtctagtgaacaagataggcattacaggggtgttaggcgtaggccttggggaaaatatgcagcggagatccgtgaccctaacaaaaaaggagctcgtgtatggcttggaacatttgatactgccattgaagctgccaaagcttatgatagcgctgctttcaggttacgaggaagcaaagcgatcttgaatttccctcttgaagctggcaagtcgaattctcaacaacctgaacaattcttggaaacttcttgcaagaaaagaaagtttgaaggaataaagagtagcgtggaaggtactaattctatcactaataaggtggtgaagagggagacttcttcaccggaaagtgaggtcaaagcggttgcttcgggtccattaacgccgtcaagttggaaggggttttgggatggtgaaaccatggggatatttagtgtgccaccattatcgccgttatctccacatccttcatttggatattcaaggctcatggttgtttga

SEQ ID NO: 2060 - protein, 287 aa, Populus balsamifera subsp. trichocarpa
  misc_feature (1)..(287): Ceres ANNOT ID no. 1438401
  misc_feature (128)..(192): Pfam Name: AP2 Pfam Description: AP2 domain
  misc_feature: SWISSPROT Homolog: ERF5_NICSY Ethylene-responsive transcription factor 5 EREBP-4 (NsERF4) with e-value of 1.1e-39 and BLAST sequence identity of 46.4
  misc_feature: SWISSPROT Homolog: ERF5_TOBAC Ethylene-responsive transcription factor 5 EREBP-4 (NtERF4) with e-value of 2.8e-39 and BLAST sequence identity of 42.7
  misc_feature: SWISSPROT Homolog: ERF5_ARATH Ethylene-responsive transcription factor 5 EREBP-5 (AtERF5) with e-value of 1.1e-35 and BLAST sequence identity of 49.4
  misc_feature: SWISSPROT Homolog: ERF6_ARATH Ethylene-responsive transcription factor 6 EREBP-6 (AtERF6) with e-value of 1.1e-30 and BLAST sequence identity of 38.7
  misc_feature: SWISSPROT Homolog: ERF2_TOBAC Ethylene-responsive transcription factor 2 EREBP-2 (NtERF2) with e-value of 5.7e-25 and BLAST sequence identity of 42.0
  misc_feature 230507:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(287): Functional Homolog of  Ceres CLONE ID no. 92102 at SEQ ID NO. 2100 with e-value of 3.69E-43 and BLAST sequence identity of 55.6
MASFDHEASTLELIRQHLLTDFASMDSFISNLDDLCSTSTTSTTDDYYIKSESTEFDPFDQPQFKLQTQSSIESKPQYSSPKSSTSLSQRKPSMIKDIAIPPPATLNMNPQVAQPVVNKTDLSSEQDRHYRGVRRRPWGKYAAEIRDPNKKGARVWLGTFDTAIEAAKAYDSAAFRLRGSKAILNFPLEAGKSNSQQPEQFLETSCKKRKFEGIKSSVEGTNSITNKVVKRETSSPESEVKAVASGPLTPSSWKGFWDGETMGIFSVPPLSPLSPHPSFGYSRLMVV

SEQ ID NO: 2061 - protein, 139 aa, Arabidopsis thaliana
  misc_feature (1)..(139): Ceres CLONE ID no. 92670
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MPLYDCMLLFKPIIRKEGLIDLVARIGKHVYSRNGVLTEIKSFGKVELGYGIRKLDGRHYQGQLMQITMMTTPNMNKELHYLNKEDKLLRWLLVKHRDIKIGQSEKEDSLTVPNRLTSGSLYDGSSSDEDDNNILGLSR

SEQ ID NO: 2062 - DNA, 444 bp, Populus balsamifera subsp. trichocarpa
  misc_feature (1)..(444): Ceres ANNOT ID no. 1531919
  misc_feature 230692:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgcctctttatgattgtatgctcatgttgaaacctcatgtacgaaaggaagcattgatggacttggttgctcgagtaggcaagcatgtttatagtagaaatggtgttgtcactgatataaaatcatttggcactgttcaactggggtatggtattaagaagctcgatggtagacattatcagggccaactgatgcaaataacaatgatggccacacctaacatcaacaaggagctgcattacctgaacaaggaggatcgcctgctgcgttggcttcttgttaaacaccgggacataaaatttgggctagaattcatggatgaagatgatgaagatggcgagtttgatttcagtgaattccctcgggacagcatttttgacaacgacaacagtgatgattatgaagacagcagccacgatgaggacaatgacggcgaccaataa

SEQ ID NO: 2063 - protein, 147 aa, Populus balsamifera subsp. trichocarpa
  misc_feature (1)..(147): Ceres ANNOT ID no. 1531919
  misc_feature 230782:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(147): Functional Homolog of  Ceres CLONE ID no. 92670 at SEQ ID NO. 2105 with e-value of 7.29E-47 and BLAST sequence identity of 69.1
MPLYDCMLMLKPHVRKEALMDLVARVGKHVYSRNGVVTDIKSFGTVQLGYGIKKLDGRHYQGQLMQITMMATPNINKELHYLNKEDRLLRWLLVKHRDIKFGLEFMDEDDEDGEFDFSEFPRDSIFDNDNSDDYEDSSHDEDNDGDQ

SEQ ID NO: 2064 - protein, 284 aa, Arabidopsis thaliana
  misc_feature (1)..(284): Ceres CLONE ID no. 93867
  misc_feature (177)..(250): Pfam Name: Ribosomal_S5_C Pfam Description: Ribosomal protein S5, C-terminal domain
  misc_feature (94)..(160): Pfam Name: Ribosomal_S5 Pfam Description: Ribosomal protein S5, N-terminal domain
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
MAERGGEGGTERGGDRGDFGRGFGGGRGGGRGRDRGPRGRGRRGGRASEETKWVPVTKLGRLVADNKITKLEQIYLHSLPVKEYQIIDHLVGPTLKDEVMKIMPVQKQTRAGQRTRFKAFVVVGDGNGHVGLGVKCSKEVATAIRGAIILAKLSVVPVRRGYWGNKIGKPHTVPCKVTGKCGSVTVRMVPAPRGSGIVAARVPKKVLQFAGIDDVFTSSRGSTKTLGNFVKATFDCLQKTYGFLTPEFWKETRFSRSPYQEHTDFLSTKAVSATKVITEGEDQA

SEQ ID NO: 2065 - DNA, 831 bp, Populus balsamifera subsp. trichocarpa
  misc_feature (1)..(831): Ceres ANNOT ID no. 1474944
  misc_feature 230996:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
atggaagagcgcccccctgcagaacgtggatccttcggtcgtggcttcggtggacgtggagaccggggaggccgaggtggacgtggagatcgcggtggacgaggccgacgccgctctggccgcaaagaggaggaagagaaatgggtaccagtcacaaaactaggccgccttgtaaaagatggcaaaatctcctccgtggagcaaatctacctccactcactacccatcaaagagtaccaaatcatagacacccttattggtcctatcttgaaagatgaggtgatgaaaatcaccccagttcagaaacaaacaagagccggtcagcgaaccaggttcaaggcctttgttgttgttggtgatgggaatggacatgttggtttgggtgtgaagtgtgctaaagaagtggccactgccattcgtggggctattattttggcaaaactctctattattccggtgaggagagggtactgggggaacaagatcggaaagccacatactgtgccttgtaaggttacagggaagtgtggcagtgtgactgtgagaatggtccccgcccctcgtggagctgggattgttgctgccagggttcctaagaaggtgcttcagtttgctggaattgatgatgtttttacatcttccagaggatctactaagactcttggaaactttgttaaggccacatttgactgcttgctgaagacttatgggttccttacacctgacttctggaaggagactcgcttcataaggtcaccattccaagagtacacagatctgttggcaaaacccactagcaaggttctcatcactgaggttcatgaagattga

SEQ ID NO: 2066 - protein, 276 aa, Populus balsamifera subsp. trichocarpa
  misc_feature (1)..(276): Ceres ANNOT ID no. 1474944
  misc_feature (172)..(245): Pfam Name: Ribosomal_S5_C Pfam Description: Ribosomal protein S5, C-terminal domain
  misc_feature (89)..(155): Pfam Name: Ribosomal_S5 Pfam Description: Ribosomal protein S5, N-terminal domain
  misc_feature: SWISSPROT Homolog: RS2_ARATH 40S ribosomal protein S2 with e-value of 1.1e-133 and BLAST sequence identity of 89.5
  misc_feature: SWISSPROT Homolog: RS2_HUMAN 40S ribosomal protein S2 (S4) (LLRep3 protein) with e-value of 1.2e-102 and BLAST sequence identity of 74.4
  misc_feature: SWISSPROT Homolog: RS2_MOUSE 40S ribosomal protein S2 (S4) (LLRep3 protein) with e-value of 1.2e-102 and BLAST sequence identity of 74.2
  misc_feature: SWISSPROT Homolog: RS2_RAT 40S ribosomal protein S2 with e-value of 1.2e-102 and BLAST sequence identity of 74.2
  misc_feature: SWISSPROT Homolog: RS2_BOVIN 40S ribosomal protein S2 (Fragment) with e-value of 2.9e-101 and BLAST sequence identity of 73.5
  misc_feature 231113:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature (1)..(276): Functional Homolog of  Ceres CLONE ID no. 93867 at SEQ ID NO. 2108 with e-value of 3.10E-117 and BLAST sequence identity of 86.2
MEERPPAERGSFGRGFGGRGDRGGRGGRGDRGGRGRRRSGRKEEEEKWVPVTKLGRLVKDGKISSVEQIYLHSLPIKEYQIIDTLIGPILKDEVMKITPVQKQTRAGQRTRFKAFVVVGDGNGHVGLGVKCAKEVATAIRGAIILAKLSIIPVRRGYWGNKIGKPHTVPCKVTGKCGSVTVRMVPAPRGAGIVAARVPKKVLQFAGIDDVFTSSRGSTKTLGNFVKATFDCLLKTYGFLTPDFWKETRFIRSPFQEYTDLLAKPTSKVLITEVHED

SEQ ID NO: 2067 - DNA, 813 bp, Populus balsamifera subsp. trichocarpa
  misc_feature (1)..(813): Ceres ANNOT ID no. 1506849
  misc_feature 231214:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
atggcagagcgcccccccgcagaacgtggttccttcggccgtggtttcggtggccgtggtggacgtggagaccgtggtggccgaggccgccgccgcggtggacgcaaagaggaagaagaaaaatgggttcccgtcaccaaactaggccgccttgtgaaagacggaaaaatatcctccgtcgaacaaatctaccttcactccctacccatcaaggagtatcaaatcattgacactctcattggccctgctttgaaagatgaggtgatgaaaatcaccccagttcagaaacaaaccagagccggtcagcgaacccggttcaaggcctttgttgttgttggcgattgcaatggacatgttgggttgggtgtgaagtgtgctaaagaggtggctactgccattcgcggggctattattttggctaaactgtcgattattcctgtgagaagagggtactggggaaacaagatcggaaagccacatactgtgccttgtaaggttacagggaagtgtggaagtgtaactgtgagaatggttcctgcccctcgtggagctgggatcgttgctgctagggttccaaagaaggtgcttcagtttgctgggattgatgatgttttcacatcatccagaggatctaccaagactcttgggaacttcgtcaaggcaacatttgactgcttgctgaagacttatgggttccttacacctgacttttggaaggagacccgcttcataagatctccattccaagagtacacagatctcttggcaaagcctactagcaaggttctcatcgctgaggttcaacaagaatga

SEQ ID NO: 2068 - protein, 270 aa, Populus balsamifera subsp. trichocarpa
  misc_feature (1)..(270): Ceres ANNOT ID no. 1506849
  misc_feature (166)..(239): Pfam Name: Ribosomal_S5_C Pfam Description: Ribosomal protein S5, C-terminal domain
  misc_feature (83)..(149): Pfam Name: Ribosomal_S5 Pfam Description: Ribosomal protein S5, N-terminal domain
  misc_feature: SWISSPROT Homolog: RS2_ARATH 40S ribosomal protein S2 with e-value of 1.1e-133 and BLAST sequence identity of 89.5
  misc_feature: SWISSPROT Homolog: RS2_HUMAN 40S ribosomal protein S2 (S4) (LLRep3 protein) with e-value of 1.2e-102 and BLAST sequence identity of 74.4
  misc_feature: SWISSPROT Homolog: RS2_MOUSE 40S ribosomal protein S2 (S4) (LLRep3 protein) with e-value of 1.2e-102 and BLAST sequence identity of 74.2
  misc_feature: SWISSPROT Homolog: RS2_RAT 40S ribosomal protein S2 with e-value of 1.2e-102 and BLAST sequence identity of 74.2
  misc_feature: SWISSPROT Homolog: RS2_BOVIN 40S ribosomal protein S2 (Fragment) with e-value of 2.9e-101 and BLAST sequence identity of 73.5
  misc_feature 231331:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature (1)..(270): Functional Homolog of  Ceres CLONE ID no. 93867 at SEQ ID NO. 2108 with e-value of 2.20E-116 and BLAST sequence identity of 88.3
MAERPPAERGSFGRGFGGRGGRGDRGGRGRRRGGRKEEEEKWVPVTKLGRLVKDGKISSVEQIYLHSLPIKEYQIIDTLIGPALKDEVMKITPVQKQTRAGQRTRFKAFVVVGDCNGHVGLGVKCAKEVATAIRGAIILAKLSIIPVRRGYWGNKIGKPHTVPCKVTGKCGSVTVRMVPAPRGAGIVAARVPKKVLQFAGIDDVFTSSRGSTKTLGNFVKATFDCLLKTYGFLTPDFWKETRFIRSPFQEYTDLLAKPTSKVLIAEVQQE

SEQ ID NO: 2069 - DNA, 897 bp, Populus balsamifera subsp. trichocarpa
  misc_feature (1)..(897): Ceres ANNOT ID no. 1492957
  misc_feature 231429:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
atggccgccgccgtcatctctgttctcctcctccaaaaactacatcgcctccacacaccaaccctagttttgcaatcatggcagacagaggagcaggaggagaacggggaggcgaccgtggagccttccgccgtggattcggcggcccaacgcggaggacgaggtggtcgccgccgtgctcgccgtgatgaggaggaaaaatgggtcccagttaccaagcttggccgtctcgttcgcgacggaaaaatccgatctctcgaacaaatctacctccactcactcccaatcaaagagtatcaaattattgacacccttgttggaccaggcatgaaggatgaggtcatgaagatcactccggttcagaaacaaacacgtgccggtcaaaggactaggtttaaggcctttgtggttgttggtgatgggaatggacacgtgggtttgggagttaagtgttcgaaggaagtggcgactgccattcgtggggctattatactggccaaattgtcggttattcctgtgaggagagggtattggggtaacaaaattgggcagccacatactgtgccttgtaaggttactgggaagtgtgggtctgtaactgtgaggatggtgcctgctcctcgtggtgcgggaattgtcgcggctagagtgccgaagaaggtgcttcaatttgctgggattgaggatgtttttacgtcttccagagggtctactaagactcttggcaactttgtcaaggccacttttgactgtctcttgaaaacctatggtttcttgactcctgatttctggacggagactcgctttatcaaatctcctttccaagagttcactgatctactagcaaagccaacaaaaacccttgtccttgaagatgtggagagagtggaggcctga

SEQ ID NO: 2070 - protein, 298 aa, Populus balsamifera subsp. trichocarpa
  misc_feature (1)..(298): Ceres ANNOT ID no. 1492957
  misc_feature (109)..(175): Pfam Name: Ribosomal_S5 Pfam Description: Ribosomal protein S5, N-terminal domain
  misc_feature (192)..(265): Pfam Name: Ribosomal_S5_C Pfam Description: Ribosomal protein S5, C-terminal domain
  misc_feature: SWISSPROT Homolog: RS2_ARATH 40S ribosomal protein S2 with e-value of 1.1e-133 and BLAST sequence identity of 89.5
  misc_feature: SWISSPROT Homolog: RS2_HUMAN 40S ribosomal protein S2 (S4) (LLRep3 protein) with e-value of 1.2e-102 and BLAST sequence identity of 74.4
  misc_feature: SWISSPROT Homolog: RS2_MOUSE 40S ribosomal protein S2 (S4) (LLRep3 protein) with e-value of 1.2e-102 and BLAST sequence identity of 74.2
  misc_feature: SWISSPROT Homolog: RS2_RAT 40S ribosomal protein S2 with e-value of 1.2e-102 and BLAST sequence identity of 74.2
  misc_feature: SWISSPROT Homolog: RS2_BOVIN 40S ribosomal protein S2 (Fragment) with e-value of 2.9e-101 and BLAST sequence identity of 73.5
  misc_feature 231548:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature (1)..(298): Functional Homolog of  Ceres CLONE ID no. 93867 at SEQ ID NO. 2108 with e-value of 1.39E-109 and BLAST sequence identity of 87.9
MAAAVISVLLLQKLHRLHTPTLVLQSWQTEEQEENGEATVEPSAVDSAAQRGGRGGRRRARRDEEEKWVPVTKLGRLVRDGKIRSLEQIYLHSLPIKEYQIIDTLVGPGMKDEVMKITPVQKQTRAGQRTRFKAFVVVGDGNGHVGLGVKCSKEVATAIRGAIILAKLSVIPVRRGYWGNKIGQPHTVPCKVTGKCGSVTVRMVPAPRGAGIVAARVPKKVLQFAGIEDVFTSSRGSTKTLGNFVKATFDCLLKTYGFLTPDFWTETRFIKSPFQEFTDLLAKPTKTLVLEDVERVEA

SEQ ID NO: 2071 - protein, 307 aa, Arabidopsis thaliana
  misc_feature (1)..(307): Ceres CLONE ID no. 94688
  misc_feature (1)..(307): Also Known As Ceres CDNA ID no. 23389279
  misc_feature (1)..(307): Also Known As Ceres GEMINI ID 533G1
  misc_feature (218)..(287): Pfam Name: ACT Pfam Description: ACT domain
  misc_feature (5)..(107): Pfam Name: AA_kinase Pfam Description: Amino acid kinase family
  misc_feature 231678:<222: Transcription Factor
  misc_feature: Phenotype: Activates expression of the gene endogenous to the PsBBE (SEQ ID NO 4160) regalutory region Useful for modulating Alkaloid Biosynthesis
MHDPAVPIVTGFLGKGWKTGAVTTLGRGGSDLTATTIGKALGLKEIQVWKDVDGVLTCDPTIYKRATPVPYLTFDEAAELAYFGAQVLHPQSMRPAREGEIPVRVKNSYNPKAPGTIITKTRDMTKSILTSIVLKRNVTMLDIASTRMLGQVGFLAKVFSIFEELGISVDVVATSEVSISLTLDPSKLWSRELIQQELDHVVEELEKIAVVNLLKGRAIISLIGNVQHSSLILERAFHVLYTKGVNVQMISQGASKVNISFIVNEAEAEGCVQALHKSFFESGDLSELLIQPRLGNGSPVRTLQVEN

SEQ ID NO: 2072 - DNA, 1674 bp, Populus balsamifera subsp. trichocarpa
  misc_feature (1)..(1674): Ceres ANNOT ID no. 1498587
  misc_feature 231763:<222: Transcription Factor
  misc_feature: Phenotype: Activates expression of the gene endogenous to the PsBBE (SEQ ID NO 4160) regalutory region Useful for modulating Alkaloid Biosynthesis
atggcaaacgcattgcaattttcggcgaccgtacaagctgcctcccctgttttctccaagaggatgcatggccaatctttacggcacaggccgtcgccgccgcttaattataatttagtggctacaagtttggtactgtcaaaaagaagtcgtagagcctttaaagtgagctgtgaggcagccagtgttgatctacttgaaacgaacaaaatcgataatgaagccgagaagaaaataacatgcgtaatgaagttcggtggttcttcggtggcgtctgccgagagaatgagagaagtggctgaacttatacttagctttccaaatgagagccctgtcattgtactttctgccatgggaaagaccactaacaaacttttgctggctggagagaaggctgttagttgcggtgttactaatgtagatagtattgaagagctgagtttcataaaggaattgcataaccggaccgtgaaggaactggaagtagacgagtcggttattgcaaaacacttggaggaattagagcagctgttgaagggaattgctatgatgaaagagttgactccacgcactagagattaccttgtttcttttggggagtgcatgtccacaaggatttttgctgcatatatgaataaaattggtgctaaagctcgccaatatgatgctttcgaaattggttttatcaccacagatgacttcacaaatgcagacattcttgaagcaacttatccggctgttgcaaagagtttgcatggagactggattagtgatcctgcaattcctattgttaccggcttccttggaaagggatggagatcctgtgctattactacattaggtcgtggtggtagtgatttgacagccacaaccattggaaaagcattaggtttgagtgagattcaggtgtggaaggatgttgatggtgttttgacatgtgatcctaatatatatccacatgctgaacctgtgccatacttgacatttgatgaggcagcagaactagcatattttggcgcgcaggtcttgcatccgcaatccatgaggcctgccagggaggctgatattcctgttagggttaaaaattcttacaatccgaatgctcctggaactcttatcaccagagcacgagatatgagtaaggcagtactaactagcattgttttgaaacggaatgttactatgttggatattgctagcacccgcatgcttggccaatttggttttcttgctaaggtgttttcaacctttgaagatttgggaatatcagtggatgttgtagctaccagcgaagtcagtatctccttgacactcgatccatcaaagctttggagtagagagctgattcagcaggcaagcgaactcgaccatgttgttgaggagcttgagaaaattgctgtagtcaatctcctgcagcgtagatcaataatctctctcattgggaatgtccagaggtcctctctgatattagagaaggccttccatgttcttcgtactcttggagtcaatgttcagatgatatcacagggtgcttcgaaggttaatatctcattaattgtgaatgacgatgaagcagagcagtgtgtcaagagtctccacaaagctttctttgaaactgacatctctgaattagagtgggagtgtgtatctggtaatggttctgcctcaacatga

SEQ ID NO: 2073 - protein, 475 aa, Populus balsamifera subsp. trichocarpa
  misc_feature (1)..(475): Ceres ANNOT ID no. 1498587
  misc_feature (1)..(280): Pfam Name: AA_kinase Pfam Description: Amino acid kinase family
  misc_feature (317)..(392): Pfam Name: ACT Pfam Description: ACT domain
  misc_feature: SWISSPROT Homolog: AK_METJA Probable aspartokinase (EC 2.7.2.4) (Aspartate kinase) with e-value of 5.9e-46 and BLAST sequence identity of 37.3
  misc_feature: SWISSPROT Homolog: AK3_ECOLI Lysine-sensitive aspartokinase 3 (EC 2.7.2.4) (Lysine-sensitive aspartokinase III) (Aspartate kinase III) with e-value of 2.6e-45 and BLAST sequence identity of 41.0
  misc_feature: SWISSPROT Homolog: AK_SCHPO Probable aspartokinase (EC 2.7.2.4) (Aspartate kinase) with e-value of 3.2e-42 and BLAST sequence identity of 42.5
  misc_feature: SWISSPROT Homolog: AKH_HAEIN Bifunctional aspartokinase/homoserine dehydrogenase with e-value of 3.1e-36 and BLAST sequence identity of 32.2
  misc_feature: SWISSPROT Homolog: AKH_HAEIN AK-HD [Includes: Aspartokinase ( EC 2.7.2.4); Homoserine dehydrogenase ( EC 1.1.1.3)]
  misc_feature: SWISSPROT Homolog: AK1H_ECOLI Bifunctional aspartokinase/homoserine dehydrogenase I with e-value of 3.1e-36 and BLAST sequence identity of 34.3
  misc_feature: SWISSPROT Homolog: AK1H_ECOLI AKI-HDI [Includes: Aspartokinase I (EC 2.7.2.4); Homoserine dehydrogenase I (EC 1.1.1.3)]
  misc_feature 231911:<222: Transcription Factor
  misc_feature: Phenotype: Activates expression of the gene endogenous to the PsBBE (SEQ ID NO 4160) regalutory region Useful for modulating Alkaloid Biosynthesis
  misc_feature (1)..(475): Functional Homolog of  Ceres CLONE ID no. 94688 at SEQ ID NO. 2115 with e-value of 4.39E-127 and BLAST sequence identity of 85.0
MKFGGSSVASAERMREVAELILSFPNESPVIVLSAMGKTTNKLLLAGEKAVSCGVTNVDSIEELSFIKELHNRTVKELEVDESVIAKHLEELEQLLKGIAMMKELTPRTRDYLVSFGECMSTRIFAAYMNKIGAKARQYDAFEIGFITTDDFTNADILEATYPAVAKSLHGDWISDPAIPIVTGFLGKGWRSCAITTLGRGGSDLTATTIGKALGLSEIQVWKDVDGVLTCDPNIYPHAEPVPYLTFDEAAELAYFGAQVLHPQSMRPAREADIPVRVKNSYNPNAPGTLITRARDMSKAVLTSIVLKRNVTMLDIASTRMLGQFGFLAKVFSTFEDLGISVDVVATSEVSISLTLDPSKLWSRELIQQASELDHVVEELEKIAVVNLLQRRSIISLIGNVQRSSLILEKAFHVLRTLGVNVQMISQGASKVNISLIVNDDEAEQCVKSLHKAFFETDISELEWECVSGNGSAST

SEQ ID NO: 2074 - DNA, 1188 bp, Populus balsamifera subsp. trichocarpa
  misc_feature (1)..(1188): Ceres ANNOT ID no. 1525287
  misc_feature 232034:<222: Transcription Factor
  misc_feature: Phenotype: Activates expression of the gene endogenous to the PsBBE (SEQ ID NO 4160) regalutory region Useful for modulating Alkaloid Biosynthesis
atgtccacgaggatttttgcagcatatatgaataaaatcggtgcaaaagctcgccaatatgatgctttcaaaattggttttatcaccacagatgacttcacgaatgcagacattctagaagcaacttatccagctgtggcacagagtttgcatggagattggattagagatactgcaattcccattgttaccggcttccttggaaagggctggcgatcttgtgcgattactacattaggccgtggtggcagtgatttgacggccacaacaattggaaaagcattaggtttgcgcgagattcaggtgtggaaggatgttgatggtgttttgacatgtgatcctaatatatatccacatgctgaacctgtgccatacttgacatttgatgaggcagcggaactagcatattttggtgctcaggtcttgcatccacaatccatgagacctgctagggagggtgatattccagttagggttaaaaattcttacaattcaaatgctcctgggactctcatcaccaggacacgagatatgagtaaggcagttctaactagcattgttatgaaacggaatgttactatgttggatattgttagcacccgcatgcttggccaatttggttttcttgctaaggtgttttcgatctttgaagatttaggaatatcagtagatgttgtggctactagcgaagtcagcatctccttgacactcgatccatcaaagctttggagtagagagctgattcagcaggcaagcgaactcgaccatgttgtggaagagcttgagaaaattgctgtagtcaatctcctgcagcatagatcaataatctctctcattgggaatgtccagaggtcctctctgatattagagaaggtcttcaatgttcttcatatcaaaggaatcaacgttcagatgatatcacagggtgcttcaaagatggctccttatcttggggtgctcactattcctggggctcggatgcttcttagcaatttgttgactgtcacgacaagtaactcacctttggccttcacttaccaggttaatatctcattaattgtgaatgatgatgaagcagagcagtgtgtcaggagtctccactcagctttctttgaaagcgacgtctctgaattagatgggaagtgtgtttctgataatggtccagttcagcttcgaagtgaagaataa

SEQ ID NO: 2075 - protein, 386 aa, Populus balsamifera subsp. trichocarpa
  misc_feature (1)..(386): Ceres ANNOT ID no. 1525287
  misc_feature (1)..(152): Pfam Name: AA_kinase Pfam Description: Amino acid kinase family
  misc_feature (189)..(264): Pfam Name: ACT Pfam Description: ACT domain
  misc_feature: SWISSPROT Homolog: AK_METJA Probable aspartokinase (EC 2.7.2.4) (Aspartate kinase) with e-value of 5.9e-46 and BLAST sequence identity of 37.3
  misc_feature: SWISSPROT Homolog: AK3_ECOLI Lysine-sensitive aspartokinase 3 (EC 2.7.2.4) (Lysine-sensitive aspartokinase III) (Aspartate kinase III) with e-value of 2.6e-45 and BLAST sequence identity of 41.0
  misc_feature: SWISSPROT Homolog: AK_SCHPO Probable aspartokinase (EC 2.7.2.4) (Aspartate kinase) with e-value of 3.2e-42 and BLAST sequence identity of 42.5
  misc_feature: SWISSPROT Homolog: AKH_HAEIN Bifunctional aspartokinase/homoserine dehydrogenase with e-value of 3.1e-36 and BLAST sequence identity of 32.2
  misc_feature: SWISSPROT Homolog: AKH_HAEIN AK-HD [Includes: Aspartokinase ( EC 2.7.2.4); Homoserine dehydrogenase ( EC 1.1.1.3)]
  misc_feature: SWISSPROT Homolog: AK1H_ECOLI Bifunctional aspartokinase/homoserine dehydrogenase I with e-value of 3.1e-36 and BLAST sequence identity of 34.3
  misc_feature: SWISSPROT Homolog: AK1H_ECOLI AKI-HDI [Includes: Aspartokinase I (EC 2.7.2.4); Homoserine dehydrogenase I (EC 1.1.1.3)]
  misc_feature 232166:<222: Transcription Factor
  misc_feature: Phenotype: Activates expression of the gene endogenous to the PsBBE (SEQ ID NO 4160) regalutory region Useful for modulating Alkaloid Biosynthesis
  misc_feature (1)..(386): Functional Homolog of  Ceres CLONE ID no. 94688 at SEQ ID NO. 2115 with e-value of 1.70E-116 and BLAST sequence identity of 84.6
MNKIGAKARQYDAFKIGFITTDDFTNADILEATYPAVAQSLHGDWIRDTAIPIVTGFLGKGWRSCAITTLGRGGSDLTATTIGKALGLREIQVWKDVDGVLTCDPNIYPHAEPVPYLTFDEAAELAYFGAQVLHPQSMRPAREGDIPVRVKNSYNSNAPGTLITRTRDMSKAVLTSIVMKRNVTMLDIVSTRMLGQFGFLAKVFSIFEDLGISVDVVATSEVSISLTLDPSKLWSRELIQQASELDHVVEELEKIAVVNLLQHRSIISLIGNVQRSSLILEKVFNVLHIKGINVQMISQGASKMAPYLGVLTIPGARMLLSNLLTVTTSNSPLAFTYQVNISLIVNDDEAEQCVRSLHSAFFESDVSELDGKCVSDNGPVQLRSEE

SEQ ID NO: 2076 - protein, 180 aa, Arabidopsis thaliana
  misc_feature (1)..(180): Ceres CLONE ID no. 95135
  misc_feature (36)..(180): Pfam Name: PMSR Pfam Description: Peptide methionine sulfoxide reductase
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
MNILNKLGIGSSRQTNMDPSPIAQVIDDEAPAPGNQFAQFGAGCFWSVELAYQRVPGVTQTEVGYSQGITHDPSYKDVCSGTTNHAEIVRVQYDPKECSYQSLLDLFWSKHDPTTLNRQGNDVGTQYRSGIYFYNPEQEKLARESLERHQQQVDRKVVTEILPAKKFYRAEEHHQQYLSK

SEQ ID NO: 2077 - DNA, 795 bp, Populus balsamifera subsp. trichocarpa; identical to SEQ ID NO: 1186
  misc_feature (1)..(795): Ceres ANNOT ID no. 1527449
  misc_feature 232380:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage

SEQ ID NO: 2078 - protein, 203 aa, Populus balsamifera subsp. trichocarpa; identical to SEQ ID NO: 1187
  misc_feature (1)..(203): Ceres ANNOT ID no. 1527449
  misc_feature (37)..(190): Pfam Name: PMSR Pfam Description: Peptide methionine sulfoxide reductase
  misc_feature: SWISSPROT Homolog: MSRA_LACSA Peptide methionine sulfoxide reductase (EC 1.8.4.6) (Protein-methionine-S-oxide reductase) (Peptide Met(O) reductase) with e-value of 1.7e-71 and BLAST sequence identity of 72.0
  misc_feature: SWISSPROT Homolog: MSRA_ARATH Peptide methionine sulfoxide reductase (EC 1.8.4.6) (Protein-methionine-S-oxide reductase) (Peptide Met(O) reductase) with e-value of 3.2e-70 and BLAST sequence identity of 69.6
  misc_feature: SWISSPROT Homolog: MSRA_BRANA Peptide methionine sulfoxide reductase (EC 1.8.4.6) (Protein-methionine-S-oxide reductase) (Peptide Met(O) reductase) with e-value of 3.8e-67 and BLAST sequence identity of 69.8
  misc_feature: SWISSPROT Homolog: MSRA_LYCES Peptide methionine sulfoxide reductase with e-value of 4.3e-59 and BLAST sequence identity of 64.4
  misc_feature: SWISSPROT Homolog: MSRA_LYCES EC 1.8.4.6 Protein-methionine-S-oxide reductase Peptide Met(O) reductase Fruit-ripening protein E4 (Fragment)
  misc_feature: SWISSPROT Homolog: MSRA_FRAAN Peptide methionine sulfoxide reductase with e-value of 1.5e-56 and BLAST sequence identity of 66.2
  misc_feature: SWISSPROT Homolog: MSRA_FRAAN EC 1.8.4.6 (Protein-methionine-S-oxide reductase) Peptide Met(O) reductase Fruit-ripening protein E4
  misc_feature 232537:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(203): Functional Homolog of  Ceres CLONE ID no. 95135 at SEQ ID NO. 2120 with e-value of 1.10E-73 and BLAST sequence identity of 75.4

SEQ ID NO: 2079 - DNA, 789 bp, Populus balsamifera subsp. trichocarpa
  misc_feature (1)..(789): Ceres ANNOT ID no. 1537653
  misc_feature 232651:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atgctccaaactctatccacccatctctcctccacctccacctccacctccaccaccacacctctcctcctcctctcaaaacccttcctgtctccctctgcaaaatcccagctttctcactctaaacccttcaacttccctcgaaccttaaaacccatctcttattacaagccccccatgaacatccttagcaaactaggctttggtactaggtcacctgacccatccacaatggacccaacaatcccacaaggtcctgacgatgacttaccagctcctggtcagcaatttgctcagtttggagctggttgtttttggggtgttgaattggcatttcaaagagtcccgggcgttaccaaaactgaagtgggttatactcaaggcttatcacataatccaagttatgaagatgtttgtactggtactaccaagcatagcgaagttgttagggttcagtatgaccctaaagagggtagctttgagactttgcttgatgctttttgggctagacatgatcctactaccttgaatcgccaggggaatgatgtgggaacacagtacaggtctggaatatactattacacccctgagcaggagaaggcagcaaaggaatccatggaacagcagcagaagctctcaaacaggaaaatagtcacggagattttacctgccaaaaaattctaccgagcagaagaataccaccaacagtatcttgccaaaggaggccgttttggatttaaacaatcttctgagaaaggctgcaatgatccaatcagatgctatggctaa

SEQ ID NO: 2080 - protein, 262 aa, Populus balsamifera subsp. trichocarpa
  misc_feature (1)..(262): Ceres ANNOT ID no. 1537653
  misc_feature (96)..(249): Pfam Name: PMSR Pfam Description: Peptide methionine sulfoxide reductase
  misc_feature: SWISSPROT Homolog: MSRA_LACSA Peptide methionine sulfoxide reductase (EC 1.8.4.6) (Protein-methionine-S-oxide reductase) (Peptide Met(O) reductase) with e-value of 1.7e-71 and BLAST sequence identity of 72.0
  misc_feature: SWISSPROT Homolog: MSRA_ARATH Peptide methionine sulfoxide reductase (EC 1.8.4.6) (Protein-methionine-S-oxide reductase) (Peptide Met(O) reductase) with e-value of 3.2e-70 and BLAST sequence identity of 69.6
  misc_feature: SWISSPROT Homolog: MSRA_BRANA Peptide methionine sulfoxide reductase (EC 1.8.4.6) (Protein-methionine-S-oxide reductase) (Peptide Met(O) reductase) with e-value of 3.8e-67 and BLAST sequence identity of 69.8
  misc_feature: SWISSPROT Homolog: MSRA_LYCES Peptide methionine sulfoxide reductase with e-value of 4.3e-59 and BLAST sequence identity of 64.4
  misc_feature: SWISSPROT Homolog: MSRA_LYCES EC 1.8.4.6 Protein-methionine-S-oxide reductase Peptide Met(O) reductase Fruit-ripening protein E4 (Fragment)
  misc_feature: SWISSPROT Homolog: MSRA_FRAAN Peptide methionine sulfoxide reductase with e-value of 1.5e-56 and BLAST sequence identity of 66.2
  misc_feature: SWISSPROT Homolog: MSRA_FRAAN EC 1.8.4.6 (Protein-methionine-S-oxide reductase) Peptide Met(O) reductase Fruit-ripening protein E4
  misc_feature 232808:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(262): Functional Homolog of  Ceres CLONE ID no. 95135 at SEQ ID NO. 2120 with e-value of 5.60E-72 and BLAST sequence identity of 73.7
MLQTLSTHLSSTSTSTSTTTPLLLLSKPFLSPSAKSQLSHSKPFNFPRTLKPISYYKPPMNILSKLGFGTRSPDPSTMDPTIPQGPDDDLPAPGQQFAQFGAGCFWGVELAFQRVPGVTKTEVGYTQGLSHNPSYEDVCTGTTKHSEVVRVQYDPKEGSFETLLDAFWARHDPTTLNRQGNDVGTQYRSGIYYYTPEQEKAAKESMEQQQKLSNRKIVTEILPAKKFYRAEEYHQQYLAKGGRFGFKQSSEKGCNDPIRCYG

SEQ ID NO: 2081 - DNA, 573 bp, Populus balsamifera subsp. trichocarpa
  misc_feature (1)..(573): Ceres ANNOT ID no. 1473733
  misc_feature 232934:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggcaaccagcaccaccaatcctgctctggatccggatctagaccagccagacaacccgaatcacgagttcgctcaattcggagctggatgtttctggggggttgagcttgcctttcagagactgcctggtgtggtcaaaactgaagtgggctactctcagggtcacgtccctgacccaacttacaagctggtatgcaccaacaccaccaaccacgttgaagttgttcgtgtccaatttgacccggaagtttgcccatataccaacctcctctctcttttctggtctcgacatgatcctaccaccctcaatcgccagggtggtgatgttggtacacagtatagatcagggatttactactacaatgaggcccaagctaagttagcccaggaatcaaaggaagctaagcagttggaattgaaggatagcaaggttgtgacagaaattctgccagcaaagagatttttcagagctgaagagtaccatcagcagtatctggagaaaggtggaggtcaaggtgttaaacagtctgctgaaaaaggttgcaatgaccctattagatgctatggttaa

SEQ ID NO: 2082 - protein, 190 aa, Populus balsamifera subsp. trichocarpa
  misc_feature (1)..(190): Ceres ANNOT ID no. 1473733
  misc_feature (23)..(168): Pfam Name: PMSR Pfam Description: Peptide methionine sulfoxide reductase
  misc_feature: SWISSPROT Homolog: MSRA_LACSA Peptide methionine sulfoxide reductase (EC 1.8.4.6) (Protein-methionine-S-oxide reductase) (Peptide Met(O) reductase) with e-value of 1.7e-71 and BLAST sequence identity of 72.0
  misc_feature: SWISSPROT Homolog: MSRA_ARATH Peptide methionine sulfoxide reductase (EC 1.8.4.6) (Protein-methionine-S-oxide reductase) (Peptide Met(O) reductase) with e-value of 3.2e-70 and BLAST sequence identity of 69.6
  misc_feature: SWISSPROT Homolog: MSRA_BRANA Peptide methionine sulfoxide reductase (EC 1.8.4.6) (Protein-methionine-S-oxide reductase) (Peptide Met(O) reductase) with e-value of 3.8e-67 and BLAST sequence identity of 69.8
  misc_feature: SWISSPROT Homolog: MSRA_LYCES Peptide methionine sulfoxide reductase with e-value of 4.3e-59 and BLAST sequence identity of 64.4
  misc_feature: SWISSPROT Homolog: MSRA_LYCES EC 1.8.4.6 Protein-methionine-S-oxide reductase Peptide Met(O) reductase Fruit-ripening protein E4 (Fragment)
  misc_feature: SWISSPROT Homolog: MSRA_FRAAN Peptide methionine sulfoxide reductase with e-value of 1.5e-56 and BLAST sequence identity of 66.2
  misc_feature: SWISSPROT Homolog: MSRA_FRAAN EC 1.8.4.6 (Protein-methionine-S-oxide reductase) Peptide Met(O) reductase Fruit-ripening protein E4
  misc_feature 233083:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(190): Functional Homolog of  Ceres CLONE ID no. 95135 at SEQ ID NO. 2120 with e-value of 2.29E-57 and BLAST sequence identity of 69.9
MATSTTNPALDPDLDQPDNPNHEFAQFGAGCFWGVELAFQRLPGVVKTEVGYSQGHVPDPTYKLVCTNTTNHVEVVRVQFDPEVCPYTNLLSLFWSRHDPTTLNRQGGDVGTQYRSGIYYYNEAQAKLAQESKEAKQLELKDSKVVTEILPAKRFFRAEEYHQQYLEKGGGQGVKQSAEKGCNDPIRCYG

SEQ ID NO: 2083 - DNA, 573 bp, Populus balsamifera subsp. trichocarpa
  misc_feature (1)..(573): Ceres ANNOT ID no. 1468537
  misc_feature 233194:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggcaacccacaccaccaatcctgctctggatccggatctagacaaaccagacaaccccaatcacgagtttgctcaattcggagctggatgtttctggggtgtcgagcttgcctttcagagattacatggtgtggtcaaaactgaagtaggctactctcagggtaacgtccctgatccgacttacaaacttgtatgcaccaaaaccaccaaccacgttgaggttgtccgggtccaatttgaccctgaagtttgcccatataccaacctcctctctcttttctggtctcgccatgatcccaccaccctcaatcgtcagggtggcgatgtgggtacacagtatagatcagggatatactactacaacgaggctcaagctaagttagcccaggaatcgaaggaagctaaacagttgggattgaaggataacacggttgtgacggaaatcctgccagcaaagagattttatagagctgaggagtaccatcagaagtatctggaaaaaggtgggggtcgaagcgctaaacagtctgctgaaaaaggttgcaatgaccctattagatgctatggttaa

SEQ ID NO: 2084 - protein, 190 aa, Populus balsamifera subsp. trichocarpa
  misc_feature (1)..(190): Ceres ANNOT ID no. 1468537
  misc_feature (23)..(179): Pfam Name: PMSR Pfam Description: Peptide methionine sulfoxide reductase
  misc_feature: SWISSPROT Homolog: MSRA_LACSA Peptide methionine sulfoxide reductase (EC 1.8.4.6) (Protein-methionine-S-oxide reductase) (Peptide Met(O) reductase) with e-value of 1.7e-71 and BLAST sequence identity of 72.0
  misc_feature: SWISSPROT Homolog: MSRA_ARATH Peptide methionine sulfoxide reductase (EC 1.8.4.6) (Protein-methionine-S-oxide reductase) (Peptide Met(O) reductase) with e-value of 3.2e-70 and BLAST sequence identity of 69.6
  misc_feature: SWISSPROT Homolog: MSRA_BRANA Peptide methionine sulfoxide reductase (EC 1.8.4.6) (Protein-methionine-S-oxide reductase) (Peptide Met(O) reductase) with e-value of 3.8e-67 and BLAST sequence identity of 69.8
  misc_feature: SWISSPROT Homolog: MSRA_LYCES Peptide methionine sulfoxide reductase with e-value of 4.3e-59 and BLAST sequence identity of 64.4
  misc_feature: SWISSPROT Homolog: MSRA_LYCES EC 1.8.4.6 Protein-methionine-S-oxide reductase Peptide Met(O) reductase Fruit-ripening protein E4 (Fragment)
  misc_feature: SWISSPROT Homolog: MSRA_FRAAN Peptide methionine sulfoxide reductase with e-value of 1.5e-56 and BLAST sequence identity of 66.2
  misc_feature: SWISSPROT Homolog: MSRA_FRAAN EC 1.8.4.6 (Protein-methionine-S-oxide reductase) Peptide Met(O) reductase Fruit-ripening protein E4
  misc_feature 233343:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(190): Functional Homolog of  Ceres CLONE ID no. 95135 at SEQ ID NO. 2120 with e-value of 3.89E-55 and BLAST sequence identity of 68.6
MATHTTNPALDPDLDKPDNPNHEFAQFGAGCFWGVELAFQRLHGVVKTEVGYSQGNVPDPTYKLVCTKTTNHVEVVRVQFDPEVCPYTNLLSLFWSRHDPTTLNRQGGDVGTQYRSGIYYYNEAQAKLAQESKEAKQLGLKDNTVVTEILPAKRFYRAEEYHQKYLEKGGGRSAKQSAEKGCNDPIRCYG

SEQ ID NO: 2085 - protein, 169 aa, Arabidopsis thaliana
  misc_feature (1)..(169): Ceres CLONE ID no. 95453
  misc_feature (1)..(169): Also Known As Ceres CDNA ID no. 23380898
  misc_feature (1)..(169): Also Known As Ceres GEMINI ID 533E1
  misc_feature (48)..(164): Pfam Name: GRP Pfam Description: Glycine rich protein family
  misc_feature 233474:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Weak Useful for making stronger plants
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers
  misc_feature (118)..(118): Xaa is any aa, unknown, or other
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGGGYSGGGGSYGGGGGXREGGGGYSGGGGYSSRGGGGGSYGGGRREGGGGYGGGEGGGYGGSGGGGGW

SEQ ID NO: 2086 - DNA, 513 bp, Populus balsamifera subsp. trichocarpa; identical to SEQ ID NO: 1234
  misc_feature (1)..(513): Ceres ANNOT ID no. 1460836
  misc_feature 233580:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Weak Useful for making stronger plants
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers

SEQ ID NO: 2087 - protein, 170 aa, Populus balsamifera subsp. trichocarpa; identical to SEQ ID NO: 1235
  misc_feature (1)..(170): Ceres ANNOT ID no. 1460836
  misc_feature (9)..(80): Pfam Name: RRM_1 Pfam Description: RNA recognition motif. (a.k.a. RRM RBD, or RNP domain)
  misc_feature: SWISSPROT Homolog: GRP7_ARATH Glycine-rich RNA-binding protein 7 with e-value of 3.8e-90 and BLAST sequence identity of 95.5
  misc_feature: SWISSPROT Homolog: GRP2_SINAL Glycine-rich RNA-binding protein GRP2A with e-value of 4.1e-77 and BLAST sequence identity of 84.3
  misc_feature: SWISSPROT Homolog: GRP1_SINAL Glycine-rich RNA-binding protein GRP1A with e-value of 1.1e-74 and BLAST sequence identity of 84.6
  misc_feature: SWISSPROT Homolog: GRP10_BRANA Glycine-rich RNA-binding protein 10 with e-value of 3.1e-65 and BLAST sequence identity of 75.6
  misc_feature: SWISSPROT Homolog: GRP8_ARATH Glycine-rich RNA-binding protein 8 (CCR1 protein) with e-value of 2.7e-64 and BLAST sequence identity of 74.9
  misc_feature 233709:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Weak Useful for making stronger plants
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers
  misc_feature (1)..(170): Functional Homolog of  Ceres CLONE ID no. 95453 at SEQ ID NO. 2129 with e-value of 1.99E-60 and BLAST sequence identity of 79.6

SEQ ID NO: 2088 - DNA, 498 bp, Populus balsamifera subsp. trichocarpa; identical to SEQ ID NO: 1232
  misc_feature (1)..(498): Ceres ANNOT ID no. 1450324
  misc_feature 233818:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Weak Useful for making stronger plants
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers

SEQ ID NO: 2089 - protein, 165 aa, Populus balsamifera subsp. trichocarpa; identical to SEQ ID NO: 1233
  misc_feature (1)..(165): Ceres ANNOT ID no. 1450324
  misc_feature (9)..(80): Pfam Name: RRM_1 Pfam Description: RNA recognition motif. (a.k.a. RRM RBD, or RNP domain)
  misc_feature: SWISSPROT Homolog: GRP7_ARATH Glycine-rich RNA-binding protein 7 with e-value of 3.8e-90 and BLAST sequence identity of 95.5
  misc_feature: SWISSPROT Homolog: GRP2_SINAL Glycine-rich RNA-binding protein GRP2A with e-value of 4.1e-77 and BLAST sequence identity of 84.3
  misc_feature: SWISSPROT Homolog: GRP1_SINAL Glycine-rich RNA-binding protein GRP1A with e-value of 1.1e-74 and BLAST sequence identity of 84.6
  misc_feature: SWISSPROT Homolog: GRP10_BRANA Glycine-rich RNA-binding protein 10 with e-value of 3.1e-65 and BLAST sequence identity of 75.6
  misc_feature: SWISSPROT Homolog: GRP8_ARATH Glycine-rich RNA-binding protein 8 (CCR1 protein) with e-value of 2.7e-64 and BLAST sequence identity of 74.9
  misc_feature 233947:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Weak Useful for making stronger plants
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers
  misc_feature (1)..(165): Functional Homolog of  Ceres CLONE ID no. 95453 at SEQ ID NO. 2129 with e-value of 1.10E-59 and BLAST sequence identity of 77.7

SEQ ID NO: 2090 - protein, 423 aa, Arabidopsis thaliana
  misc_feature (1)..(423): Ceres CLONE ID no. 95677
  misc_feature (1)..(405): Pfam Name: p450 Pfam Description: Cytochrome P450
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Lanceolate Shaped Useful for making plants with increased biomass and foliage
  misc_feature: Phenotype: ROSETTE LEAVES - Serrate Margins Useful for making plants with increased biomass and foliage
MLLKLGKVPTVILSSSETAKQALRDYDLYCCSRPSLAGGRELSYNNLDMSSSPYNEYWKELRKLCSQELFSANKIQSIQPIKDEEVKKVIDSIAESSSLKNPVNLSKTFLALTTSVVCKAAFGVSFEGTVLNSDRFNKLVRDTFEMLGSFSASDFIPYVGWIIDKFNGLQGWRKKSFRDLDAFYEQIFDLHKEEKEVGSEDLVDVLLRLEKEEIVVGNGKLTRNHIKAILMNILLGGIDTSAITMTWAMAELAKNPRVMKKVQAEIRSQIKNKERISFDDTDKLEYLKMVIKETWRLHPPTPLLLPRVVITEFEINGYTIPAKTRLHVNVWAIGRDPDTWKDPEMFLPERFNDSNIDAKGQNFELLSFGSGRRICPGLYMGTTMVEFGLANMLYHFDWKLPEGMVVRRYRYGRSSWTYCEQKK

SEQ ID NO: 2091 - DNA, 1449 bp, Populus balsamifera subsp. trichocarpa
  misc_feature (1)..(1449): Ceres ANNOT ID no. 1459723
  misc_feature 234207:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Lanceolate Shaped Useful for making plants with increased biomass and foliage
  misc_feature: Phenotype: ROSETTE LEAVES - Serrate Margins Useful for making plants with increased biomass and foliage
atggaagttaagagacaaagcgagcagcttcttcctccaagccctcctaagcttccaattttaggcaacttgcaccaacttggatcactgcctcaccaatctctgtggcaactctccaagaaatatggccctgtcatgctaattcgacttggtcgaataccaactgtcgtaatctcctctgctgaggcagcaagagaggtcttaaaagttcatgatcttgccttttgcagtagacctcttttagctgggactgggagactcacgtacaattatctagacatagcattttcaccatatagtgatcactggagaaacatgagaaaagttcttactctggagctattcagcttgaaaagggtgcagtctttccggttcatcagggaagaagaagttagcttgctggtcaattttatctctgagtcatcagctttagcagcacctgttgatcttactcagaaattatatgctctcgttgcgaatataacattcaggatggcttatggattcaattatcgagggactagctttgatcgagataaatttcatgaagtggttcatgacaccgaggctgtagcgggaagcatctcagcagatgaatccatcccgtatttagggtggattgtggatcggcttactggtcatcgtgcaaggactgagagagttttccatgaattagatactttctttcagcatttaattgataatcatcttaaacctggaaggataaaggagcacgatgacatggtagatgttctgctgagaatagagaaggatcagactgaacttggtgcatctcagttcacaaaggataatatcaaggcaatcctcctgaatttatttctgggaggagtagacactatttcactgacagtgaattgggcaatggcagaacttgttaggaatccaagagtgatgaagaaagtgcaggatgaagttaggaaatgtgttggaaataagggaagagttactgaaagcgacatcgatcaacttgagtatctccggatggtaataaaagaaactctgagactgcaccctcctgccccgctacttatcacaagagaaaccatgtctcactgtaaagtcagtggtcataatatctatccgaagatgctggtccaaattaatgtctgggcaattggacgtgaccccacgtactggaaggatcctgaagagtttttccctgaaagattccttgatagctccattgactataaaggacaaagttttgagtacttgccatttggatctggtcgaagaatttgtcctgggatgcatatgggatttataacaatggagattatacttgcaaatctcttgtattgttttgattgggtttttcccgatgggatgaagaaggaagatatcaacatggaagagaaagctggtgttagtcttactacctctaagaagacacctctcattcttgtaccagtcaactaccttcagtga

SEQ ID NO: 2092 - protein, 482 aa, Populus balsamifera subsp. trichocarpa
  misc_feature (1)..(482): Ceres ANNOT ID no. 1459723
  misc_feature (12)..(475): Pfam Name: p450 Pfam Description: Cytochrome P450
  misc_feature: SWISSPROT Homolog: C71BQ_ARATH Cytochrome P450 71B26 (EC 1.14.-.-) with e-value of 3.9e-216 and BLAST sequence identity of 98.8
  misc_feature: SWISSPROT Homolog: C71BV_ARATH Cytochrome P450 71B34 (EC 1.14.-.-) with e-value of 8.9e-178 and BLAST sequence identity of 79.6
  misc_feature: SWISSPROT Homolog: C71BW_ARATH Cytochrome P450 71B35 (EC 1.14.-.-) with e-value of 9.7e-172 and BLAST sequence identity of 76.2
  misc_feature: SWISSPROT Homolog: C71BY_ARATH Cytochrome P450 71B37 (EC 1.14.-.-) with e-value of 2.3e-163 and BLAST sequence identity of 72.9
  misc_feature: SWISSPROT Homolog: C71BX_ARATH Cytochrome P450 71B36 (EC 1.14.-.-) with e-value of 2.1e-160 and BLAST sequence identity of 71.1
  misc_feature 234370:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Lanceolate Shaped Useful for making plants with increased biomass and foliage
  misc_feature: Phenotype: ROSETTE LEAVES - Serrate Margins Useful for making plants with increased biomass and foliage
  misc_feature (1)..(482): Functional Homolog of  Ceres CLONE ID no. 95677 at SEQ ID NO. 2134 with e-value of 1.00E-111 and BLAST sequence identity of 49.2
MEVKRQSEQLLPPSPPKLPILGNLHQLGSLPHQSLWQLSKKYGPVMLIRLGRIPTVVISSAEAAREVLKVHDLAFCSRPLLAGTGRLTYNYLDIAFSPYSDHWRNMRKVLTLELFSLKRVQSFRFIREEEVSLLVNFISESSALAAPVDLTQKLYALVANITFRMAYGFNYRGTSFDRDKFHEVVHDTEAVAGSISADESIPYLGWIVDRLTGHRARTERVFHELDTFFQHLIDNHLKPGRIKEHDDMVDVLLRIEKDQTELGASQFTKDNIKAILLNLFLGGVDTISLTVNWAMAELVRNPRVMKKVQDEVRKCVGNKGRVTESDIDQLEYLRMVIKETLRLHPPAPLLITRETMSHCKVSGHNIYPKMLVQINVWAIGRDPTYWKDPEEFFPERFLDSSIDYKGQSFEYLPFGSGRRICPGMHMGFITMEIILANLLYCFDWVFPDGMKKEDINMEEKAGVSLTTSKKTPLILVPVNYLQ

SEQ ID NO: 2093 - DNA, 1407 bp, Populus balsamifera subsp. trichocarpa
  misc_feature (1)..(1407): Ceres ANNOT ID no. 1516455
  misc_feature 234538:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Lanceolate Shaped Useful for making plants with increased biomass and foliage
  misc_feature: Phenotype: ROSETTE LEAVES - Serrate Margins Useful for making plants with increased biomass and foliage
atggctctctatgctgtgcctttgtggcttcctcttattttacttctgcctctactgcttttgtttatgaaaaggatgaaagatgcgggacaaagcaatttgcaccagcttagttcactgcctcaccaatctatgtggcatctctccaagaaatatggccctgtcatgctccttcgacttggtcaaataccaactgttgtaatctcctccgctgaggcagcaagggaggtgttaaaagttcatgatcttgccttttgcagtagacctttgttatctggcgctggcagactcacgtacaattatctagacattgcattttcaccatatagcgatcactggagaaacatgagaaaaattgttactttggagctcttcagcttgaaaagggtgcaatctttccgattcattagggaagaggaagttggctttctggtcaattctctctccgagtcatcagctctagcagcaccagttgatcttactcagaaggtatatgctctggttgcgaatataacattcagggtggcttatgggttcgattatcgagggactacctttgatcgagatagattccatgaagtggttcatgacaccgaggctgtggtgggaaactggcttactggtcaccgtgcaaggatggaaagagttttccacgagttagatactttcttccagcatgtaattgataatcatcttaaacctggaaggataaaggatcacgatgacatgatagatgttctgctgagaatagagaaggaacaaactgagctgggtgcatctcagtttacgagtgataatattaaggcagtcctcctgaatttatttttgggcggagtagacactagttcacttacggtgaattgggcaatggcagaacttgtcaggaatccaagagtgatgaagaaagtgcaggatgaagtgaggaaatgtgttggaaagaaaggaagagttactgaaggggatgtcgatcaacttgagtatctcaggatggtaataaaagaaactctgagactgcaccctcctgcccctctacttctcccaagagaaaccatgtctcactgtatagtcagtggctacaatatctatccgaagacgctggtccatgttaatgtctgggcaattggacgtgaccccaagtactggagggatcctgaagactcctgcgacttcaatggacaaagttttgagtatttgccatttggatctggtcgaagaatttgtcctggaattcatatgggatctataacagtagagattatactttcaaatctcttgcattgttttgattggattttgccccatgggatgcagaaggaagatatcaacatggaagagaaagctggtgttagccttgctccctctaagaagacacctgtaatcctcgtacctgtcaactaccttcagtga

SEQ ID NO: 2094 - protein, 443 aa, Populus balsamifera subsp. trichocarpa
  misc_feature (1)..(443): Ceres ANNOT ID no. 1516455
  misc_feature (363)..(436): Pfam Name: p450 Pfam Description: Cytochrome P450
  misc_feature: SWISSPROT Homolog: C71BQ_ARATH Cytochrome P450 71B26 (EC 1.14.-.-) with e-value of 3.9e-216 and BLAST sequence identity of 98.8
  misc_feature: SWISSPROT Homolog: C71BV_ARATH Cytochrome P450 71B34 (EC 1.14.-.-) with e-value of 8.9e-178 and BLAST sequence identity of 79.6
  misc_feature: SWISSPROT Homolog: C71BW_ARATH Cytochrome P450 71B35 (EC 1.14.-.-) with e-value of 9.7e-172 and BLAST sequence identity of 76.2
  misc_feature: SWISSPROT Homolog: C71BY_ARATH Cytochrome P450 71B37 (EC 1.14.-.-) with e-value of 2.3e-163 and BLAST sequence identity of 72.9
  misc_feature: SWISSPROT Homolog: C71BX_ARATH Cytochrome P450 71B36 (EC 1.14.-.-) with e-value of 2.1e-160 and BLAST sequence identity of 71.1
  misc_feature 234699:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Lanceolate Shaped Useful for making plants with increased biomass and foliage
  misc_feature: Phenotype: ROSETTE LEAVES - Serrate Margins Useful for making plants with increased biomass and foliage
  misc_feature (1)..(443): Functional Homolog of  Ceres CLONE ID no. 95677 at SEQ ID NO. 2134 with e-value of 7.79E-98 and BLAST sequence identity of 49.4
MKDAGQSNLHQLSSLPHQSMWHLSKKYGPVMLLRLGQIPTVVISSAEAAREVLKVHDLAFCSRPLLSGAGRLTYNYLDIAFSPYSDHWRNMRKIVTLELFSLKRVQSFRFIREEEVGFLVNSLSESSALAAPVDLTQKVYALVANITFRVAYGFDYRGTTFDRDRFHEVVHDTEAVVGNWLTGHRARMERVFHELDTFFQHVIDNHLKPGRIKDHDDMIDVLLRIEKEQTELGASQFTSDNIKAVLLNLFLGGVDTSSLTVNWAMAELVRNPRVMKKVQDEVRKCVGKKGRVTEGDVDQLEYLRMVIKETLRLHPPAPLLLPRETMSHCIVSGYNIYPKTLVHVNVWAIGRDPKYWRDPEDSCDFNGQSFEYLPFGSGRRICPGIHMGSITVEIILSNLLHCFDWILPHGMQKEDINMEEKAGVSLAPSKKTPVILVPVNYLQ

SEQ ID NO: 2095 - protein, 446 aa, Arabidopsis thaliana
  misc_feature (1)..(446): Ceres CLONE ID no. 96020
  misc_feature (103)..(353): Pfam Name: Orn_Arg_deC_N Pfam Description: Pyridoxal-dependent decarboxylase pyridoxal binding domain
  misc_feature (361)..(440): Pfam Name: Orn_DAP_Arg_deC Pfam Description: Pyridoxal-dependent decarboxylase C-terminal sheet domain
  misc_feature: Phenotype: ROSETTE LEAVES - Corkscrew Useful for making plants with altered leaf shape eg curled leaves
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: WHOLE PLANT - Other Useful for making bigger plants
  misc_feature: Phenotype: INFLORESCENCE - Other Useful for making ornamental plants with modified flowers
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
MAAVTQFLSQPSSIRGTLNQYQLNQTSLSRIPFLSLKSTLKPLKRLSVKAAVSQNSTKTLTKESASSFDHCFKKSSDGFLYCEGTKVQDIMETVEKRPFYLYSKPQITRNLEAYKEALEGVRSVIGYAIKANNNLKILEYLRSLGCGAVLVSGNELRLALLAGFDPTKCIFNGNGKSLEDLVLAAQEGVFVNVDSEFDLNNIVEASRISGKQVNVLLRINPDVDPQVHPYVATGNKNSKFGIRNEKLQWFLDEVKAHPKELKLVGAHCHLGSTITKVDIFRDAAVLMIEYIDEIRRQGFEVSYLNIGGGLGIDYYHAGAVLPTPMDLINTVRELVLSRDLNLIIEPGRSLIANTCCFVNYVTGVKTNGTKNFIVIDGSMAELIRPSLYDAYQHIELVSPTPPEAEVTKFDVVGPVCESADFLGKDRELPTPPQGAGLWFMTLVHTV

SEQ ID NO: 2096 - DNA, 1464 bp, Populus balsamifera subsp. trichocarpa
  misc_feature (1)..(1464): Ceres ANNOT ID no. 1450365
  misc_feature 235048:<222: Transcription Factor
  misc_feature: Phenotype: ROSETTE LEAVES - Corkscrew Useful for making plants with altered leaf shape eg curled leaves
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: WHOLE PLANT - Other Useful for making bigger plants
  misc_feature: Phenotype: INFLORESCENCE - Other Useful for making ornamental plants with modified flowers
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atggcgactgctacagatctctctcagtcacgcttcatttccaaaaccctaactcactccctaaatcaaaacctattttccaaaaaatcaattttgccctttaaactaacaaaaaaaaactatctcaaacccctttctctcaaggcagttatttcccaacaaaaccccgctacaaccacagcacaggaaaccacacagtttaagcattgtttcaccaaatccaaagatgggtttctctgctgtgagaaccttaaggttcaggagattatggagaatgttgagaagagaccgttttatttgtatagtaagccacagattactagaaatgttgaggcttataaggatgccttacaaggactgaattctattattggttatgctattaaggctaataataatttgaagattttggagcatttgagagggttgggttgtggtgctgttttggtaagtggtaacgagcttaggttggctcttcgggccggtttcgatcccacaaggtgtatttttaatggaaatgggaagctgctggacgatttggttctggctgctcaagaaggtgtttttgttaacgtggatagtgaatttgatttggaaaatattgtggcagctgctagaattgctggcaagaaggttaatgttctactccggatcaacccagatgttgaccctcaggttcatccttatgttgctacagggaacaagaactctaaatttggtattagaaatgagaagctgcaatggtttctggatgctgtaaaggcacaccgtgatgagctgaagctcgtgggggcccattgccatctaggatcaaccatcaccaaggtggacatattcagggatgctgcagttctcatggttaactacattgatgaaatcagagctcagggctttgaagttgattacttaaacattggaggtggtttgggtatagattattatcattctggtgcagtccttcctactccaagagatctcattgacactgttcgtgaactggttctctcacgagatctcaatctcatcattgaacctgggagatcgctcattgcaaatacttgctgcttggtgaatagggtcactggggttaaaactaatggaacaaaaaattttgttgtgatagatggcagcatggctgaacttatccgtcctagtctttatgatgcttatcaacacatagagcttgtttctcctgcatcacccaaggctgaagtttcaacttttgatgtggttggtcctgtctgtgagtccgcagatttcctgggaaaggatagagaacttccaactccagctaagggagctggtttggttgttcatgatgcaggtgcttactgcatgagcatggcatcgacatacaatctcaagatgcgccctcctgagtactgggttgaagatggaacagtgtccaaaattcggcatggggagacattcgaagaccatattcggttctttgagggtctttga

SEQ ID NO: 2097 - protein, 487 aa, Populus balsamifera subsp. trichocarpa
  misc_feature (1)..(487): Ceres ANNOT ID no. 1450365
  misc_feature (102)..(352): Pfam Name: Orn_Arg_deC_N Pfam Description: Pyridoxal-dependent decarboxylase pyridoxal binding domain
  misc_feature (355)..(464): Pfam Name: Orn_DAP_Arg_deC Pfam Description: Pyridoxal-dependent decarboxylase C-terminal sheet domain
  misc_feature: SWISSPROT Homolog: DCDA_AQUAE Diaminopimelate decarboxylase (EC 4.1.1.20) (DAP decarboxylase) with e-value of 3.5e-64 and BLAST sequence identity of 38.2
  misc_feature: SWISSPROT Homolog: DCDA_ARCFU Diaminopimelate decarboxylase (EC 4.1.1.20) (DAP decarboxylase) with e-value of 1.2e-63 and BLAST sequence identity of 40.4
  misc_feature: SWISSPROT Homolog: DCDA_PSEAE Diaminopimelate decarboxylase (EC 4.1.1.20) (DAP decarboxylase) with e-value of 5.9e-62 and BLAST sequence identity of 38.0
  misc_feature: SWISSPROT Homolog: DCDA_NEIMB Diaminopimelate decarboxylase (EC 4.1.1.20) (DAP decarboxylase) with e-value of 1.6e-59 and BLAST sequence identity of 38.7
  misc_feature: SWISSPROT Homolog: DCDA_NEIMA Diaminopimelate decarboxylase (EC 4.1.1.20) (DAP decarboxylase) with e-value of 2.6e-59 and BLAST sequence identity of 38.5
  misc_feature 235247:<222: Transcription Factor
  misc_feature: Phenotype: ROSETTE LEAVES - Corkscrew Useful for making plants with altered leaf shape eg curled leaves
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: WHOLE PLANT - Other Useful for making bigger plants
  misc_feature: Phenotype: INFLORESCENCE - Other Useful for making ornamental plants with modified flowers
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(487): Functional Homolog of  Ceres CLONE ID no. 96020 at SEQ ID NO. 2139 with e-value of 3.40E-184 and BLAST sequence identity of 80.9
MATATDLSQSRFISKTLTHSLNQNLFSKKSILPFKLTKKNYLKPLSLKAVISQQNPATTTAQETTQFKHCFTKSKDGFLCCENLKVQEIMENVEKRPFYLYSKPQITRNVEAYKDALQGLNSIIGYAIKANNNLKILEHLRGLGCGAVLVSGNELRLALRAGFDPTRCIFNGNGKLLDDLVLAAQEGVFVNVDSEFDLENIVAAARIAGKKVNVLLRINPDVDPQVHPYVATGNKNSKFGIRNEKLQWFLDAVKAHRDELKLVGAHCHLGSTITKVDIFRDAAVLMVNYIDEIRAQGFEVDYLNIGGGLGIDYYHSGAVLPTPRDLIDTVRELVLSRDLNLIIEPGRSLIANTCCLVNRVTGVKTNGTKNFVVIDGSMAELIRPSLYDAYQHIELVSPASPKAEVSTFDVVGPVCESADFLGKDRELPTPAKGAGLVVHDAGAYCMSMASTYNLKMRPPEYWVEDGTVSKIRHGETFEDHIRFFEGL

SEQ ID NO: 2098 - DNA, 1509 bp, Populus balsamifera subsp. trichocarpa
  misc_feature (1)..(1509): Ceres ANNOT ID no. 1460794
  misc_feature 235443:<222: Transcription Factor
  misc_feature: Phenotype: ROSETTE LEAVES - Corkscrew Useful for making plants with altered leaf shape eg curled leaves
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: WHOLE PLANT - Other Useful for making bigger plants
  misc_feature: Phenotype: INFLORESCENCE - Other Useful for making ornamental plants with modified flowers
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atggcggctgctactaatttctctcactcgcccttcatttctaaaaccctaactcactctctaaaccataacccacttcccaaaaacccaactttgcctttcaaactctcaaaaagctactctctcaaggcagttatatcccagcaaaaccctgctacagccacaacacagaaaacgcagtttaagcattgttttacaaaatcccaagatggatttctctactgtgagagccttaaggttcaggagattatggagagtgttgagaagagaccattttatttgtacagtaagccacagattactagaaatgttgaggcttataaggatgctttacaaggattgagttctatcattgggtatgctattaaggctaataataacttgaagattttggagcatttgagagggttgggttgtggtgctgttttggttagtggtaacgagcttaggctggctctccgtgccggtttcgatcccacgaggtgtatttttaatggaaatgggaagctgttggatgatttggttttagctgctcaagaaggtgtttttgttaacgtggatagtgaattcgatttggaaaatattgtggctgctgctagaattgctggcaagaaggttaatgttctacttcggatcaacccagatgttgaccctcagaaaaggataatgcttgctgatttgctcatatattttaaaactggcaccacaaaagtcatggtccatccttatgttgctactgggaataagaactctaaatttggtattagaaatgagaagctgcaatggtttctggatgctgtgaaggcacaccctaatgagctgaagcttgtgggggcccattgccatcttggatcaaccatcaccaaggtggacatattcagagatgctgcagctcttatggttaactacattgatgaaatccgagcccagggatttgaagttgattacttgaacattggaggtggtttgggtatagattattatcattctggtgctgtccttcctactccaagagatctcattgacactgttcgtgaactggtgctctcacgagatctcaatctcattattgaacctgggagatctctcattgcaaatacttgctgcctggtgaacagggtcactggggttaaaactaatggaacaaaaaattttgttgtgatagatggaagcatggctgaacttatccgccctagtctttatgatgcttatcaacacatagagcttgtttctcctgcgtcacccagtgcggaagtttcaacttttgatgtggttggtcctgtctgtgagtcagcagatttcctgggaaaggatagagaacttccaactcctgctaagggagctggtttggttgttcatgatgcaggtgcttactgtatgagcatggcgtcgacatacaatctcaagatgcgccctcctgagtactgggttgaagatgatggatcagtgtccaaaattcgacagggagagacatttgaagaccatattcggttcttcgagggtctttga

SEQ ID NO: 2099 - protein, 502 aa, Populus balsamifera subsp. trichocarpa
  misc_feature (1)..(502): Ceres ANNOT ID no. 1460794
  misc_feature (241)..(366): Pfam Name: Orn_Arg_deC_N Pfam Description: Pyridoxal-dependent decarboxylase pyridoxal binding domain
  misc_feature (369)..(478): Pfam Name: Orn_DAP_Arg_deC Pfam Description: Pyridoxal-dependent decarboxylase C-terminal sheet domain
  misc_feature: SWISSPROT Homolog: DCDA_AQUAE Diaminopimelate decarboxylase (EC 4.1.1.20) (DAP decarboxylase) with e-value of 3.5e-64 and BLAST sequence identity of 38.2
  misc_feature: SWISSPROT Homolog: DCDA_ARCFU Diaminopimelate decarboxylase (EC 4.1.1.20) (DAP decarboxylase) with e-value of 1.2e-63 and BLAST sequence identity of 40.4
  misc_feature: SWISSPROT Homolog: DCDA_PSEAE Diaminopimelate decarboxylase (EC 4.1.1.20) (DAP decarboxylase) with e-value of 5.9e-62 and BLAST sequence identity of 38.0
  misc_feature: SWISSPROT Homolog: DCDA_NEIMB Diaminopimelate decarboxylase (EC 4.1.1.20) (DAP decarboxylase) with e-value of 1.6e-59 and BLAST sequence identity of 38.7
  misc_feature: SWISSPROT Homolog: DCDA_NEIMA Diaminopimelate decarboxylase (EC 4.1.1.20) (DAP decarboxylase) with e-value of 2.6e-59 and BLAST sequence identity of 38.5
  misc_feature 235644:<222: Transcription Factor
  misc_feature: Phenotype: ROSETTE LEAVES - Corkscrew Useful for making plants with altered leaf shape eg curled leaves
  misc_feature: Phenotype: ROSETTE LEAVES - Curled 4 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: WHOLE PLANT - Other Useful for making bigger plants
  misc_feature: Phenotype: INFLORESCENCE - Other Useful for making ornamental plants with modified flowers
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(502): Functional Homolog of  Ceres CLONE ID no. 96020 at SEQ ID NO. 2139 with e-value of 3.69E-178 and BLAST sequence identity of 81.1
MAAATNFSHSPFISKTLTHSLNHNPLPKNPTLPFKLSKSYSLKAVISQQNPATATTQKTQFKHCFTKSQDGFLYCESLKVQEIMESVEKRPFYLYSKPQITRNVEAYKDALQGLSSIIGYAIKANNNLKILEHLRGLGCGAVLVSGNELRLALRAGFDPTRCIFNGNGKLLDDLVLAAQEGVFVNVDSEFDLENIVAAARIAGKKVNVLLRINPDVDPQKRIMLADLLIYFKTGTTKVMVHPYVATGNKNSKFGIRNEKLQWFLDAVKAHPNELKLVGAHCHLGSTITKVDIFRDAAALMVNYIDEIRAQGFEVDYLNIGGGLGIDYYHSGAVLPTPRDLIDTVRELVLSRDLNLIIEPGRSLIANTCCLVNRVTGVKTNGTKNFVVIDGSMAELIRPSLYDAYQHIELVSPASPSAEVSTFDVVGPVCESADFLGKDRELPTPAKGAGLVVHDAGAYCMSMASTYNLKMRPPEYWVEDDGSVSKIRQGETFEDHIRFFEGL

SEQ ID NO: 2100 - protein, 155 aa, Arabidopsis thaliana
  misc_feature (1)..(155): Ceres CLONE ID no. 97415
  misc_feature (45)..(153): Pfam Name: HSP20 Pfam Description: Hsp20/alpha crystallin family
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: ROSETTE LEAVES - Lanceolate Shaped Useful for making plants with increased biomass and foliage
  misc_feature: Phenotype: SILIQUES - Other Useful for increasing seed/fruit yield or modifying fruit content
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MSAVAINHFFGLPETIEKLILPISRSGESNNESRGRGSSNNIPIDILESPKKYIFYLDIPGISKSDIQVTVEEERTLVIKSNGKRKRDDDESEEGSKYIRLERRLAQNLVKKFRLPEDADMASVTAKYQEGILTVVIKKLPPQPPKPKTVQIAVS

SEQ ID NO: 2101 - DNA, 279 bp, Populus balsamifera subsp. trichocarpa
  misc_feature (1)..(279): Ceres ANNOT ID no. 1481701
  misc_feature 235943:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: ROSETTE LEAVES - Lanceolate Shaped Useful for making plants with increased biomass and foliage
  misc_feature: Phenotype: SILIQUES - Other Useful for increasing seed/fruit yield or modifying fruit content
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atggatgaacctggattgtccaagtctgatatcctgatgactgttgaagatgagaatactctggtgattaaaagtgcaggaaagaggaaacgcgaagatgatgatgaggaaggctgcaagtacatcaggcttgaaaggaaggcaccccagaagctgctgaggaagttccggttgcccgagaatgccattgtgtcttctgccattactgctaaatgtgagattggggttttgcctgtggttgttgagaagcatcctccaccacccaagacagacagttga

SEQ ID NO: 2102 - protein, 92 aa, Populus balsamifera subsp. trichocarpa
  misc_feature (1)..(92): Ceres ANNOT ID no. 1481701
  misc_feature (4)..(89): Pfam Name: HSP20 Pfam Description: Hsp20/alpha crystallin family
  misc_feature: SWISSPROT Homolog: HSP21_HELAN 17.9 kDa class II heat shock protein with e-value of 2.1e-25 and BLAST sequence identity of 44.4
  misc_feature: SWISSPROT Homolog: HSP21_PEA 17.1 kDa class II heat shock protein with e-value of 1.2e-24 and BLAST sequence identity of 46.5
  misc_feature: SWISSPROT Homolog: HSP21_SOYBN 17.9 kDa class II heat shock protein with e-value of 1.1e-23 and BLAST sequence identity of 45.6
  misc_feature: SWISSPROT Homolog: HSP21_ARATH 17.6 kDa class II heat shock protein with e-value of 2.2e-23 and BLAST sequence identity of 43.9
  misc_feature: SWISSPROT Homolog: HSP21_MAIZE 17.5 kDa class II heat shock protein with e-value of 5.8e-23 and BLAST sequence identity of 45.6
  misc_feature 236061:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: ROSETTE LEAVES - Lanceolate Shaped Useful for making plants with increased biomass and foliage
  misc_feature: Phenotype: SILIQUES - Other Useful for increasing seed/fruit yield or modifying fruit content
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(92): Functional Homolog of  Ceres CLONE ID no. 97415 at SEQ ID NO. 2144 with e-value of 1.70E-24 and BLAST sequence identity of 65.9
MDEPGLSKSDILMTVEDENTLVIKSAGKRKREDDDEEGCKYIRLERKAPQKLLRKFRLPENAIVSSAITAKCEIGVLPVVVEKHPPPPKTDS

SEQ ID NO: 2103 - protein, 113 aa, Arabidopsis thaliana
  misc_feature (1)..(113): Ceres CLONE ID no. 97434
  misc_feature (17)..(112): Pfam Name: Ribosomal_60s Pfam Description: 60s Acidic ribosomal protein
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: WHOLE PLANT - Other Useful for making bigger plants
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MKVAAAFLLAVLGGNANPSAENIKDIIGAVGADVDGESIELLLKEVSGKDIAELIASGREKLASVPSGGGVAVSAAPSSGGGGAAAAAPAEKKEAKKEEKEESDDDMGFSLFE

SEQ ID NO: 2104 - DNA, 345 bp, Populus balsamifera subsp. trichocarpa
  misc_feature (1)..(345): Ceres ANNOT ID no. 1488311
  misc_feature 236248:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: WHOLE PLANT - Other Useful for making bigger plants
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgaaggttgtagccgcttacttgctcgccgttctcggtggcaacacctgccctaccgccgaggacttgaagcacatcctcggatctgttggagcagatgctgatgatgacaggattgagctgctgttgtccagtgtgaaaggaaaggacataactgagctgattgcttccggaagggagaagttggcttccgtcccttccggtggtggcgttgctgtcgctgccggtggagctccagctgctgcttccggtggtgctgcccctgctgccgaggcaaagaaagaggagaaggttgaagagaaagaggagtctgatgatgatatgggtttcagtctattcgattaa

SEQ ID NO: 2105 - protein, 114 aa, Populus balsamifera subsp. trichocarpa
  misc_feature (1)..(114): Ceres ANNOT ID no. 1488311
  misc_feature (17)..(113): Pfam Name: Ribosomal_60s Pfam Description: 60s Acidic ribosomal protein
  misc_feature: SWISSPROT Homolog: RLA2B_ARATH 60S acidic ribosomal protein P2-B with e-value of 2.3e-37 and BLAST sequence identity of 72.2
  misc_feature: SWISSPROT Homolog: RLA2A_ARATH 60S acidic ribosomal protein P2-A with e-value of 9.8e-37 and BLAST sequence identity of 70.4
  misc_feature: SWISSPROT Homolog: RLA2_PARAR 60S acidic ribosomal protein P2 with e-value of 1.5e-33 and BLAST sequence identity of 65.5
  misc_feature: SWISSPROT Homolog: RLA2A_MAIZE 60S acidic ribosomal protein P2A (P2) with e-value of 1.5e-31 and BLAST sequence identity of 66.4
  misc_feature: SWISSPROT Homolog: RLA2B_MAIZE 60S acidic ribosomal protein P2B with e-value of 1.9e-31 and BLAST sequence identity of 60.2
  misc_feature 236369:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: WHOLE PLANT - Other Useful for making bigger plants
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(114): Functional Homolog of  Ceres CLONE ID no. 97434 at SEQ ID NO. 2147 with e-value of 8.50E-37 and BLAST sequence identity of 75.0
MKVVAAYLLAVLGGNTCPTAEDLKHILGSVGADADDDRIELLLSSVKGKDITELIASGREKLASVPSGGGVAVAAGGAPAAASGGAAPAAEAKKEEKVEEKEESDDDMGFSLFD

SEQ ID NO: 2106 - DNA, 333 bp, Populus balsamifera subsp. trichocarpa
  misc_feature (1)..(333): Ceres ANNOT ID no. 1518776
  misc_feature 236468:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: WHOLE PLANT - Other Useful for making bigger plants
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgaagactgttgctgctttcttgttggctgttttgggtggcaacaatagcccttctgctgaagatatcaagaagattcttgcctctgttggtgctgaagctgatgataagattgagctactcttgtctcaagttaaggataaggatataactgagcttattgctgctggaagggagaaattagcttctgtgccttgtggtggtggcgcagttgttgcagcggctgctccagctgatggcgctgctgctcctgctgctgctgagacaaaagaggagaaggtagaggagaaagaggatacagatgatgatctgggcttcagtctctttgattga

SEQ ID NO: 2107 - protein, 110 aa, Populus balsamifera subsp. trichocarpa
  misc_feature (1)..(110): Ceres ANNOT ID no. 1518776
  misc_feature (17)..(109): Pfam Name: Ribosomal_60s Pfam Description: 60s Acidic ribosomal protein
  misc_feature: SWISSPROT Homolog: RLA2B_ARATH 60S acidic ribosomal protein P2-B with e-value of 2.3e-37 and BLAST sequence identity of 72.2
  misc_feature: SWISSPROT Homolog: RLA2A_ARATH 60S acidic ribosomal protein P2-A with e-value of 9.8e-37 and BLAST sequence identity of 70.4
  misc_feature: SWISSPROT Homolog: RLA2_PARAR 60S acidic ribosomal protein P2 with e-value of 1.5e-33 and BLAST sequence identity of 65.5
  misc_feature: SWISSPROT Homolog: RLA2A_MAIZE 60S acidic ribosomal protein P2A (P2) with e-value of 1.5e-31 and BLAST sequence identity of 66.4
  misc_feature: SWISSPROT Homolog: RLA2B_MAIZE 60S acidic ribosomal protein P2B with e-value of 1.9e-31 and BLAST sequence identity of 60.2
  misc_feature 236589:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: WHOLE PLANT - Other Useful for making bigger plants
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(110): Functional Homolog of  Ceres CLONE ID no. 97434 at SEQ ID NO. 2147 with e-value of 1.69E-31 and BLAST sequence identity of 67.2
MKTVAAFLLAVLGGNNSPSAEDIKKILASVGAEADDKIELLLSQVKDKDITELIAAGREKLASVPCGGGAVVAAAAPADGAAAPAAAETKEEKVEEKEDTDDDLGFSLFD

SEQ ID NO: 2108 - protein, 89 aa, Arabidopsis thaliana
  misc_feature (1)..(89): Ceres CLONE ID no. 97480
  misc_feature (9)..(75): Pfam Name: LSM Pfam Description: LSM domain
  misc_feature: Phenotype: INFLORESCENCE - Late Flowering Useful for modulating flowering time
  misc_feature: Phenotype: WHOLE PLANT - Late Senescence Useful for delaying senescence
MSGRKETVLDLAKFVDKGVQVKLTGGRQVTGTLKGYDQLLNLVLDEAVEFVRDHDDPLKTTDQTRRLGLIVCRGTGDACLTNRWHRRNR

SEQ ID NO: 2109 - DNA, 300 bp, Populus balsamifera subsp. trichocarpa
  misc_feature (1)..(300): Ceres ANNOT ID no. 1493111
  misc_feature 236738:<222: Transcription Factor
  misc_feature: Phenotype: INFLORESCENCE - Late Flowering Useful for modulating flowering time
  misc_feature: Phenotype: WHOLE PLANT - Late Senescence Useful for delaying senescence
atgtcagggaggaaagaaacagtattggatttggctaagttcgtggacaagggtgttcaagtcaagctcactggtggtagacaagtgacagggactttgaagggatatgaccaattactaaaccttgtcctggatgaggcggtagaatttctaagagatgctgatgatccgctaaagaccactgatcagacaaggcgccttggcctaattgtttgcaggggaactgctgtgatgctggtgtctccaactgatggtacagatgagattgccaacccttttgtccagccagatggagcctag

SEQ ID NO: 2110 - protein, 99 aa, Populus balsamifera subsp. trichocarpa
  misc_feature (1)..(99): Ceres ANNOT ID no. 1493111
  misc_feature (9)..(82): Pfam Name: LSM Pfam Description: LSM domain
  misc_feature: SWISSPROT Homolog: LSM7_HUMAN U6 snRNA-associated Sm-like protein LSm7 with e-value of 1.6e-20 and BLAST sequence identity of 58.3
  misc_feature: SWISSPROT Homolog: LSM7_MOUSE U6 snRNA-associated Sm-like protein LSm7 with e-value of 2.6e-20 and BLAST sequence identity of 58.3
  misc_feature: SWISSPROT Homolog: LSM7_YEAST U6 snRNA-associated Sm-like protein LSm3 with e-value of 2.0e-15 and BLAST sequence identity of 52.0
  misc_feature: SWISSPROT Homolog: RUXG_ARATH Probable small nuclear ribonucleoprotein G (snRNP-G) Sm protein G (Sm-G) (SmG) with e-value of 1.7e-09 and BLAST sequence identity of 47.7
  misc_feature: SWISSPROT Homolog: RUXG_HUMAN Small nuclear ribonucleoprotein G (snRNP-G) (Sm protein G) (Sm-G) (SmG) with e-value of 2.7e-09 and BLAST sequence identity of 43.1
  misc_feature 236825:<222: Transcription Factor
  misc_feature: Phenotype: INFLORESCENCE - Late Flowering Useful for modulating flowering time
  misc_feature: Phenotype: WHOLE PLANT - Late Senescence Useful for delaying senescence
  misc_feature (1)..(99): Functional Homolog of  Ceres CLONE ID no. 97480 at SEQ ID NO. 2152 with e-value of 3.80E-34 and BLAST sequence identity of 97.3
MSGRKETVLDLAKFVDKGVQVKLTGGRQVTGTLKGYDQLLNLVLDEAVEFLRDADDPLKTTDQTRRLGLIVCRGTAVMLVSPTDGTDEIANPFVQPDGA

SEQ ID NO: 2111 - protein, 178 aa, Arabidopsis thaliana
  misc_feature (1)..(178): Ceres CLONE ID no. 98140
  misc_feature (1)..(178): Also Known As Ceres CDNA ID no. 23448005
  misc_feature (1)..(178): Also Known As Ceres GEMINI ID 531C1
  misc_feature (53)..(122): Pfam Name: HMG_box Pfam Description: HMG (high mobility group) box
  misc_feature 236906:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: Activates expression of the gene endogenous to the AtHMGS (SEQ ID NO 4144) regalutory region Useful for modulating Terpenoid Biosynthesis
MKTAKGKDKVKTTKEALKPVDDRKVGKRKAPAEKPTKRETRKEKKAKKDPNKPKRAPSAFFVFLEDFRVTFKKENPNVKAVSAVGKAGGQKWKAMSQAEKAPYEEKAAKRKAEYEKQMDAYNKNLEEGSDESEKSRSEINDEDEASGEEELLEKEAAGDDEEEEEEEDDDNDDDEEED

SEQ ID NO: 2112 - DNA, 642 bp, Populus balsamifera subsp. trichocarpa
  misc_feature (1)..(642): Ceres ANNOT ID no. 1518036
  misc_feature 236974:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: Activates expression of the gene endogenous to the AtHMGS (SEQ ID NO 4144) regalutory region Useful for modulating Terpenoid Biosynthesis
atgaaaattgccaagggcaaggggacagcaaggacggaaaagaaggaagtattactcccggttgaggacaggaagattggaaagcgaaaggcagcactaaaggctaatgagagtagcaagaaacgagtcaagaaagaaaaaatcaccaagaaggaccctaacaaacccaaaaggcctcctagtgctttctttgtttttctagaagagttcaggaaggtatacaaacaagagcaccccaatgtgaaggctgtgtcagctgtggggaaagctggaggagagaagtggaaatccttgtctgctgcagagaaagctccatatgaagctaaagcagcaaaacggaaatcagactatgaaaagctaatgacagcttacaataaaaaacaggtgaaatatttttgcattgttttcttcagaatcaaatggacttgcattatttccccagcctcaggactacattatgctcctctcaggatacggatgatggtgatgatgacgataatgatgatgacaacatcgaacaatctcacaagtccaaatctgaagtcaatggccaaaatgacgagagtgatgaggaggatgaagatgacgacggcgacgatgatgatgaagatgactgatcaagttggcatgtgggctgattag

SEQ ID NO: 2113 - protein, 213 aa, Populus balsamifera subsp. trichocarpa
  misc_feature (1)..(213): Ceres ANNOT ID no. 1518036
  misc_feature (56)..(125): Pfam Name: HMG_box Pfam Description: HMG (high mobility group) box
  misc_feature: SWISSPROT Homolog: HMGL_IPONI HMG1/2-like protein with e-value of 1.1e-35 and BLAST sequence identity of 51.7
  misc_feature: SWISSPROT Homolog: HMGL_SOYBN HMG1/2-like protein (SB11 protein) with e-value of 7.9e-35 and BLAST sequence identity of 57.5
  misc_feature: SWISSPROT Homolog: HMGL_VICFA HMG1/2-like protein with e-value of 1.2e-33 and BLAST sequence identity of 50.0
  misc_feature: SWISSPROT Homolog: HMGL_WHEAT HMG1/2-like protein with e-value of 1.0e-32 and BLAST sequence identity of 48.4
  misc_feature: SWISSPROT Homolog: MNB1B_MAIZE DNA-binding protein MNB1B (HMG1-like protein) with e-value of 1.3e-32 and BLAST sequence identity of 48.1
  misc_feature 237071:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: Activates expression of the gene endogenous to the AtHMGS (SEQ ID NO 4144) regalutory region Useful for modulating Terpenoid Biosynthesis
  misc_feature (1)..(213): Functional Homolog of  Ceres CLONE ID no. 98140 at SEQ ID NO. 2155 with e-value of 2.99E-41 and BLAST sequence identity of 69.9
MKIAKGKGTARTEKKEVLLPVEDRKIGKRKAALKANESSKKRVKKEKITKKDPNKPKRPPSAFFVFLEEFRKVYKQEHPNVKAVSAVGKAGGEKWKSLSAAEKAPYEAKAAKRKSDYEKLMTAYNKKQVKYFCIVFFRIKWTCIISPASGLHYAPLRIRMMVMMTIMMMTTSNNLTSPNLKSMAKMTRVMRRMKMTTATMMMKMTDQVGMWAD

SEQ ID NO: 2114 - DNA, 582 bp, Populus balsamifera subsp. trichocarpa
  misc_feature (1)..(582): Ceres ANNOT ID no. 1511508
  misc_feature 237153:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: Activates expression of the gene endogenous to the AtHMGS (SEQ ID NO 4144) regalutory region Useful for modulating Terpenoid Biosynthesis
atgaaaactgccaagggcaagggggcagcgaggacggaaaagaaggaagtatcactcccagttgaggacaggaagattggaaagcgaaaggcagcactaaaggctaccgagagtagcaagaaacgagccgcgaaagaaaaaatcaccaagaaggaccctgacaaacccaaaaggcctccgagttctttctttgtttttctagaagagttcaggaagatttacaaacaagagcaccccaatatgaaggctgtctcagctgtggggaaagctggaggagagaagtggaaatccatgtctgctgcagagaaagctccatatgaagctaaagcagcaataaagaaatcagattatgggaagcttatgacagcctacagcaagaaacaggaaacggatgatggtggtgctgacgaagaagacgattacaaacattctcacaggtccaaatctgaagtcgatggccaagatgacagtgatgagagtgtagggacatctactcattgttttacacggttcaatccgttgtctaagttaattgtcactgtagatgccccacgtttaaagaggccaggttctttgctctaa

SEQ ID NO: 2115 - protein, 193 aa, Populus balsamifera subsp. trichocarpa
  misc_feature (1)..(193): Ceres ANNOT ID no. 1511508
  misc_feature (56)..(125): Pfam Name: HMG_box Pfam Description: HMG (high mobility group) box
  misc_feature: SWISSPROT Homolog: HMGL_IPONI HMG1/2-like protein with e-value of 1.1e-35 and BLAST sequence identity of 51.7
  misc_feature: SWISSPROT Homolog: HMGL_SOYBN HMG1/2-like protein (SB11 protein) with e-value of 7.9e-35 and BLAST sequence identity of 57.5
  misc_feature: SWISSPROT Homolog: HMGL_VICFA HMG1/2-like protein with e-value of 1.2e-33 and BLAST sequence identity of 50.0
  misc_feature: SWISSPROT Homolog: HMGL_WHEAT HMG1/2-like protein with e-value of 1.0e-32 and BLAST sequence identity of 48.4
  misc_feature: SWISSPROT Homolog: MNB1B_MAIZE DNA-binding protein MNB1B (HMG1-like protein) with e-value of 1.3e-32 and BLAST sequence identity of 48.1
  misc_feature 237248:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: Activates expression of the gene endogenous to the AtHMGS (SEQ ID NO 4144) regalutory region Useful for modulating Terpenoid Biosynthesis
  misc_feature (1)..(193): Functional Homolog of  Ceres CLONE ID no. 98140 at SEQ ID NO. 2155 with e-value of 7.20E-40 and BLAST sequence identity of 60.6
MKTAKGKGAARTEKKEVSLPVEDRKIGKRKAALKATESSKKRAAKEKITKKDPDKPKRPPSSFFVFLEEFRKIYKQEHPNMKAVSAVGKAGGEKWKSMSAAEKAPYEAKAAIKKSDYGKLMTAYSKKQETDDGGADEEDDYKHSHRSKSEVDGQDDSDESVGTSTHCFTRFNPLSKLIVTVDAPRLKRPGSLL

SEQ ID NO: 2116 - DNA, 507 bp, Populus balsamifera subsp. trichocarpa
  misc_feature (1)..(507): Ceres ANNOT ID no. 1464717
  misc_feature 237327:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: Activates expression of the gene endogenous to the AtHMGS (SEQ ID NO 4144) regalutory region Useful for modulating Terpenoid Biosynthesis
atgaaaattgccaagggcaaggggacagcaaggacggaaaagaaggaagtattactcccggttgaggacaggaagattggaaagcgaaaggcagcactaaaggctaatgagagtagcaagaaacgagtcaagaaagaaaaaatcaccaagaaggaccctaacaaacccaaaaggcctcctagtgctttctttgtttttctagaagagttcaggaaggtatacaaacaagagcaccccaatgtgaaggctgtgtcagctgtggggaaagctggaggagagaagtggaaatccttgtctgctgcaaatcaaatggacttgcattatttccccagcctcaggactacattatgctcctctcaggatacggatgatggtgatgatgacgataatgatgatgacaacatcgaacaatctcacaagtccaaatctgaagtcaatggccaaaatgacgagagtgatgaggaggatgaagatgacgacggcgacgatgatgatgaagatgactga

SEQ ID NO: 2117 - protein, 168 aa, Populus balsamifera subsp. trichocarpa
  misc_feature (1)..(168): Ceres ANNOT ID no. 1464717
  misc_feature (56)..(113): Pfam Name: HMG_box Pfam Description: HMG (high mobility group) box
  misc_feature: SWISSPROT Homolog: HMGL_IPONI HMG1/2-like protein with e-value of 1.1e-35 and BLAST sequence identity of 51.7
  misc_feature: SWISSPROT Homolog: HMGL_SOYBN HMG1/2-like protein (SB11 protein) with e-value of 7.9e-35 and BLAST sequence identity of 57.5
  misc_feature: SWISSPROT Homolog: HMGL_VICFA HMG1/2-like protein with e-value of 1.2e-33 and BLAST sequence identity of 50.0
  misc_feature: SWISSPROT Homolog: HMGL_WHEAT HMG1/2-like protein with e-value of 1.0e-32 and BLAST sequence identity of 48.4
  misc_feature: SWISSPROT Homolog: MNB1B_MAIZE DNA-binding protein MNB1B (HMG1-like protein) with e-value of 1.3e-32 and BLAST sequence identity of 48.1
  misc_feature 237420:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: Activates expression of the gene endogenous to the AtHMGS (SEQ ID NO 4144) regalutory region Useful for modulating Terpenoid Biosynthesis
  misc_feature (1)..(168): Functional Homolog of  Ceres CLONE ID no. 98140 at SEQ ID NO. 2155 with e-value of 5.20E-37 and BLAST sequence identity of 52.1
MKIAKGKGTARTEKKEVLLPVEDRKIGKRKAALKANESSKKRVKKEKITKKDPNKPKRPPSAFFVFLEEFRKVYKQEHPNVKAVSAVGKAGGEKWKSLSAANQMDLHYFPSLRTTLCSSQDTDDGDDDDNDDDNIEQSHKSKSEVNGQNDESDEEDEDDDGDDDDEDD

SEQ ID NO: 2118 - protein, 141 aa, Arabidopsis thaliana
  misc_feature (1)..(141): Ceres CLONE ID no. 98855
  misc_feature (10)..(81): Pfam Name: RRM_1 Pfam Description: RNA recognition motif. (a.k.a. RRM RBD, or RNP domain)
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: FLOWER - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGYSSRGGGGGSYGGGRREGGGGYGGGEGGGYGGNGGGGGW

SEQ ID NO: 2119 - DNA, 513 bp, Populus balsamifera subsp. trichocarpa; identical to SEQ ID NO: 1234
  misc_feature (1)..(513): Ceres ANNOT ID no. 1460836
  misc_feature 237612:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: FLOWER - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage

SEQ ID NO: 2120 - protein, 170 aa, Populus balsamifera subsp. trichocarpa; identical to SEQ ID NO: 1235
  misc_feature (1)..(170): Ceres ANNOT ID no. 1460836
  misc_feature (9)..(80): Pfam Name: RRM_1 Pfam Description: RNA recognition motif. (a.k.a. RRM RBD, or RNP domain)
  misc_feature: SWISSPROT Homolog: GRP7_ARATH Glycine-rich RNA-binding protein 7 with e-value of 2.3e-67 and BLAST sequence identity of 90.5
  misc_feature: SWISSPROT Homolog: GRP1_SINAL Glycine-rich RNA-binding protein GRP1A with e-value of 9.6e-62 and BLAST sequence identity of 77.1
  misc_feature: SWISSPROT Homolog: GRP2_SINAL Glycine-rich RNA-binding protein GRP2A with e-value of 5.3e-61 and BLAST sequence identity of 74.1
  misc_feature: SWISSPROT Homolog: GRP1_DAUCA Glycine-rich RNA-binding protein with e-value of 1.5e-56 and BLAST sequence identity of 75.5
  misc_feature: SWISSPROT Homolog: GRP2_SORBI Glycine-rich RNA-binding protein 2 with e-value of 2.0e-54 and BLAST sequence identity of 72.0
  misc_feature 237760:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: FLOWER - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(170): Functional Homolog of  Ceres CLONE ID no. 98855 at SEQ ID NO. 2162 with e-value of 1.50E-55 and BLAST sequence identity of 81.4

SEQ ID NO: 2121 - DNA, 498 bp, Populus balsamifera subsp. trichocarpa; identical to SEQ ID NO: 1232
  misc_feature (1)..(498): Ceres ANNOT ID no. 1450324
  misc_feature 237889:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: FLOWER - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage

SEQ ID NO: 2122 - protein, 165 aa, Populus balsamifera subsp. trichocarpa; identical to SEQ ID NO: 1233
  misc_feature (1)..(165): Ceres ANNOT ID no. 1450324
  misc_feature (9)..(80): Pfam Name: RRM_1 Pfam Description: RNA recognition motif. (a.k.a. RRM RBD, or RNP domain)
  misc_feature: SWISSPROT Homolog: GRP7_ARATH Glycine-rich RNA-binding protein 7 with e-value of 2.3e-67 and BLAST sequence identity of 90.5
  misc_feature: SWISSPROT Homolog: GRP1_SINAL Glycine-rich RNA-binding protein GRP1A with e-value of 9.6e-62 and BLAST sequence identity of 77.1
  misc_feature: SWISSPROT Homolog: GRP2_SINAL Glycine-rich RNA-binding protein GRP2A with e-value of 5.3e-61 and BLAST sequence identity of 74.1
  misc_feature: SWISSPROT Homolog: GRP1_DAUCA Glycine-rich RNA-binding protein with e-value of 1.5e-56 and BLAST sequence identity of 75.5
  misc_feature: SWISSPROT Homolog: GRP2_SORBI Glycine-rich RNA-binding protein 2 with e-value of 2.0e-54 and BLAST sequence identity of 72.0
  misc_feature 238037:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: FLOWER - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(165): Functional Homolog of  Ceres CLONE ID no. 98855 at SEQ ID NO. 2162 with e-value of 3.50E-54 and BLAST sequence identity of 79.8

SEQ ID NO: 2123 - protein, 194 aa, Arabidopsis thaliana
  misc_feature (1)..(194): Ceres CLONE ID no. 99075
  misc_feature (1)..(194): Also Known As Ceres CDNA ID no. 23372744
  misc_feature (1)..(194): Also Known As Ceres GEMINI ID 554G11
  misc_feature (72)..(190): Pfam Name: DUF298 Pfam Description: Domain of unknown function (DUF298)
  misc_feature 238186:<222: Transcription Factor
  misc_feature: Phenotype: Activates expression of the gene endogenous to the AtHMGS (SEQ ID NO 4144) regalutory region Useful for modulating Terpenoid Biosynthesis
MDRIDHLFNQYANKSSSLIDPEGIEELCSNLEVSHTDIRILMLAWKMKAEKQGYFTHEEWRRGLKALRADTINKLKKALPELEKEVRRPSNFADFYAYAFCYCLTEEKQKSIDIETICQLLEIVMGSTFRAQVDYFVEYLKIQNDYKVINMDQWMGLYRFCNEISFPDMGNYNPELAWPLILDNFVEWIQEKQA

SEQ ID NO: 2124 - DNA, 519 bp, Populus balsamifera subsp. trichocarpa
  misc_feature (1)..(519): Ceres ANNOT ID no. 1490832
  misc_feature 238250:<222: Transcription Factor
  misc_feature: Phenotype: Activates expression of the gene endogenous to the AtHMGS (SEQ ID NO 4144) regalutory region Useful for modulating Terpenoid Biosynthesis
atggagcgaatcgataacctattttactcatacgcaaacaggtcttctggtattattgacccagaaggaattgaaactctatgttcagatatggaggtggatcatactgatgtcagaatcttgatgctagcttggaaaatgagagctgaaaaacagggatactttaccctggaggagtggcgaaggggcctcaaatcactgagggctgatactgtaaataaattaaaaaaggtgcttctggagctagaaaaggaggttaagaggccaacaaactttatggatttctatacctatgcatttcgatattgcctaacagaggagaaacaaaagagtatagacatagagagcatctgccaattgttggatcttgttttaggatcccattttcgagcccaggttgattatttcattgagtatctaaagataagttttccagactttagtaattatgatccggaacttgcatggcccctgatcttggacaattttgtagaatggatgcgagcaaaaaggacctaa

SEQ ID NO: 2125 - protein, 172 aa, Populus balsamifera subsp. trichocarpa
  misc_feature (1)..(172): Ceres ANNOT ID no. 1490832
  misc_feature (72)..(141): Pfam Name: DUF298 Pfam Description: Domain of unknown function (DUF298)
  misc_feature: SWISSPROT Homolog: DCNL4_HUMAN DCN1-like protein 4 with e-value of 1.7e-32 and BLAST sequence identity of 37.6
  misc_feature: SWISSPROT Homolog: DCNL4_HUMAN Defective in cullin neddylation protein 1-like protein 4 DCUN1 domain-containing protein 4
  misc_feature: SWISSPROT Homolog: DCNL4_MOUSE DCN1-like protein 4 (Defective in cullin neddylation protein 1- like protein 4) (DCUN1 domain-containing protein 4) with e-value of 1.7e-32 and BLAST sequence identity of 38.2
  misc_feature: SWISSPROT Homolog: DCNL4_BRARE DCN1-like protein 4 (Defective in cullin neddylation protein 1- like protein 4) (DCUN1 domain-containing protein 4) with e-value of 3.2e-31 and BLAST sequence identity of 35.5
  misc_feature: SWISSPROT Homolog: DCNL1_HUMAN DCN1-like protein 1 with e-value of 8.0e-26 and BLAST sequence identity of 31.1
  misc_feature: SWISSPROT Homolog: DCNL1_HUMAN Defective in cullin neddylation protein 1-like protein 1) ( DCUN1 domain-containing protein 1) ( Squamous cell carcinoma-related oncogene)
  misc_feature: SWISSPROT Homolog: DCN1L_DROME DCN1-like protein (Defective in cullin neddylation protein 1-like protein) with e-value of 2.7e-25 and BLAST sequence identity of 35.3
  misc_feature 238354:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(172): Functional Homolog of  Ceres CLONE ID no. 99075 at SEQ ID NO. 2167 with e-value of 1.39E-68 and BLAST sequence identity of 78.9
MERIDNLFYSYANRSSGIIDPEGIETLCSDMEVDHTDVRILMLAWKMRAEKQGYFTLEEWRRGLKSLRADTVNKLKKVLLELEKEVKRPTNFMDFYTYAFRYCLTEEKQKSIDIESICQLLDLVLGSHFRAQVDYFIEYLKISFPDFSNYDPELAWPLILDNFVEWMRAKRT

SEQ ID NO: 2126 - DNA, 561 bp, Populus balsamifera subsp. trichocarpa
  misc_feature (1)..(561): Ceres ANNOT ID no. 1501068
  misc_feature 238420:<222: Transcription Factor
  misc_feature: Phenotype: Activates expression of the gene endogenous to the AtHMGS (SEQ ID NO 4144) regalutory region Useful for modulating Terpenoid Biosynthesis
atggagcgaatcgataacctattttactcatatgcaaacaggtcttctggtatgattgacccagaaggaattgaaactctatgttcagatatggaggtggatcatactgatgttagaatcttgatgctagcttggaaaatgagagctgaaaaacagggatactttaccctggaggagtggcgacagggcctcaaatcactgagggctgatactctaaataaattaaaaaaggcgctcccggatctagagaaagaggttaagaggccatcaaactttgtggatttctataactatgcattccggtattgcctaacagaggagaaacaaaagagtatagacatagagagcatctgccaattgttggatcttgttttaggatcccatttccaagcccaggttgattacttcattgagtatctaaaggggatccaggcaactttattagctgaatttgagaggaaatgccccattgttttatgttcattgcgtatccatacatgtttaggcaccttaacagtgcagttcccttcacaagaatggatgcgagccaaaaggacctaa

SEQ ID NO: 2127 - protein, 186 aa, Populus balsamifera subsp. trichocarpa
  misc_feature (1)..(186): Ceres ANNOT ID no. 1501068
  misc_feature (72)..(168): Pfam Name: DUF298 Pfam Description: Domain of unknown function (DUF298)
  misc_feature: SWISSPROT Homolog: DCNL4_HUMAN DCN1-like protein 4 with e-value of 1.7e-32 and BLAST sequence identity of 37.6
  misc_feature: SWISSPROT Homolog: DCNL4_HUMAN Defective in cullin neddylation protein 1-like protein 4 DCUN1 domain-containing protein 4
  misc_feature: SWISSPROT Homolog: DCNL4_BRARE DCN1-like protein 4 (Defective in cullin neddylation protein 1- like protein 4) (DCUN1 domain-containing protein 4) with e-value of 1.7e-32 and BLAST sequence identity of 38.2
  misc_feature: SWISSPROT Homolog: DCNL4_BRARE DCN1-like protein 4 (Defective in cullin neddylation protein 1- like protein 4) (DCUN1 domain-containing protein 4) with e-value of 3.2e-31 and BLAST sequence identity of 35.5
  misc_feature: SWISSPROT Homolog: DCNL1_HUMAN DCN1-like protein 1 with e-value of 8.0e-26 and BLAST sequence identity of 31.1
  misc_feature: SWISSPROT Homolog: DCNL1_HUMAN Defective in cullin neddylation protein 1-like protein 1) ( DCUN1 domain-containing protein 1) ( Squamous cell carcinoma-related oncogene)
  misc_feature: SWISSPROT Homolog: DCN1L_DROME DCN1-like protein (Defective in cullin neddylation protein 1-like protein) with e-value of 2.7e-25 and BLAST sequence identity of 35.3
  misc_feature 238526:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(186): Functional Homolog of  Ceres CLONE ID no. 99075 at SEQ ID NO. 2167 with e-value of 5.29E-60 and BLAST sequence identity of 79.4
MERIDNLFYSYANRSSGMIDPEGIETLCSDMEVDHTDVRILMLAWKMRAEKQGYFTLEEWRQGLKSLRADTLNKLKKALPDLEKEVKRPSNFVDFYNYAFRYCLTEEKQKSIDIESICQLLDLVLGSHFQAQVDYFIEYLKGIQATLLAEFERKCPIVLCSLRIHTCLGTLTVQFPSQEWMRAKRT

SEQ ID NO: 2128 - DNA, 528 bp, Populus balsamifera subsp. trichocarpa
  misc_feature (1)..(528): Ceres ANNOT ID no. 1438021
  misc_feature 238595:<222: Transcription Factor
  misc_feature: Phenotype: Activates expression of the gene endogenous to the AtHMGS (SEQ ID NO 4144) regalutory region Useful for modulating Terpenoid Biosynthesis
atggagcgaatcgataacctattttactcatacgcaaacaggtcttctggtattattgacccagaaggaattgaaactctatgttcagatatggaggtggatcatactgatgtcagaatcttgatgctagcttggaaaatgagagctgaaaaacagggatactttaccctggaggagtggcgaaggggcctcaaatcactgagggctgatactgtaaataaattaaaaaaggtgcttctggagctagaaaaggaggttaagaggccaacaaactttatggatttctatacctatgcatttcgatattgcctaacagaggagaaacaaaagagtatagacatagagagcatctgccaattgttggatcttgttttaggatcccattttcgagcccaggttgattatttcattgagtatctaaagtttatgcttctctctggtctattagcttatgagctagactttagaattgatgggctatttgattctgcatctgttttactttttgtagccaatcttgcaacttaa

SEQ ID NO: 2129 - protein, 175 aa, Populus balsamifera subsp. trichocarpa
  misc_feature (1)..(175): Ceres ANNOT ID no. 1438021
  misc_feature (72)..(141): Pfam Name: DUF298 Pfam Description: Domain of unknown function (DUF298)
  misc_feature: SWISSPROT Homolog: DCNL4_HUMAN DCN1-like protein 4 with e-value of 1.7e-32 and BLAST sequence identity of 37.6
  misc_feature: SWISSPROT Homolog: DCNL4_HUMAN Defective in cullin neddylation protein 1-like protein 4 DCUN1 domain-containing protein 4
  misc_feature: SWISSPROT Homolog: DCNL4_BRARE DCN1-like protein 4 (Defective in cullin neddylation protein 1- like protein 4) (DCUN1 domain-containing protein 4) with e-value of 1.7e-32 and BLAST sequence identity of 38.2
  misc_feature: SWISSPROT Homolog: DCNL4_BRARE DCN1-like protein 4 (Defective in cullin neddylation protein 1- like protein 4) (DCUN1 domain-containing protein 4) with e-value of 3.2e-31 and BLAST sequence identity of 35.5
  misc_feature: SWISSPROT Homolog: DCNL1_HUMAN DCN1-like protein 1 with e-value of 8.0e-26 and BLAST sequence identity of 31.1
  misc_feature: SWISSPROT Homolog: DCNL1_HUMAN Defective in cullin neddylation protein 1-like protein 1) ( DCUN1 domain-containing protein 1) ( Squamous cell carcinoma-related oncogene)
  misc_feature: SWISSPROT Homolog: DCN1L_DROME DCN1-like protein (Defective in cullin neddylation protein 1-like protein) with e-value of 2.7e-25 and BLAST sequence identity of 35.3
  misc_feature 238698:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(175): Functional Homolog of  Ceres CLONE ID no. 99075 at SEQ ID NO. 2167 with e-value of 1.40E-59 and BLAST sequence identity of 79.4
MERIDNLFYSYANRSSGIIDPEGIETLCSDMEVDHTDVRILMLAWKMRAEKQGYFTLEEWRRGLKSLRADTVNKLKKVLLELEKEVKRPTNFMDFYTYAFRYCLTEEKQKSIDIESICQLLDLVLGSHFRAQVDYFIEYLKFMLLSGLLAYELDFRIDGLFDSASVLLFVANLAT

SEQ ID NO: 2130 - protein, 598 aa, Arabidopsis thaliana
  misc_feature (1)..(598): Ceres CLONE ID no. 99298
  misc_feature (284)..(583): Pfam Name: Pectinesterase Pfam Description: Pectinesterase
  misc_feature (81)..(232): Pfam Name: PMEI Pfam Description: Plant invertase/pectin methylesterase inhibitor
  misc_feature: Phenotype: WHOLE PLANT - Late Senescence Useful for delaying senescence
MGYERLGPSGATGSVTTSTTTAPILNQVSTSEQPENNNRRSKKKLVVSSIVLAISLILAAAIFAGVRSRLKLNQSVPGLARKPSQAISKACELTRFPELCVDSLMDFPGSLAASSSKDLIHVTVNMTLHHFSHALYSSASLSFVDMPPRARSAYDSCVELLDDSVDALSRALSSVVSSSAKPQDVTTWLSAALTNHDTCTEGFDGVDDGGVKDHMTAALQNLSELVSNCLAIFSASHDGDDFAGVPIQNRRLLGVEEREEKFPRWMRPKEREILEMPVSQIQADIIVSKDGNGTCKTISEAIKKAPQNSTRRIIIYVKAGRYEENNLKVGRKKINLMFVGDGKGKTVISGGKSIFDNITTFHTASFAATGAGFIARDITFENWAGPAKHQAVALRIGADHAVIYRCNIIGYQDTLYVHSNRQFFRECDIYGTVDFIFGNAAVVLQNCSIYARKPMDFQKNTITAQNRKDPNQNTGISIHASRVLAASDLQATNGSTQTYLGRPWKLFSRTVYMMSYIGGHVHTRGWLEWNTTFALDTLYYGEYLNSGPGSGLGQRVSWPGYRVINSTAEANRFTVAEFIYGSSWLPSTGVSFLAGLSI

SEQ ID NO: 2131 - DNA, 1818 bp, Populus balsamifera subsp. trichocarpa
  misc_feature (1)..(1818): Ceres ANNOT ID no. 1473029
  misc_feature 238912:<222: Transcription Factor
  misc_feature: Phenotype: WHOLE PLANT - Late Senescence Useful for delaying senescence
atggattatgggaggctcgggccaacagaatccgatccgggagaaggatccggtacttcatttaacatcaacgagccacaacttgccacgccacgggtttccccaacgagaaaaaagagaatcatcttccttgccatcttctccatcgcattgatagctgcttcggccgtctcggccgtgctcctcctcgggattcggaccaaggcatcgggtcagcccgacccgagcagtcttactcaccggaaaccgacccaggccatctccaagacctgcagcaaaactcgcttccctaatctctgtgtcagctcgctcctcgacttccccggctcagtcagtgcgtccgagtcagacttggttcacatttccttcaacatgactctgcaacacttcagcaaagctctgtacctatcctcggcaatctcctatgtcaatatggagacacgtgtacggtcagcatttgatgactgcctcgagctactggatgactccatagacgctctctctcgctctctttccaccgtcgcaccatcccacggcgggggaactggtggcggatcgccggctgatgtagtcacgtggctgagcgcggcgttgacgaaccaggacacatgctcggagggattcgatggagttaacggagctgttaagaatcagatgacggggaggttgaaggatttgacggagctggtcagtaattgtttggcaatattctcatcggcaaatggagacgacttctcaggagtgccggtacagaataagaggagattactgacggagaatgaagacatatcgtatgaggagaatttcccgagatggttagggaggagagacaggaaattactggatgtgccagtaccggcgatacatgccgatattatcgtgtcgggagatgggaatggaacgtgcaagacaatatccgaggcgataaaaaaggcgcctgagtatagtactcggcgtactgtaatttacgtgagggcaggaaggtacgaagagaataacttgaaagttgggaggaagaaatggaatttaatgttcatcggagatgggaagggaaagactataatctcaggaggcaaaagtgttttaaacaaccttaccacattccatacagcatcctttgctgcaacaggagctggttttattgctcgagacatgacatttgagaactgggcgggtccagccaagcaccaagcagtggctcttcgagtcggtgcagaccatgctgtggtctacaggtgcaacatcattggctaccaagacaccctttatgtgcattcaaatcgccaattcttcagggaatgtgacatctatggaactgtagatttcatatttggcaatgctgcagttgtgtttcagaactgtagcatatacgccaggaaaccaatggccttccaaaaaaacaccatcactgcccaaaatcgtaaggaccctaatcaaaatacaggcatatcaatccacgcttgcaggatccttgccacttcagacctcacaccgttgaaaggcagcttcccgacatttctcggccgtccatggaagctctactctagaactgtgtacatgttatcatacataggcgatcatgttcatccaagagggtggctagaatggaacacaacatttgcactcgacacattatactatggtgaatacatgaattacggacccggtggggcggtcgggcaaagggttaaatggcctgggtaccgggtcgttacatcgaccatcgaggcaagtaaattcaccgtggcacagttcatttatggatcatcttggttgccttctaccggggtgtcatttttagctggtctctcactttaa

SEQ ID NO: 2132 - protein, 605 aa, Populus balsamifera subsp. trichocarpa
  misc_feature (1)..(605): Ceres ANNOT ID no. 1473029
  misc_feature (291)..(590): Pfam Name: Pectinesterase Pfam Description: Pectinesterase
  misc_feature (81)..(236): Pfam Name: PMEI Pfam Description: Plant invertase/pectin methylesterase inhibitor
  misc_feature: SWISSPROT Homolog: PME1_CITSI Pectinesterase-1 precursor (EC 3.1.1.11) (Pectin methylesterase) (PE) with e-value of 9.8e-124 and BLAST sequence identity of 45.1
  misc_feature: SWISSPROT Homolog: PME3_CITSI Pectinesterase-3 precursor (EC 3.1.1.11) (Pectin methylesterase 3) (PE 3) with e-value of 8.8e-123 and BLAST sequence identity of 44.4
  misc_feature: SWISSPROT Homolog: PMEU1_LYCES Pectinesterase U1 precursor (EC 3.1.1.11) (Pectin methylesterase) (PE) with e-value of 2.6e-114 and BLAST sequence identity of 41.9
  misc_feature: SWISSPROT Homolog: PME2_ARATH Pectinesterase-2 precursor (EC 3.1.1.11) (Pectin methylesterase 2) (PE 2) with e-value of 1.0e-112 and BLAST sequence identity of 41.0
  misc_feature: SWISSPROT Homolog: PME2_CITSI Pectinesterase-2 precursor (EC 3.1.1.11) (Pectin methylesterase) (PE) with e-value of 2.2e-112 and BLAST sequence identity of 55.9
  misc_feature 239051:<222: Transcription Factor
  misc_feature: Phenotype: WHOLE PLANT - Late Senescence Useful for delaying senescence
  misc_feature (1)..(605): Functional Homolog of  Ceres CLONE ID no. 99298 at SEQ ID NO. 2174 with e-value of 2.69E-223 and BLAST sequence identity of 71.3
MDYGRLGPTESDPGEGSGTSFNINEPQLATPRVSPTRKKRIIFLAIFSIALIAASAVSAVLLLGIRTKASGQPDPSSLTHRKPTQAISKTCSKTRFPNLCVSSLLDFPGSVSASESDLVHISFNMTLQHFSKALYLSSAISYVNMETRVRSAFDDCLELLDDSIDALSRSLSTVAPSHGGGTGGGSPADVVTWLSAALTNQDTCSEGFDGVNGAVKNQMTGRLKDLTELVSNCLAIFSSANGDDFSGVPVQNKRRLLTENEDISYEENFPRWLGRRDRKLLDVPVPAIHADIIVSGDGNGTCKTISEAIKKAPEYSTRRTVIYVRAGRYEENNLKVGRKKWNLMFIGDGKGKTIISGGKSVLNNLTTFHTASFAATGAGFIARDMTFENWAGPAKHQAVALRVGADHAVVYRCNIIGYQDTLYVHSNRQFFRECDIYGTVDFIFGNAAVVFQNCSIYARKPMAFQKNTITAQNRKDPNQNTGISIHACRILATSDLTPLKGSFPTFLGRPWKLYSRTVYMLSYIGDHVHPRGWLEWNTTFALDTLYYGEYMNYGPGGAVGQRVKWPGYRVVTSTIEASKFTVAQFIYGSSWLPSTGVSFLAGLSL

SEQ ID NO: 2133 - DNA, 1809 bp, Populus balsamifera subsp. trichocarpa
  misc_feature (1)..(1809): Ceres ANNOT ID no. 1467502
  misc_feature 239198:<222: Transcription Factor
  misc_feature: Phenotype: WHOLE PLANT - Late Senescence Useful for delaying senescence
atgggttacggtagactcgggcgaaaggaatccgacccgggagaagggtccagtaattcatttactatcaaccaaccacaacacgccacgtcacaggtttccccgacgagaaaaaagaaaatcatcttccttaccatcttctctgtcgtattgatagccgcctccgccgcctccgcggcgatcctcctcggggtccgagataaggcttctggtcaatccgacccgaacagtcttactcaccggaaaccaacccaggctatctccaaggcatgcagcaagactcggttcccggccctctgcgtcagctcgctcctcgacttccctggctcaatgactgcgtccgagtcagacttggttcacatttccttcaacatgactcttctgcacttggataaagctctatatctctcctcgggaatctcctatgtcaacatggagacacatgaacggtcagcatttgatgactgcctcgagctactggaagactccatagacgccctcactcggtccctctccaccgtctcaccatcctccggcggtggtggatcgccggaggacgtagtgacgtggctgagcgcagcgttgacgaaccaggacacatgcagtgaaggattcgaaggagttaacggaactgttaaagatcagatgacagagaagttgaaggatttgacggagctggtcagtaactgtttggcgatattttccgcgactaatggaggcgatttctctggagtgccgatacagaataagaggagattaatgacagaggatggggacatatcggaagaggacaatttcccgagttggttagggaggagagagaggagactattaggcctgcctgtatcggccatacaagccgatattatcgtatcgggagatgggagcggaacgttcaagacaatatcggaggcgataaaaaaggcgcctgagcacagtaatcggcggacgataatttatgtgagggcaggaagatatgtagaggataacttgaaagttgggaggaagaaatggaatttgatgttcatcggagatgggatgggaaagacaataattacaggaagcagaagtgtttttaaccacatcaccacattccacacagcatcctttgctgcaacaggagctggttttattgctcgtgacatgacatttgagaactgggctggtccagccaagcatcaagctgtggctcttcgagttggtgcagaccatgctgtggtctataggtgcagcatcattggttaccaagacaccctctacgtgcactcaaatcgccaattctacagggaatgtgacatttatgggactgtagatttcatattcggcaatgctgcagttgtgttacaaaactgtagcatttatgcccgtaagccaatggcctcccagaaaaacaccatcactgcccagaatcgcaaagaccctaatcaaaatacaggcatatcaatccatgcttgcaagatccttgccgcgtcggacctcgcaccgtcgaaaggcaccttcccgacatatctcggccgtccatggaagctgtactctagaactgtgtacatgttatcattcatgggtgatcacattcatccaagagggtggctcgagtgggacgcatcatttgcactggacaccttatactatggtgaatacatgaattatggacctggtgcggcggtcgggcaaagggtaaaatggcccgggtatcgggtcatcacatcgaccgtcgaggcaaataaattcactgtggcacagtttatctatggttcatcttggttaccttctacaggggtggcatttttagctggactttcagtttaa

SEQ ID NO: 2134 - protein, 602 aa, Populus balsamifera subsp. trichocarpa
  misc_feature (1)..(602): Ceres ANNOT ID no. 1467502
  misc_feature (288)..(587): Pfam Name: Pectinesterase Pfam Description: Pectinesterase
  misc_feature (81)..(233): Pfam Name: PMEI Pfam Description: Plant invertase/pectin methylesterase inhibitor
  misc_feature: SWISSPROT Homolog: PME1_CITSI Pectinesterase-1 precursor (EC 3.1.1.11) (Pectin methylesterase) (PE) with e-value of 9.8e-124 and BLAST sequence identity of 45.1
  misc_feature: SWISSPROT Homolog: PME3_CITSI Pectinesterase-3 precursor (EC 3.1.1.11) (Pectin methylesterase 3) (PE 3) with e-value of 8.8e-123 and BLAST sequence identity of 44.4
  misc_feature: SWISSPROT Homolog: PMEU1_LYCES Pectinesterase U1 precursor (EC 3.1.1.11) (Pectin methylesterase) (PE) with e-value of 2.6e-114 and BLAST sequence identity of 41.9
  misc_feature: SWISSPROT Homolog: PME2_ARATH Pectinesterase-2 precursor (EC 3.1.1.11) (Pectin methylesterase 2) (PE 2) with e-value of 1.0e-112 and BLAST sequence identity of 41.0
  misc_feature: SWISSPROT Homolog: PME2_CITSI Pectinesterase-2 precursor (EC 3.1.1.11) (Pectin methylesterase) (PE) with e-value of 2.2e-112 and BLAST sequence identity of 55.9
  misc_feature 239337:<222: Transcription Factor
  misc_feature: Phenotype: WHOLE PLANT - Late Senescence Useful for delaying senescence
  misc_feature (1)..(602): Functional Homolog of  Ceres CLONE ID no. 99298 at SEQ ID NO. 2174 with e-value of 2.39E-215 and BLAST sequence identity of 68.8
MGYGRLGRKESDPGEGSSNSFTINQPQHATSQVSPTRKKKIIFLTIFSVVLIAASAASAAILLGVRDKASGQSDPNSLTHRKPTQAISKACSKTRFPALCVSSLLDFPGSMTASESDLVHISFNMTLLHLDKALYLSSGISYVNMETHERSAFDDCLELLEDSIDALTRSLSTVSPSSGGGGSPEDVVTWLSAALTNQDTCSEGFEGVNGTVKDQMTEKLKDLTELVSNCLAIFSATNGGDFSGVPIQNKRRLMTEDGDISEEDNFPSWLGRRERRLLGLPVSAIQADIIVSGDGSGTFKTISEAIKKAPEHSNRRTIIYVRAGRYVEDNLKVGRKKWNLMFIGDGMGKTIITGSRSVFNHITTFHTASFAATGAGFIARDMTFENWAGPAKHQAVALRVGADHAVVYRCSIIGYQDTLYVHSNRQFYRECDIYGTVDFIFGNAAVVLQNCSIYARKPMASQKNTITAQNRKDPNQNTGISIHACKILAASDLAPSKGTFPTYLGRPWKLYSRTVYMLSFMGDHIHPRGWLEWDASFALDTLYYGEYMNYGPGAAVGQRVKWPGYRVITSTVEANKFTVAQFIYGSSWLPSTGVAFLAGLSV

SEQ ID NO: 2135 - protein, 483 aa, Arabidopsis thaliana
  misc_feature (1)..(483): Ceres CLONE ID no. 99519
  misc_feature (1)..(483): Also Known As Ceres CDNA ID no. 23363833
  misc_feature (1)..(483): Also Known As Ceres GEMINI ID 555D6
  misc_feature (16)..(130): Pfam Name: ArfGap Pfam Description: Putative GTPase activating protein for Arf
  misc_feature 239504:<222: Transcription Factor
  misc_feature: Phenotype: Activates expression of the gene endogenous to the AtDXPR (SEQ ID NO 4143) regalutory region Useful for modulating Terpenoid Biosynthesis
MNEKANVSKELNARHRKILEGLLKHPENRECADCKTKGPRWASVNLGIFICMQCSGIHRSLGVHISKVRSATLDTWLPEQVAFIQSMGNDKANSYWEAELPPNYDRVGIENFIRAKYEEKRWVSRGEKARSPPRVEQERRKSVETSGPGYEHGHSSSPVNLFEERKTIPASRTRNNVAATRINLPVPPQGPSQVIKPQQKMESAATPVEREKQAVNVAPASDPPKVDFATDLFNMLSMDDSTTNTSEATPGDTPADDNSWAGFQSAGSGQTAEKIVTAKPAESSSPPASSSDFEDLFKDTPNLTTQQAPKDVKGDIMSLFEKTNIVSPFAMHQQQVAMLAQQQALYMAAAKAAGGTPNGVNQQAIANALNVASANWSNPGGYQIPGMTNPVGGQADLQKLMQNMNMNANMNTRPAQPQENTLQYPSSSFYTMGQANQVNGMTPNSTGKPQSSSATQPTSTTPSSQSGKDFDFSSLMDGMFTKH

SEQ ID NO: 2136 - DNA, 1512 bp, Populus balsamifera subsp. trichocarpa
  misc_feature (1)..(1512): Ceres ANNOT ID no. 1520166
  misc_feature 239622:<222: Transcription Factor
  misc_feature: Phenotype: Activates expression of the gene endogenous to the AtDXPR (SEQ ID NO 4143) regalutory region Useful for modulating Terpenoid Biosynthesis
atgaaccagaaggccaacgtctctaaagagctcaatgctagacacagaaagttcttggaaggcctcctcaaattgcctgagaatagggaatgtgctgactgcaaagccaaaggtccaagatgggcaagtgtgaatttgggtatctttatatgcatgcagtgttcagggatccacagaagtcttggggttcgatccgcaacccttgacacatggcttccagaacaggttgcatttattcaatcaatggggaatgagagggcaaatagttattgggaagcagagttacccccaaactacgacagagttggaattgagaatttcattcgtgcgaagtatgaagagaagagatgggtctctaaagatggaagagcacaatctcctcctagtgggctggatgaaagatctctgcatcagagacccggtgaaagaagtgggcatggacgcaccagcagttctgaaaatttgttcgaggaaaaaaagaattcacaagtatcaagctcaaggaacagtgctactgctacaagaataagtgttcctgttcctcctagaggaccggagcaggttactcctgcaaagcctcaacaggttgttgaaaaagctgaaccaatggtggaggctactgaagctgcaaagaaagttgcagatgctgctccagctgtctctgcacccaaagttgattttgctactgaccttttcaacttgctctccatggatggccctagtgaaaatggctcagaagtagcgtccaatgatgataatggttgggcagctgcagcagttgctgaagaattatcaacgactggaaaagctgttccaagaaaagctgtagaaaataatactcagtccaattcaggaattgaggatttatttaaagattcaccttctttagctatcccttcagtctcggagaaaccccagaaagatgtgaaaaatgatataatgagcctttttgagaagtccaatatggtatcaccatttgcgatgcatcaacaacaacttgctatgctagcgcaacaacagcaacttcttatggctgctgcagcaaaatctgctggtggggacccaaaagtgatgaatcaacagcaacttgctatgctgacacagcaacagcaacttatggctgcagcagcgaagtcagttggtggggacctgaaactctcaggcagtattcaacaacaagggccaaatggtattaacatacctgcacaaaattggccaaacatgggataccaaattcctggtttgatgatgccagtagctgggcagggtgacttacagaaacttatgcagattggtaacataggactgacacatccagggggaagcgctatacaatatccaccatctagcttttttgacatggggcaagttaaccctgccaacggtgggacaagcactggagccagtaaaactcaatcagcagctccggtttcatctggtggtactaaaatgcaaaccggaaaggattatgatttctcctctttaactcaaggcatgttctcaaagcaatga

SEQ ID NO: 2137 - protein, 503 aa, Populus balsamifera subsp. trichocarpa
  misc_feature (1)..(503): Ceres ANNOT ID no. 1520166
  misc_feature (16)..(125): Pfam Name: ArfGap Pfam Description: Putative GTPase activating protein for Arf
  misc_feature: SWISSPROT Homolog: AGE2_YEAST Protein AGE2 with e-value of 3.5e-26 and BLAST sequence identity of 30.2
  misc_feature: SWISSPROT Homolog: CENB2_HUMAN Centaurin-beta 2 (Cnt-b2) with e-value of 2.7e-24 and BLAST sequence identity of 42.0
  misc_feature: SWISSPROT Homolog: UCP3_SCHPO UBA domain-containing protein 3 with e-value of 5.0e-22 and BLAST sequence identity of 43.0
  misc_feature: SWISSPROT Homolog: CENB5_HUMAN Centaurin-beta 5 (Cnt-b5) with e-value of 4.1e-20 and BLAST sequence identity of 38.7
  misc_feature: SWISSPROT Homolog: CENA1_HUMAN Centaurin-alpha 1 (Putative MAPK-activating protein PM25) with e-value of 1.0e-19 and BLAST sequence identity of 45.3
  misc_feature 239743:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(503): Functional Homolog of  Ceres CLONE ID no. 99519 at SEQ ID NO. 2179 with e-value of 1.69E-134 and BLAST sequence identity of 64.2
MNQKANVSKELNARHRKFLEGLLKLPENRECADCKAKGPRWASVNLGIFICMQCSGIHRSLGVRSATLDTWLPEQVAFIQSMGNERANSYWEAELPPNYDRVGIENFIRAKYEEKRWVSKDGRAQSPPSGLDERSLHQRPGERSGHGRTSSSENLFEEKKNSQVSSSRNSATATRISVPVPPRGPEQVTPAKPQQVVEKAEPMVEATEAAKKVADAAPAVSAPKVDFATDLFNLLSMDGPSENGSEVASNDDNGWAAAAVAEELSTTGKAVPRKAVENNTQSNSGIEDLFKDSPSLAIPSVSEKPQKDVKNDIMSLFEKSNMVSPFAMHQQQLAMLAQQQQLLMAAAAKSAGGDPKVMNQQQLAMLTQQQQLMAAAAKSVGGDLKLSGSIQQQGPNGINIPAQNWPNMGYQIPGLMMPVAGQGDLQKLMQIGNIGLTHPGGSAIQYPPSSFFDMGQVNPANGGTSTGASKTQSAAPVSSGGTKMQTGKDYDFSSLTQGMFSKQ

SEQ ID NO: 2138 - DNA, 1431 bp, Populus balsamifera subsp. trichocarpa
  misc_feature (1)..(1431): Ceres ANNOT ID no. 1519131
  misc_feature 239872:<222: Transcription Factor
  misc_feature: Phenotype: Activates expression of the gene endogenous to the AtDXPR (SEQ ID NO 4143) regalutory region Useful for modulating Terpenoid Biosynthesis
atgaatgagaaggctaatgtttcgaaagaacttaatgcaaagcacagaaagatactggaaagcctccttaaattaccggagaatcgagagtgcgctgactgcaaaagcaaagggcctagatgggctagtgtgaatctaggaatcttcatatgcatgcagtgttcaggtatccataggagtcttggagtgcacatctcaaaggttagatcagccactttagacacatggcttccagagcagattgcatttatccaatctacggggaacgagagatcaaataactactgggaagcagagttgcctcctaattatgacagagttggaatcgagaatttcattcgagcaaaatatgaagagaagagatgggttcctagggatggaaaagccaaatcaccttcgagggggagtggagaggggacctcaatttatagaccagaaccaagaagtagtgggcatggccgaatgaatggcactaaccatggttctgaggagagaagaattactcgtccacccattacaaatgacagtagtcctgcttcgagaagttccactccggcgcctattaaagcttccacaccactgcctgttaaagcatccactccaatgcctgttaaagcatctcaaccggtggcacgtgataccaaaccacaagaacctgtgcggaagtcagaaccagtagccccaaaagttgaattagaaaagaaggaagaaagtgcaaccaaagttgtaacaccgccaaaagttgattatgcaactgaactttttaatttgctttgcatggatgattctagggggagtaattccacgactcctgctcatgatattggatggaccggtttaaaagctgctgaagcaaaatcaacacccgagagaagtggtacatcaaattttattgaaagcatgacacaaccaaactcaacttcacctcctttagagaaacccctaaaggattcaaataatgatcctatgaacctcttcaacaagtccagtatggtttctccattttccgtccctcaacagcaacttgcaatgttatcccaacaacaacaattccacatgactgctgcagcaaggactggtggtggatcccaaaccgttcctgccaatgcacatagacccatttccaatggcattcacttacctgctcagaattggggaagctatggctatcaagttcctgggatggtgatgccaagcacttatccacagacatatattcagatgggaagcggccaacaaacctattcagcagggaattcatttaattttccaatatcaagtatgtataggccagggtcagtagctcctatcaatggcatgacaaactctaatccaagtatgcctcctccagcattccctgttgccccaactcagcccgcaggatatttcgatctctcatcattggcacaagggatgtatacaaagcggtga

SEQ ID NO: 2139 - protein, 476 aa, Populus balsamifera subsp. trichocarpa
  misc_feature (1)..(476): Ceres ANNOT ID no. 1519131
  misc_feature (16)..(130): Pfam Name: ArfGap Pfam Description: Putative GTPase activating protein for Arf
  misc_feature: SWISSPROT Homolog: AGE2_YEAST Protein AGE2 with e-value of 3.5e-26 and BLAST sequence identity of 30.2
  misc_feature: SWISSPROT Homolog: CENB2_HUMAN Centaurin-beta 2 (Cnt-b2) with e-value of 2.7e-24 and BLAST sequence identity of 42.0
  misc_feature: SWISSPROT Homolog: UCP3_SCHPO UBA domain-containing protein 3 with e-value of 5.0e-22 and BLAST sequence identity of 43.0
  misc_feature: SWISSPROT Homolog: CENB5_HUMAN Centaurin-beta 5 (Cnt-b5) with e-value of 4.1e-20 and BLAST sequence identity of 38.7
  misc_feature: SWISSPROT Homolog: CENA1_HUMAN Centaurin-alpha 1 (Putative MAPK-activating protein PM25) with e-value of 1.0e-19 and BLAST sequence identity of 45.3
  misc_feature 239989:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(476): Functional Homolog of  Ceres CLONE ID no. 99519 at SEQ ID NO. 2179 with e-value of 3.90E-103 and BLAST sequence identity of 55.0
MNEKANVSKELNAKHRKILESLLKLPENRECADCKSKGPRWASVNLGIFICMQCSGIHRSLGVHISKVRSATLDTWLPEQIAFIQSTGNERSNNYWEAELPPNYDRVGIENFIRAKYEEKRWVPRDGKAKSPSRGSGEGTSIYRPEPRSSGHGRMNGTNHGSEERRITRPPITNDSSPASRSSTPAPIKASTPLPVKASTPMPVKASQPVARDTKPQEPVRKSEPVAPKVELEKKEESATKVVTPPKVDYATELFNLLCMDDSRGSNSTTPAHDIGWTGLKAAEAKSTPERSGTSNFIESMTQPNSTSPPLEKPLKDSNNDPMNLFNKSSMVSPFSVPQQQLAMLSQQQQFHMTAAARTGGGSQTVPANAHRPISNGIHLPAQNWGSYGYQVPGMVMPSTYPQTYIQMGSGQQTYSAGNSFNFPISSMYRPGSVAPINGMTNSNPSMPPPAFPVAPTQPAGYFDLSSLAQGMYTKR

SEQ ID NO: 2140 - DNA, 1335 bp, Populus balsamifera subsp. trichocarpa
  misc_feature (1)..(1335): Ceres ANNOT ID no. 1501805
  misc_feature 240112:<222: Transcription Factor
  misc_feature: Phenotype: Activates expression of the gene endogenous to the AtDXPR (SEQ ID NO 4143) regalutory region Useful for modulating Terpenoid Biosynthesis
atgaacgagaaggctaatgtttcgaaagaactcaatgcaaagcacagaaagatcttggaaagcctccttaaattaccagagaatagagagtgtgctgactgcaaaagcaaagggcctcgatgggctagcgtgaatctaggaatcttcatatgcatgcagtgttcaggtatccacaggagtctaggagtacacatatcaaaggttagatctgccactttagacacatggcttccagggcagattgcatttattcaatctatggggaacgagagatcgaataactattgggaagcagagttgcctcctaaatatgacagagttgtaattgagtatttcattcgggcaaaatatgaagagaagagatgggttcctagggatggaaaagccaaatcaccttcaagggtgaatggagagaagactccaacaagaagtagtggtcatggccaaatgaatgacactaaccatgttttagaggagaggaaagttactcgtccacccattaccaatggcagaagtccttcttccaaaagttccactccaatgcctgttaaagcttccactccattgcctaagtcagaaccagcggccccaaaagctgaattggcaaagaaggaagaacgtgcaaccaaagttgtaacacttccaaaagttgattatgcaactgaactttttaatttgctttgcatggatgattctagggagagtgatttcacgactcctgctcatgataatggatgggccagtttccaaactgctgatgcaaaatctacaccagagagaagtagttcatcaaactttattgaaagcatgacacaaccgaacttaacttcaccatctttggagaaacccctaaaggctgtgaataatgatatcatgaacctcttcgacaagtccagtatggtgtctccattttctgtccatcaacagcaacttgcaaaaatgttatcccaacaacaacaattcattatggctactgcagcagggtctggcaatggatcccacaccgttccttcaaaatcacatagaccaagttccaatggcattcacttacctgctcagagttggggaagctatggctatcaagttcctgggatggtgatgccaatcactgattcacaaaaatatatgcagatgggaagcagccaacaagtgtattctgcagggaacccaattaattttccgatatcaagcatgtataggccaggtccagtagctccaatcaatggcatgacaaaaaccaaagcaactatgcctactccagcattcccagttactccaactcagcctgcagggtattacgatctctcatcattagcgacgtatacaaaacagtga

SEQ ID NO: 2141 - protein, 444 aa, Populus balsamifera subsp. trichocarpa
  misc_feature (1)..(444): Ceres ANNOT ID no. 1501805
  misc_feature (16)..(130): Pfam Name: ArfGap Pfam Description: Putative GTPase activating protein for Arf
  misc_feature: SWISSPROT Homolog: AGE2_YEAST Protein AGE2 with e-value of 3.5e-26 and BLAST sequence identity of 30.2
  misc_feature: SWISSPROT Homolog: CENB2_HUMAN Centaurin-beta 2 (Cnt-b2) with e-value of 2.7e-24 and BLAST sequence identity of 42.0
  misc_feature: SWISSPROT Homolog: UCP3_SCHPO UBA domain-containing protein 3 with e-value of 5.0e-22 and BLAST sequence identity of 43.0
  misc_feature: SWISSPROT Homolog: CENB5_HUMAN Centaurin-beta 5 (Cnt-b5) with e-value of 4.1e-20 and BLAST sequence identity of 38.7
  misc_feature: SWISSPROT Homolog: CENA1_HUMAN Centaurin-alpha 1 (Putative MAPK-activating protein PM25) with e-value of 1.0e-19 and BLAST sequence identity of 45.3
  misc_feature 240227:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(444): Functional Homolog of  Ceres CLONE ID no. 99519 at SEQ ID NO. 2179 with e-value of 5.70E-102 and BLAST sequence identity of 53.3
MNEKANVSKELNAKHRKILESLLKLPENRECADCKSKGPRWASVNLGIFICMQCSGIHRSLGVHISKVRSATLDTWLPGQIAFIQSMGNERSNNYWEAELPPKYDRVVIEYFIRAKYEEKRWVPRDGKAKSPSRVNGEKTPTRSSGHGQMNDTNHVLEERKVTRPPITNGRSPSSKSSTPMPVKASTPLPKSEPAAPKAELAKKEERATKVVTLPKVDYATELFNLLCMDDSRESDFTTPAHDNGWASFQTADAKSTPERSSSSNFIESMTQPNLTSPSLEKPLKAVNNDIMNLFDKSSMVSPFSVHQQQLAKMLSQQQQFIMATAAGSGNGSHTVPSKSHRPSSNGIHLPAQSWGSYGYQVPGMVMPITDSQKYMQMGSSQQVYSAGNPINFPISSMYRPGPVAPINGMTKTKATMPTPAFPVTPTQPAGYYDLSSLATYTKQ

SEQ ID NO: 2142 - protein, 93 aa, Arabidopsis thaliana
  misc_feature (1)..(93): Ceres CLONE ID no. 99657
  misc_feature (12)..(85): Pfam Name: Cofilin_ADF Pfam Description: Cofilin/tropomyosin-type actin-binding protein
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: INFLORESCENCE - Tall Useful for making taller plants and plants with longer inflorescences
MANAASGMAVHDDCKLKFMELKAKRTFRTIVYKIEDKQVIVEKLGEPEQSYDDFAASLPADDCRYCIYDFDFVTAENCQKSKIFLHGLRTLPK

SEQ ID NO: 2143 - DNA, 420 bp, Populus balsamifera subsp. trichocarpa
  misc_feature (1)..(420): Ceres ANNOT ID no. 1461858
  misc_feature 240404:<222: Transcription Factor
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: INFLORESCENCE - Tall Useful for making taller plants and plants with longer inflorescences
atggccaacgcagcatctggtatggcagtgcatgatgactgcaagctgaaatttttggagctgaaggctaaaagaacttaccgcttcatagtttataagattgaggaaaagcaaaagcaggttattgtggagaagcttggtgagcctgcccaaagctatgaagattttactgcaagcctccctgctgatgagtgtcgctttgctgtttatgattttgattttgtgactgcagagaatgtccagaagagcagaattttcttcattgcatggtgtcccgacacatcaagggtgagaagcaagatgatttatgctagttctaaggacaggttcaagagagaactagatggtattcaggtagagttgcaggcaaccgatccaactgaaatgggtctcgatgtcattagaagccgtgccagctaa

SEQ ID NO: 2144 - protein, 139 aa, Populus balsamifera subsp. trichocarpa
  misc_feature (1)..(139): Ceres ANNOT ID no. 1461858
  misc_feature (12)..(139): Pfam Name: Cofilin_ADF Pfam Description: Cofilin/tropomyosin-type actin-binding protein
  misc_feature: SWISSPROT Homolog: ADF2_ARATH Actin-depolymerizing factor 2 (ADF-2) (AtADF2) with e-value of 4.9e-42 and BLAST sequence identity of 100.0
  misc_feature: SWISSPROT Homolog: ADF4_ARATH Actin-depolymerizing factor 4 (ADF-4) (AtADF4) with e-value of 2.7e-34 and BLAST sequence identity of 83.7
  misc_feature: SWISSPROT Homolog: ADF1_PETHY Actin-depolymerizing factor 1 (ADF 1) with e-value of 9.1e-34 and BLAST sequence identity of 79.1
  misc_feature: SWISSPROT Homolog: ADF1_ARATH Actin-depolymerizing factor 1 (ADF-1) (AtADF1) with e-value of 1.2e-33 and BLAST sequence identity of 80.2
  misc_feature: SWISSPROT Homolog: ADF2_PETHY Actin-depolymerizing factor 2 (ADF 2) with e-value of 1.0e-32 and BLAST sequence identity of 76.7
  misc_feature 240505:<222: Transcription Factor
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: INFLORESCENCE - Tall Useful for making taller plants and plants with longer inflorescences
  misc_feature (1)..(139): Functional Homolog of  Ceres CLONE ID no. 99657 at SEQ ID NO. 2186 with e-value of 2.30E-34 and BLAST sequence identity of 84.5
MANAASGMAVHDDCKLKFLELKAKRTYRFIVYKIEEKQKQVIVEKLGEPAQSYEDFTASLPADECRFAVYDFDFVTAENVQKSRIFFIAWCPDTSRVRSKMIYASSKDRFKRELDGIQVELQATDPTEMGLDVIRSRAS

SEQ ID NO: 2145 - DNA, 420 bp, Populus balsamifera subsp. trichocarpa; identical to SEQ ID NO: 2143
  misc_feature (1)..(420): Ceres ANNOT ID no. 1461858
  misc_feature 240579:<222: Transcription Factor
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: INFLORESCENCE - Tall Useful for making taller plants and plants with longer inflorescences

SEQ ID NO: 2146 - protein, 139 aa, Populus balsamifera subsp. trichocarpa; identical to SEQ ID NO: 2144
  misc_feature (1)..(139): Ceres ANNOT ID no. 1461858
  misc_feature (12)..(139): Pfam Name: Cofilin_ADF Pfam Description: Cofilin/tropomyosin-type actin-binding protein
  misc_feature: SWISSPROT Homolog: ADF2_ARATH Actin-depolymerizing factor 2 (ADF-2) (AtADF2) with e-value of 4.9e-42 and BLAST sequence identity of 100.0
  misc_feature: SWISSPROT Homolog: ADF4_ARATH Actin-depolymerizing factor 4 (ADF-4) (AtADF4) with e-value of 2.7e-34 and BLAST sequence identity of 83.7
  misc_feature: SWISSPROT Homolog: ADF1_PETHY Actin-depolymerizing factor 1 (ADF 1) with e-value of 9.1e-34 and BLAST sequence identity of 79.1
  misc_feature: SWISSPROT Homolog: ADF1_ARATH Actin-depolymerizing factor 1 (ADF-1) (AtADF1) with e-value of 1.2e-33 and BLAST sequence identity of 80.2
  misc_feature: SWISSPROT Homolog: ADF2_PETHY Actin-depolymerizing factor 2 (ADF 2) with e-value of 1.0e-32 and BLAST sequence identity of 76.7
  misc_feature 240680:<222: Transcription Factor
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: INFLORESCENCE - Tall Useful for making taller plants and plants with longer inflorescences
  misc_feature (1)..(139): Functional Homolog of  Ceres CLONE ID no. 99657 at SEQ ID NO. 2186 with e-value of 2.30E-34 and BLAST sequence identity of 84.5

SEQ ID NO: 2147 - DNA, 420 bp, Populus balsamifera subsp. trichocarpa
  misc_feature (1)..(420): Ceres ANNOT ID no. 1440018
  misc_feature 240754:<222: Transcription Factor
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: INFLORESCENCE - Tall Useful for making taller plants and plants with longer inflorescences
atggccaacgcagcatctggtatggctgtgcatgatgactgcaagctgaagttcttggagctgaaggcgaaaagaacttaccgcttcatagtttataagattgaggaaaagcaaaagcaggttattgtggaaaagcttggcgagcctgcccaaagctatgaagattttactgcaagcctccctgctgatgagtgtcgctatgctgtttatgattttgattttgtgactgaagagaatgtccagaagagcagaattttcttcattgcatggtctcctgacacatcacgggtgagaagcaagatgatttatgctagttccaaggacaggttcaagagagaactagatggcattcaggtagaattgcaggcaactgatccaactgaaatgggtcttgatgtcatcaagagccgtgccagctaa

SEQ ID NO: 2148 - protein, 139 aa, Populus balsamifera subsp. trichocarpa
  misc_feature (1)..(139): Ceres ANNOT ID no. 1440018
  misc_feature (12)..(139): Pfam Name: Cofilin_ADF Pfam Description: Cofilin/tropomyosin-type actin-binding protein
  misc_feature: SWISSPROT Homolog: ADF2_ARATH Actin-depolymerizing factor 2 (ADF-2) (AtADF2) with e-value of 4.9e-42 and BLAST sequence identity of 100.0
  misc_feature: SWISSPROT Homolog: ADF4_ARATH Actin-depolymerizing factor 4 (ADF-4) (AtADF4) with e-value of 2.7e-34 and BLAST sequence identity of 83.7
  misc_feature: SWISSPROT Homolog: ADF1_PETHY Actin-depolymerizing factor 1 (ADF 1) with e-value of 9.1e-34 and BLAST sequence identity of 79.1
  misc_feature: SWISSPROT Homolog: ADF1_ARATH Actin-depolymerizing factor 1 (ADF-1) (AtADF1) with e-value of 1.2e-33 and BLAST sequence identity of 80.2
  misc_feature: SWISSPROT Homolog: ADF2_PETHY Actin-depolymerizing factor 2 (ADF 2) with e-value of 1.0e-32 and BLAST sequence identity of 76.7
  misc_feature 240855:<222: Transcription Factor
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: INFLORESCENCE - Tall Useful for making taller plants and plants with longer inflorescences
  misc_feature (1)..(139): Functional Homolog of  Ceres CLONE ID no. 99657 at SEQ ID NO. 2186 with e-value of 3.00E-34 and BLAST sequence identity of 84.5
MANAASGMAVHDDCKLKFLELKAKRTYRFIVYKIEEKQKQVIVEKLGEPAQSYEDFTASLPADECRYAVYDFDFVTEENVQKSRIFFIAWSPDTSRVRSKMIYASSKDRFKRELDGIQVELQATDPTEMGLDVIKSRAS

SEQ ID NO: 2149 - DNA, 420 bp, Populus balsamifera subsp. trichocarpa; identical to SEQ ID NO: 2147
  misc_feature (1)..(420): Ceres ANNOT ID no. 1440018
  misc_feature 240929:<222: Transcription Factor
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: INFLORESCENCE - Tall Useful for making taller plants and plants with longer inflorescences

SEQ ID NO: 2150 - protein, 139 aa, Populus balsamifera subsp. trichocarpa; identical to SEQ ID NO: 2148
  misc_feature (1)..(139): Ceres ANNOT ID no. 1440018
  misc_feature (12)..(139): Pfam Name: Cofilin_ADF Pfam Description: Cofilin/tropomyosin-type actin-binding protein
  misc_feature: SWISSPROT Homolog: ADF2_ARATH Actin-depolymerizing factor 2 (ADF-2) (AtADF2) with e-value of 4.9e-42 and BLAST sequence identity of 100.0
  misc_feature: SWISSPROT Homolog: ADF4_ARATH Actin-depolymerizing factor 4 (ADF-4) (AtADF4) with e-value of 2.7e-34 and BLAST sequence identity of 83.7
  misc_feature: SWISSPROT Homolog: ADF1_PETHY Actin-depolymerizing factor 1 (ADF 1) with e-value of 9.1e-34 and BLAST sequence identity of 79.1
  misc_feature: SWISSPROT Homolog: ADF1_ARATH Actin-depolymerizing factor 1 (ADF-1) (AtADF1) with e-value of 1.2e-33 and BLAST sequence identity of 80.2
  misc_feature: SWISSPROT Homolog: ADF2_PETHY Actin-depolymerizing factor 2 (ADF 2) with e-value of 1.0e-32 and BLAST sequence identity of 76.7
  misc_feature 241030:<222: Transcription Factor
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: INFLORESCENCE - Tall Useful for making taller plants and plants with longer inflorescences
  misc_feature (1)..(139): Functional Homolog of  Ceres CLONE ID no. 99657 at SEQ ID NO. 2186 with e-value of 3.00E-34 and BLAST sequence identity of 84.5

SEQ ID NO: 2151 - DNA, 495 bp, Populus balsamifera subsp. trichocarpa
  misc_feature (1)..(495): Ceres ANNOT ID no. 1440019
  misc_feature 241104:<222: Transcription Factor
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: INFLORESCENCE - Tall Useful for making taller plants and plants with longer inflorescences
atgaaacgagtgataagagatgtcttgttaaaacatcgcttctccatcttaccatatatcacccctctctgtgtacaggccaacgcagcatctggtatggctgtgcatgatgactgcaagctgaagttcttggagctgaaggctaaaagaacttaccgatccatagtttttaagattgaagaaaagctaaagcaggttattgtggagaagctgggtgagccagctcaaagctatgaagattttactgcaagcatccctgctgatgagtgtcgatatgctgtttatgattttgatttcatgactgcagagaatgttcaaaagagcaggattttcttcattgcatggtcccctgacacatcaagggtgagaagcaagatgatttatgccagctctaaggacaggtttaagagagaattggatggtattcagatagagttgcaggcaactgatccaactgaaatgggtcttgatgtcattagaagccgtgccagttaa

SEQ ID NO: 2152 - protein, 164 aa, Populus balsamifera subsp. trichocarpa
  misc_feature (1)..(164): Ceres ANNOT ID no. 1440019
  misc_feature (37)..(164): Pfam Name: Cofilin_ADF Pfam Description: Cofilin/tropomyosin-type actin-binding protein
  misc_feature: SWISSPROT Homolog: ADF2_ARATH Actin-depolymerizing factor 2 (ADF-2) (AtADF2) with e-value of 4.9e-42 and BLAST sequence identity of 100.0
  misc_feature: SWISSPROT Homolog: ADF4_ARATH Actin-depolymerizing factor 4 (ADF-4) (AtADF4) with e-value of 2.7e-34 and BLAST sequence identity of 83.7
  misc_feature: SWISSPROT Homolog: ADF1_PETHY Actin-depolymerizing factor 1 (ADF 1) with e-value of 9.1e-34 and BLAST sequence identity of 79.1
  misc_feature: SWISSPROT Homolog: ADF1_ARATH Actin-depolymerizing factor 1 (ADF-1) (AtADF1) with e-value of 1.2e-33 and BLAST sequence identity of 80.2
  misc_feature: SWISSPROT Homolog: ADF2_PETHY Actin-depolymerizing factor 2 (ADF 2) with e-value of 1.0e-32 and BLAST sequence identity of 76.7
  misc_feature 241207:<222: Transcription Factor
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: INFLORESCENCE - Tall Useful for making taller plants and plants with longer inflorescences
  misc_feature (1)..(164): Functional Homolog of  Ceres CLONE ID no. 99657 at SEQ ID NO. 2186 with e-value of 1.30E-33 and BLAST sequence identity of 81.9
MKRVIRDVLLKHRFSILPYITPLCVQANAASGMAVHDDCKLKFLELKAKRTYRSIVFKIEEKLKQVIVEKLGEPAQSYEDFTASIPADECRYAVYDFDFMTAENVQKSRIFFIAWSPDTSRVRSKMIYASSKDRFKRELDGIQIELQATDPTEMGLDVIRSRAS

SEQ ID NO: 2153 - DNA, 540 bp, Populus balsamifera subsp. trichocarpa
  misc_feature (1)..(540): Ceres ANNOT ID no. 1511305
  misc_feature 241287:<222: Transcription Factor
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: INFLORESCENCE - Tall Useful for making taller plants and plants with longer inflorescences
atggcaccataccaaaggagcaaaagccaggcatcaatgaccgtgacggtaagacttgtgaaggaacgaccacagacacgcataccaaacgtgaaagaaaggaaacaaaaaagagaaaaaatggcaaatgcagcgtctgggatggctgtgcatgatgactgcaagctgaagtttttggaattgaaagcaaaaaggactcaccgcttcattgttttcaagattgaggagaagcaaaagcaggtgattgtggagaagcttggtaaaccaactgatagctacgaagacttcactgccagtcttcctgccaatgagtgtcgatatgctgtttatgactttgattatgtaacagacgagaactgccagaagagcaggattgttttcgttgcatggtcccctgacacatctagggtgagaagcaagatgatttatgcgagctccaaggataggtttaagagagagttagatggtattcagatcgagttgcaagctactgatcctacagagatggggctcgatgttattagaagccgttcgtattaa

SEQ ID NO: 2154 - protein, 139 aa, Populus balsamifera subsp. trichocarpa
  misc_feature (1)..(139): Ceres ANNOT ID no. 1511305
  misc_feature (12)..(139): Pfam Name: Cofilin_ADF Pfam Description: Cofilin/tropomyosin-type actin-binding protein
  misc_feature: SWISSPROT Homolog: ADF2_ARATH Actin-depolymerizing factor 2 (ADF-2) (AtADF2) with e-value of 4.9e-42 and BLAST sequence identity of 100.0
  misc_feature: SWISSPROT Homolog: ADF4_ARATH Actin-depolymerizing factor 4 (ADF-4) (AtADF4) with e-value of 2.7e-34 and BLAST sequence identity of 83.7
  misc_feature: SWISSPROT Homolog: ADF1_PETHY Actin-depolymerizing factor 1 (ADF 1) with e-value of 9.1e-34 and BLAST sequence identity of 79.1
  misc_feature: SWISSPROT Homolog: ADF1_ARATH Actin-depolymerizing factor 1 (ADF-1) (AtADF1) with e-value of 1.2e-33 and BLAST sequence identity of 80.2
  misc_feature: SWISSPROT Homolog: ADF2_PETHY Actin-depolymerizing factor 2 (ADF 2) with e-value of 1.0e-32 and BLAST sequence identity of 76.7
  misc_feature 241392:<222: Transcription Factor
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: INFLORESCENCE - Tall Useful for making taller plants and plants with longer inflorescences
  misc_feature (1)..(139): Functional Homolog of  Ceres CLONE ID no. 99657 at SEQ ID NO. 2186 with e-value of 6.29E-32 and BLAST sequence identity of 79.5
MANAASGMAVHDDCKLKFLELKAKRTHRFIVFKIEEKQKQVIVEKLGKPTDSYEDFTASLPANECRYAVYDFDYVTDENCQKSRIVFVAWSPDTSRVRSKMIYASSKDRFKRELDGIQIELQATDPTEMGLDVIRSRSY

SEQ ID NO: 2155 - DNA, 540 bp, Populus balsamifera subsp. trichocarpa; identical to SEQ ID NO: 2153
  misc_feature (1)..(540): Ceres ANNOT ID no. 1511305
  misc_feature 241466:<222: Transcription Factor
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: INFLORESCENCE - Tall Useful for making taller plants and plants with longer inflorescences

SEQ ID NO: 2156 - protein, 139 aa, Populus balsamifera subsp. trichocarpa; identical to SEQ ID NO: 2154
  misc_feature (1)..(139): Ceres ANNOT ID no. 1511305
  misc_feature (12)..(139): Pfam Name: Cofilin_ADF Pfam Description: Cofilin/tropomyosin-type actin-binding protein
  misc_feature: SWISSPROT Homolog: ADF2_ARATH Actin-depolymerizing factor 2 (ADF-2) (AtADF2) with e-value of 4.9e-42 and BLAST sequence identity of 100.0
  misc_feature: SWISSPROT Homolog: ADF4_ARATH Actin-depolymerizing factor 4 (ADF-4) (AtADF4) with e-value of 2.7e-34 and BLAST sequence identity of 83.7
  misc_feature: SWISSPROT Homolog: ADF1_PETHY Actin-depolymerizing factor 1 (ADF 1) with e-value of 9.1e-34 and BLAST sequence identity of 79.1
  misc_feature: SWISSPROT Homolog: ADF1_ARATH Actin-depolymerizing factor 1 (ADF-1) (AtADF1) with e-value of 1.2e-33 and BLAST sequence identity of 80.2
  misc_feature: SWISSPROT Homolog: ADF2_PETHY Actin-depolymerizing factor 2 (ADF 2) with e-value of 1.0e-32 and BLAST sequence identity of 76.7
  misc_feature 241571:<222: Transcription Factor
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: INFLORESCENCE - Tall Useful for making taller plants and plants with longer inflorescences
  misc_feature (1)..(139): Functional Homolog of  Ceres CLONE ID no. 99657 at SEQ ID NO. 2186 with e-value of 6.29E-32 and BLAST sequence identity of 79.5

SEQ ID NO: 2157 - DNA, 399 bp, Populus balsamifera subsp. trichocarpa
  misc_feature (1)..(399): Ceres ANNOT ID no. 1464927
  misc_feature 241645:<222: Transcription Factor
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: INFLORESCENCE - Tall Useful for making taller plants and plants with longer inflorescences
atggctgtgcatgatgactgcaagctgaggtttttggatttgaaggcaaaaaggacttaccgtttcattgttttcaagattgaggagaagcaaaagcaggtgattgtggagaagcttggtgaaccagctgatagctatgaaaatttctctgccagtctgcccgctgatgagtgtcgatatgctgtttatgactttgattatgtaacagaggagaactgccagaagagcaggattgtttttattgcatggtgccctgacacggctagggtgagaagcaagatgatttatgcaagctccaaggacaggtttaagagagaattagatggtattcagattgagctgcaagctactgatcctacagagatggggcttgatgttattagaagccgttcgaattaa

SEQ ID NO: 2158 - protein, 132 aa, Populus balsamifera subsp. trichocarpa
  misc_feature (1)..(132): Ceres ANNOT ID no. 1464927
  misc_feature (5)..(132): Pfam Name: Cofilin_ADF Pfam Description: Cofilin/tropomyosin-type actin-binding protein
  misc_feature: SWISSPROT Homolog: ADF2_ARATH Actin-depolymerizing factor 2 (ADF-2) (AtADF2) with e-value of 4.9e-42 and BLAST sequence identity of 100.0
  misc_feature: SWISSPROT Homolog: ADF4_ARATH Actin-depolymerizing factor 4 (ADF-4) (AtADF4) with e-value of 2.7e-34 and BLAST sequence identity of 83.7
  misc_feature: SWISSPROT Homolog: ADF1_PETHY Actin-depolymerizing factor 1 (ADF 1) with e-value of 9.1e-34 and BLAST sequence identity of 79.1
  misc_feature: SWISSPROT Homolog: ADF1_ARATH Actin-depolymerizing factor 1 (ADF-1) (AtADF1) with e-value of 1.2e-33 and BLAST sequence identity of 80.2
  misc_feature: SWISSPROT Homolog: ADF2_PETHY Actin-depolymerizing factor 2 (ADF 2) with e-value of 1.0e-32 and BLAST sequence identity of 76.7
  misc_feature 241744:<222: Transcription Factor
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: INFLORESCENCE - Tall Useful for making taller plants and plants with longer inflorescences
  misc_feature (1)..(132): Functional Homolog of  Ceres CLONE ID no. 99657 at SEQ ID NO. 2186 with e-value of 7.49E-29 and BLAST sequence identity of 76.3
MAVHDDCKLRFLDLKAKRTYRFIVFKIEEKQKQVIVEKLGEPADSYENFSASLPADECRYAVYDFDYVTEENCQKSRIVFIAWCPDTARVRSKMIYASSKDRFKRELDGIQIELQATDPTEMGLDVIRSRSN

SEQ ID NO: 2159 - DNA, 399 bp, Populus balsamifera subsp. trichocarpa; identical to SEQ ID NO: 2157
  misc_feature (1)..(399): Ceres ANNOT ID no. 1464927
  misc_feature 241818:<222: Transcription Factor
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: INFLORESCENCE - Tall Useful for making taller plants and plants with longer inflorescences

SEQ ID NO: 2160 - protein, 132 aa, Populus balsamifera subsp. trichocarpa; identical to SEQ ID NO: 2158
  misc_feature (1)..(132): Ceres ANNOT ID no. 1464927
  misc_feature (5)..(132): Pfam Name: Cofilin_ADF Pfam Description: Cofilin/tropomyosin-type actin-binding protein
  misc_feature: SWISSPROT Homolog: ADF2_ARATH Actin-depolymerizing factor 2 (ADF-2) (AtADF2) with e-value of 4.9e-42 and BLAST sequence identity of 100.0
  misc_feature: SWISSPROT Homolog: ADF4_ARATH Actin-depolymerizing factor 4 (ADF-4) (AtADF4) with e-value of 2.7e-34 and BLAST sequence identity of 83.7
  misc_feature: SWISSPROT Homolog: ADF1_PETHY Actin-depolymerizing factor 1 (ADF 1) with e-value of 9.1e-34 and BLAST sequence identity of 79.1
  misc_feature: SWISSPROT Homolog: ADF1_ARATH Actin-depolymerizing factor 1 (ADF-1) (AtADF1) with e-value of 1.2e-33 and BLAST sequence identity of 80.2
  misc_feature: SWISSPROT Homolog: ADF2_PETHY Actin-depolymerizing factor 2 (ADF 2) with e-value of 1.0e-32 and BLAST sequence identity of 76.7
  misc_feature 241917:<222: Transcription Factor
  misc_feature: Phenotype: INFLORESCENCE - Late Flowering Useful for modulating flowering time
  misc_feature: Phenotype: WHOLE PLANT - Late Senescence Useful for delaying senescence
  misc_feature: Phenotype: INFLORESCENCE - Tall Useful for making taller plants and plants with longer inflorescences
  misc_feature (1)..(132): Functional Homolog of  Ceres CLONE ID no. 99657 at SEQ ID NO. 2186 with e-value of 7.49E-29 and BLAST sequence identity of 76.3

SEQ ID NO: 2161 - protein, 378 aa, Arabidopsis thaliana
  misc_feature (1)..(378): Ceres CLONE ID no. 99784
  misc_feature (107)..(355): Pfam Name: Methyltransf_2 Pfam Description: O-methyltransferase
  misc_feature (40)..(99): Pfam Name: Dimerisation Pfam Description: Dimerisation domain
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature: Phenotype: SILIQUES - Short Useful for increasing seed/fruit yield or modifying fruit content
  misc_feature (328)..(328): Xaa is any aa, unknown, or other
MANHLQVPLTKPDRVKEEQEVEEEARLLARRLANAAALPMVLKAALELGVIDTITTVGGGDLWLSPSEIALRLPTKPCNLEAPVLLDRMLRFLVSHSVLKCRTVIEENGQTGKVERVYAAEPVCKYLLNKSDDVSGSFASLFMLDLSDVFIKTWTHLKDVILAGRDAFSSAHGMKLFEYIQADERFGKVFNRAMLESSTMVTEKVLKFYEGFKDVKTLVDVGGGLGNTLGLITSKYPHLIGINFDLAPVLANAHSYPGVNHVAGDMFIKIPKGDAIFMKWILHDWTDEQCVAILKNCWKSLEENGKLIIVEMVTPVEAKSGDICSNIXFGMDMTMLTQCSGGKERSLYEFENLAYASGFSRCAIVCAVYPFSVIEIYK

SEQ ID NO: 2162 - DNA, 1095 bp, Populus balsamifera subsp. trichocarpa
  misc_feature (1)..(1095): Ceres ANNOT ID no. 1521032
  misc_feature 242130:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature: Phenotype: SILIQUES - Short Useful for increasing seed/fruit yield or modifying fruit content
atgggttcgacaggtgaaactcagatgactccaactcaggtatcagatgaagaggcacacctctttgccatgcaactagccagtgcttcagttctaccaatgatcctcaaaacagccattgaactcgaccttcttgaaatcatggctaaagctggccctggtgctttcttgtccacatctgagatagcttctcacctccctaccaaaaaccctgatgcgcctgtcatgttagaccgtatcttgcgcctcctggctagctactccattcttacttgctctctgaaagatcttcctgatgggaaagttgagagactgtatggccttgctcctgtttgcaaattcttgaccaagaacgaggatggtgtctctgtcagccctctctgtctcatgaaccaggacaaggtcctcatggaaagctggtattatttgaaagatgcaattcttgatggaggaattccatttaacaaggcctatgggatgactgcatttgaatatcatggcacggatccaagattcaacaaggtgttcaataagggaatgtctgaccactctaccattaccatgaagaagcttcttgagacctacaaaggctttgaaggcctcacatccttggtggatgttggtggtgggactggagctgtcgttaacaccatcgtctctaaatacccttcaattaagggcattaactttgatctgccccacgtcattgaggatgccccatcttatcccggtgtggagcatgttggtggggacatgtttgttagtgtgcccaaagcagatgccgttttcatgaagtggatatgccatgattggagcgacgcacactgcttaaaattcttgaagaattgctatgacgccttgccggaaaacggcaaggtgatacttgttgagtgcattcttcccgtggctcctgacacaagccttgccaccaagggagtcgtgcacattgatgttatcatgctggcgcacaaccccggtgggaaagagaggaccgaaaaggaatttgagggcttagcaaagggagctggctttcaaggttttgaagtaatgtgctgtgcattcaacacacatgtcattgaattccgcaagaactaa

SEQ ID NO: 2163 - protein, 356 aa, Populus balsamifera subsp. trichocarpa
  misc_feature (1)..(356): Ceres ANNOT ID no. 1521032
  misc_feature (26)..(82): Pfam Name: Dimerisation Pfam Description: Dimerisation domain
  misc_feature (86)..(332): Pfam Name: Methyltransf_2 Pfam Description: O-methyltransferase
  misc_feature: SWISSPROT Homolog: COMT1_CATRO Caffeic acid 3-O-methyltransferase with e-value of 1.2e-86 and BLAST sequence identity of 48.2
  misc_feature: SWISSPROT Homolog: COMT1_CATRO EC 2.1.1.68 S-adenosysl-L-methionine:caffeic acid 3-O-methyltransferase COMT (CAOMT)
  misc_feature: SWISSPROT Homolog: OMT1_ARATH Quercetin 3-O-methyltransferase 1 (EC 2.1.1.76) (AtOMT1) with e-value of 4.7e-85 and BLAST sequence identity of 49.2
  misc_feature: SWISSPROT Homolog: OMT1_ARATH Flavonol 3-O-methyltransferase 1 Caffeic acid/5-hydroxyferulic acid O-methyltransferase
  misc_feature: SWISSPROT Homolog: COMT1_PRUDU Caffeic acid 3-O-methyltransferase (EC 2.1.1.68)(COMT) (CAOMT) (S-adenosysl-L-methionine:caffeic acid 3-O-methyltransferase) with e-value of 3.3e-84 and BLAST sequence identity of 47.5
  misc_feature: SWISSPROT Homolog: COMT1_ROSCH Caffeic acid 3-O-methyltransferase (EC 2.1.1.68) (S-adenosysl-L-methionine:caffeic acid 3-O-methyltransferase) with e-value of 4.2e-84 and BLAST sequence identity of 47.5
  misc_feature: SWISSPROT Homolog: COMT1_CAPAN Caffeic acid 3-O-methyltransferase (EC 2.1.1.68) (S-adenosysl-L-methionine:caffeic acid 3-O-methyltransferase) with e-value of 4.8e-83 and BLAST sequence identity of 47.1
  misc_feature 242288:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature: Phenotype: SILIQUES - Short Useful for increasing seed/fruit yield or modifying fruit content
  misc_feature (1)..(356): Functional Homolog of  Ceres CLONE ID no. 99784 at SEQ ID NO. 2205 with e-value of 2.29E-82 and BLAST sequence identity of 48.4
MTPTQVSDEEAHLFAMQLASASVLPMILKTAIELDLLEIMAKAGPGAFLSTSEIASHLPTKNPDAPVMLDRILRLLASYSILTCSLKDLPDGKVERLYGLAPVCKFLTKNEDGVSVSPLCLMNQDKVLMESWYYLKDAILDGGIPFNKAYGMTAFEYHGTDPRFNKVFNKGMSDHSTITMKKLLETYKGFEGLTSLVDVGGGTGAVVNTIVSKYPSIKGINFDLPHVIEDAPSYPGVEHVGGDMFVSVPKADAVFMKWICHDWSDAHCLKFLKNCYDALPENGKVILVECILPVAPDTSLATKGVVHIDVIMLAHNPGGKERTEKEFEGLAKGAGFQGFEVMCCAFNTHVIEFRKN

SEQ ID NO: 2164 - DNA, 1095 bp, Populus balsamifera subsp. trichocarpa
  misc_feature (1)..(1095): Ceres ANNOT ID no. 1472909
  misc_feature 242418:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature: Phenotype: SILIQUES - Short Useful for increasing seed/fruit yield or modifying fruit content
atgggttcaacaggtgaaactcagatgtctccagctcagatattagatgaagaagcgaattttgccatgcaactgatcagttcttcagtgctacctatggtcctcaaaacagccattgaacttgaccttcttgaaatcatggctaaagctggccctggtgctctcttgtccccatccgatatagcttctcatctccctaccaaaaaccctgatgcacctgtcatgttagatcgtatcttgcgccttctggctagttactccattcttatttgctctctaagagatcttcctgatgggaaagttgagagactctatggtcttgcttctgtttgtaagttcttgaccaagaatgaagatggtgtctctgttagccctctctgtctcatgaaccaggacaaggtcctcatggaaagttggtatcatttgaaagacgcgattcttgaaggaggaattccatttaacaaggcctatggaatgactgcatttgaatatcatggcacggatccaagattcaacaaggttttcaacaagggaatgtctgaccattctaaaattgccatgaagaagattcttgagacctacaaaggctttgaaggcctcgcatccttggtggatgttggtggcgggactggtgctgtgcttagcacaatcgtctccaagtacccttcaattaagggcatcaactttgatttgcctcatgtcattgcggatgccccagctttccctggtgtggagaatgttggtggtgacatgtttgttagtgtgcccaaagcagatgctgttttcatgaagtggatatgtcatgattggagcgatgaacactgcttaagattcttgaagaactgctatgatgcgctgccggaaaacgggaaagtgatccttgttgaatgcattctccctgtggctcctgacacaagtcttgccaccaagggagtcatgcacgttgatgccataatgctggcacataaccccggaggaaaagagaggaccgaaaaggaatttgagggcttggccaggggagctggcttcaagggtttcgaagtgatgtgctgtgcattcaatacgtacgtgattgaattccgcaagcaggcctaa

SEQ ID NO: 2165 - protein, 364 aa, Populus balsamifera subsp. trichocarpa
  misc_feature (1)..(364): Ceres ANNOT ID no. 1472909
  misc_feature (33)..(89): Pfam Name: Dimerisation Pfam Description: Dimerisation domain
  misc_feature (93)..(339): Pfam Name: Methyltransf_2 Pfam Description: O-methyltransferase
  misc_feature: SWISSPROT Homolog: COMT1_CATRO Caffeic acid 3-O-methyltransferase with e-value of 1.2e-86 and BLAST sequence identity of 48.2
  misc_feature: SWISSPROT Homolog: COMT1_CATRO EC 2.1.1.68 S-adenosysl-L-methionine:caffeic acid 3-O-methyltransferase COMT (CAOMT)
  misc_feature: SWISSPROT Homolog: OMT1_ARATH Quercetin 3-O-methyltransferase 1 (EC 2.1.1.76) (AtOMT1) with e-value of 4.7e-85 and BLAST sequence identity of 49.2
  misc_feature: SWISSPROT Homolog: OMT1_ARATH Flavonol 3-O-methyltransferase 1 Caffeic acid/5-hydroxyferulic acid O-methyltransferase
  misc_feature: SWISSPROT Homolog: COMT1_PRUDU Caffeic acid 3-O-methyltransferase (EC 2.1.1.68) (S-adenosysl-L-methionine:caffeic acid 3-O-methyltransferase) with e-value of 3.3e-84 and BLAST sequence identity of 47.5
  misc_feature: SWISSPROT Homolog: COMT1_ROSCH Caffeic acid 3-O-methyltransferase (EC 2.1.1.68) (S-adenosysl-L-methionine:caffeic acid 3-O-methyltransferase) with e-value of 4.2e-84 and BLAST sequence identity of 47.5
  misc_feature: SWISSPROT Homolog: COMT1_CAPAN Caffeic acid 3-O-methyltransferase (EC 2.1.1.68) (S-adenosysl-L-methionine:caffeic acid 3-O-methyltransferase) with e-value of 4.8e-83 and BLAST sequence identity of 47.1
  misc_feature 242576:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature: Phenotype: SILIQUES - Short Useful for increasing seed/fruit yield or modifying fruit content
  misc_feature (1)..(364): Functional Homolog of  Ceres CLONE ID no. 99784 at SEQ ID NO. 2205 with e-value of 2.99E-80 and BLAST sequence identity of 47.0
MGSTGETQMSPAQILDEEANFAMQLISSSVLPMVLKTAIELDLLEIMAKAGPGALLSPSDIASHLPTKNPDAPVMLDRILRLLASYSILICSLRDLPDGKVERLYGLASVCKFLTKNEDGVSVSPLCLMNQDKVLMESWYHLKDAILEGGIPFNKAYGMTAFEYHGTDPRFNKVFNKGMSDHSKIAMKKILETYKGFEGLASLVDVGGGTGAVLSTIVSKYPSIKGINFDLPHVIADAPAFPGVENVGGDMFVSVPKADAVFMKWICHDWSDEHCLRFLKNCYDALPENGKVILVECILPVAPDTSLATKGVMHVDAIMLAHNPGGKERTEKEFEGLARGAGFKGFEVMCCAFNTYVIEFRKQA

SEQ ID NO: 2166 - DNA, 1212 bp, Populus balsamifera subsp. trichocarpa
  misc_feature (1)..(1212): Ceres ANNOT ID no. 1467665
  misc_feature 242706:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature: Phenotype: SILIQUES - Short Useful for increasing seed/fruit yield or modifying fruit content
atgggttcgacaggtgaaactcagatgactccaactcaggtatcagatgaagaggcacacctctttgccatgcaactagccagtgcttcagttctaccaatgatcctcaaaacagccattgaactcgaccttcttgaaatcatggctaaagctggccctggtgctttcttgtccacatctgagatagcttctcacctccctaccaaaaaccctgatgcgcctgtcatgttagaccgtatcttgcgcctcctggctagctactccattcttacttgctctctgaaagatcttcctgatgggaaagttgagagactgtatggccttgctcctgtttgcaaattcttgaccaagaacgaggatggtgtctctgtcagccctctctgtctcatgaaccaggacaaggtcctcatggaaagctggtattatttgaaagatgcaattcttgatggaggaattccatttaacaaggcctatgggatgactgcatttgaatatcatggcacggatccaagattcaacaaggtgttcaataagggaatgtctgaccactctaccattaccatgaagaagcttcttgagacctacaaaggctttgaaggcctcacatccttggtggatgttggtggtgggactggagctgtcgttaacaccatcgtctctaaatacccttcaattaagggcattaactttgatctgccccacgtcattgaggatgccccatcttatcccggtgtggagcatgttggtggggacatgtttgttagtgtgcccaaagcagatgccgttttcatgaagtggatatgccatgattggagcgacgcacactgcttaaaattcttgaagaattgctatgacgccttgccggaaaacggcaaggtgatacttgttgagtgcattcttcccgtggctcctgacacaagccttgccaccaagggagtcgtgcacattgatgttatcatgctggcgcacaaccccggtgggaaagagaggaccgaaaaggaatttgagggcttagcaaagggagctggctttcaaggtaccttctcaaccttcccttctcaagatgcaattcttgaaggaggcattccattcaacaaggcccatggaatggctgtatttgaatactttggcatggatccaatactcatcaaggttttcaatgagggaatgtcagaccactctaccattacctgcatgcagaagattctttag

SEQ ID NO: 2167 - protein, 395 aa, Populus balsamifera subsp. trichocarpa
  misc_feature (1)..(395): Ceres ANNOT ID no. 1467665
  misc_feature (26)..(82): Pfam Name: Dimerisation Pfam Description: Dimerisation domain
  misc_feature (347)..(389): Pfam Name: Methyltransf_2 Pfam Description: O-methyltransferase
  misc_feature: SWISSPROT Homolog: COMT1_CATRO Caffeic acid 3-O-methyltransferase with e-value of 1.2e-86 and BLAST sequence identity of 48.2
  misc_feature: SWISSPROT Homolog: COMT1_CATRO EC 2.1.1.68 S-adenosysl-L-methionine:caffeic acid 3-O-methyltransferase COMT (CAOMT)
  misc_feature: SWISSPROT Homolog: OMT1_ARATH Quercetin 3-O-methyltransferase 1 (EC 2.1.1.76) (AtOMT1) with e-value of 4.7e-85 and BLAST sequence identity of 49.2
  misc_feature: SWISSPROT Homolog: OMT1_ARATH Flavonol 3-O-methyltransferase 1 Caffeic acid/5-hydroxyferulic acid O-methyltransferase
  misc_feature: SWISSPROT Homolog: COMT1_PRUDU Caffeic acid 3-O-methyltransferase (EC 2.1.1.68) (S-adenosysl-L-methionine:caffeic acid 3-O-methyltransferase) with e-value of 3.3e-84 and BLAST sequence identity of 47.5
  misc_feature: SWISSPROT Homolog: COMT1_ROSCH Caffeic acid 3-O-methyltransferase (EC 2.1.1.68) (S-adenosysl-L-methionine:caffeic acid 3-O-methyltransferase) with e-value of 4.2e-84 and BLAST sequence identity of 47.5
  misc_feature: SWISSPROT Homolog: COMT1_CAPAN Caffeic acid 3-O-methyltransferase (EC 2.1.1.68) (S-adenosysl-L-methionine:caffeic acid 3-O-methyltransferase) with e-value of 4.8e-83 and BLAST sequence identity of 47.1
  misc_feature 242868:<222: Transcription Factor
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature: Phenotype: SILIQUES - Short Useful for increasing seed/fruit yield or modifying fruit content
  misc_feature (1)..(395): Functional Homolog of  Ceres CLONE ID no. 99784 at SEQ ID NO. 2205 with e-value of 4.90E-80 and BLAST sequence identity of 49.6
MTPTQVSDEEAHLFAMQLASASVLPMILKTAIELDLLEIMAKAGPGAFLSTSEIASHLPTKNPDAPVMLDRILRLLASYSILTCSLKDLPDGKVERLYGLAPVCKFLTKNEDGVSVSPLCLMNQDKVLMESWYYLKDAILDGGIPFNKAYGMTAFEYHGTDPRFNKVFNKGMSDHSTITMKKLLETYKGFEGLTSLVDVGGGTGAVVNTIVSKYPSIKGINFDLPHVIEDAPSYPGVEHVGGDMFVSVPKADAVFMKWICHDWSDAHCLKFLKNCYDALPENGKVILVECILPVAPDTSLATKGVVHIDVIMLAHNPGGKERTEKEFEGLAKGAGFQGTFSTFPSQDAILEGGIPFNKAHGMAVFEYFGMDPILIKVFNEGMSDHSTITCMQKIL

SEQ ID NO: 2168 - protein, 119 aa, Arabidopsis thaliana
  misc_feature (1)..(119): Ceres CLONE ID no. 99920
  misc_feature (10)..(102): Pfam Name: Auxin_inducible Pfam Description: Auxin responsive protein
  misc_feature: Utility: ABA Useful for making plants with enhanced tolerance to drought
  misc_feature: Utility: Mannitol Useful for making plants with enhanced tolerance to drought
  misc_feature: Utility: Soil Drought Useful for making plants with increased tolerance to drought
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - Soil Drought Useful for making plants with increased tolerance to drought
MAKVGKLTKLKSAMKKWPSFAKNHHHSTSSAAVSDELSEDNNLHVVYVGQTRRPYMLRPDIISHPLFQELVDRSSSRSIEQDREIVVACEVVLFEHLLWMLKSGQEGGSVEELAEFYTY

SEQ ID NO: 2169 - DNA, 381 bp, Populus balsamifera subsp. trichocarpa
  misc_feature (1)..(381): Ceres ANNOT ID no. 1446695
  misc_feature: Utility: ABA Useful for making plants with enhanced tolerance to drought
  misc_feature: Utility: Mannitol Useful for making plants with enhanced tolerance to drought
  misc_feature: Utility: Soil Drought Useful for making plants with increased tolerance to drought
  misc_feature 243106:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - Soil Drought Useful for making plants with increased tolerance to drought
atggcaaagacttccaagttgacaaagctcaagtctgccataaagaggttgccatctttcaccaagatagtccgcacaaatagctccattgctgctgctgacaacgatcacatcgatggcaagatttcaaaggaacttcatgcagtctatgttggaaagtcaaggaggagatatctcttgagctccgatgtcatttgtcatcctctttttcaagggctaatagacaggtcaggcgctggttttggtgatgaggataatcaagcagttgttgttgcttgtgaggttgtcttgtttgagcacttgctgtggatgattgagagtggtggctctgatcagttggggtccatggaggagcttgctgaattctattacacttgctga

SEQ ID NO: 2170 - protein, 126 aa, Populus balsamifera subsp. trichocarpa
  misc_feature (1)..(126): Ceres ANNOT ID no. 1446695
  misc_feature (1)..(106): Pfam Name: Auxin_inducible Pfam Description: Auxin responsive protein
  misc_feature: Utility: ABA Useful for making plants with enhanced tolerance to drought
  misc_feature: Utility: Mannitol Useful for making plants with enhanced tolerance to drought
  misc_feature: Utility: Soil Drought Useful for making plants with increased tolerance to drought
  misc_feature 243183:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - Soil Drought Useful for making plants with increased tolerance to drought
  misc_feature (1)..(126): Functional Homolog of  Ceres CLONE ID no. 99920 at SEQ ID NO. 2212 with e-value of 2.50E-28 and BLAST sequence identity of 58.1
MAKTSKLTKLKSAIKRLPSFTKIVRTNSSIAAADNDHIDGKISKELHAVYVGKSRRRYLLSSDVICHPLFQGLIDRSGAGFGDEDNQAVVVACEVVLFEHLLWMIESGGSDQLGSMEELAEFYYTC

SEQ ID NO: 2171 - DNA, 408 bp, Populus balsamifera subsp. trichocarpa
  misc_feature (1)..(408): Ceres ANNOT ID no. 1481700
  misc_feature: Utility: ABA Useful for making plants with enhanced tolerance to drought
  misc_feature: Utility: Mannitol Useful for making plants with enhanced tolerance to drought
  misc_feature: Utility: Soil Drought Useful for making plants with increased tolerance to drought
  misc_feature 243272:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - Soil Drought Useful for making plants with increased tolerance to drought
atggaaaagttttccaagttaacaaagctcaagtccgccataaagagattgccatctttcaccaagataggccgcacaaatagctccattgctgcttttaacaacgatcatgatcagtatgatcagtctgatgatcacgtcgatggcaagatttcaaatggacttcatgcagtttatgttggaaagtcaaggaggaggtatcttgtacgttccgatgtcatttgtcatcctcttttccaaggtttaatggacaggtcaggcgctggttctggtgatgaagaagataatcaagtagttgttgttgcttgtgaggttgttttgtttgagcacttgttgtggatgcttgagagtggtggctctcagttggggtccatggaggagcttgctgagttctattacacttgctga

SEQ ID NO: 2172 - protein, 135 aa, Populus balsamifera subsp. trichocarpa
  misc_feature (1)..(135): Ceres ANNOT ID no. 1481700
  misc_feature (57)..(86): Pfam Name: Auxin_inducible Pfam Description: Auxin responsive protein
  misc_feature: Utility: ABA Useful for making plants with enhanced tolerance to drought
  misc_feature: Utility: Mannitol Useful for making plants with enhanced tolerance to drought
  misc_feature: Utility: Soil Drought Useful for making plants with increased tolerance to drought
  misc_feature 243349:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - Soil Drought Useful for making plants with increased tolerance to drought
  misc_feature (1)..(135): Functional Homolog of  Ceres CLONE ID no. 99920 at SEQ ID NO. 2212 with e-value of 1.10E-27 and BLAST sequence identity of 61.5
MEKFSKLTKLKSAIKRLPSFTKIGRTNSSIAAFNNDHDQYDQSDDHVDGKISNGLHAVYVGKSRRRYLVRSDVICHPLFQGLMDRSGAGSGDEEDNQVVVVACEVVLFEHLLWMLESGGSQLGSMEELAEFYYTC

SEQ ID NO: 2173 - protein, 389 aa, Arabidopsis thaliana
  misc_feature (1)..(389): Ceres CLONE ID no. 100047
  misc_feature (203)..(346): Pfam Name: ADH_zinc_N Pfam Description: Zinc-binding dehydrogenase
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
MEKTSMFSIHEGKPIRCKAAVSRKPGEALVIEEIHVDPPQAYEVRIKIICTSLCHTDVSFSKIDSGPLARFPRILGHEAVGVIESIGEHVNGFQQGDIVLPVFHPHCEECRDCKSSKSNWCARFADDFLSNTRRYGMTSRFKDSFGEDIYHFLFVSSFSEYTVVDIAHLVKISPDIPVDKAALLSCGVSTGIGAAWKVANVEKGSTVAVFGLGAVGLAVGEGARLRGAGKIIGVDLNPEKFELGKKFGFTSFINPTLCGEKKISEVIKEMTGGGVDYSFECVGLPSLLTEAFSSTRTGSGKTVVLGIDKHLTPVSLGSFDLLRGRHVCGSLFGGLKPKLDIPILVDHYLKKELNLDSFITHELKFEEINKAFDLLVQGKSLRCILWMNK

SEQ ID NO: 2174 - DNA, 1134 bp, Populus balsamifera subsp. trichocarpa
  misc_feature (1)..(1134): Ceres ANNOT ID no. 1532164
  misc_feature 243554:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
atgtcaaagagcagcagctcacaggtgataacatgcaaagcggcagtatgctggggagtaggggagccattgaaggtggaagagatacaggtggagccaccgaagttttctgagattcgtgtgaaggtgttatgtgctagtttatgccatactgataccttatatgccaaaggatccctgattcctcttttccctcgagtcctaggccatgaaggagttggagtggtggaaagcataggtgaaggagtaagagatcttaaagaaggagaccttgtgattccagcctaccttggagagtgccaagaatgtgagaattgcacctctgggaagaccaatttatgcttgaagtacccgttaatcctcaatgggctaatgcctgatggcacttcaagaatgtccattaatggacaaaaattgtatcaccttattacatgttcaacatggtctgaatacatggtgattgataccaattacgttgtcaagattgatccaagcatagatcttcctcatgcaagcttcctttcatgtgggttctcaactggatttgggtcagcctggagggaagctaatgttgagaagggatcaagtgttgctgtcattggtctaggtgctgttggattaggggccatagagggagctagaatgcaaggggcagcgaaaataatcggaatagacaagaatgaaaagaaaagagagaaagggcaagcctttggaatgaccgattttataaacccagatgaatacttcaacaaacctatttcagaactgataaaagacataacaggtggattgggtgtggattactgctttgagtgcaccggtgtcggacccttgattaacgaagccctcctggcaacaaaaccagggaaaggagaaacatttgtagttggtgctggagctgatctaactgtgtccatcgacttcctacctctaatttgtggtggaaatttgaagggttctattttcggggggctccaaattaaatcccatctccccattttacttgacaaaagcaaaaataaggaattcaatctggatgaacttttgacccatcaagttatgttggaagacataaacaaagcttttcaactactgaagcaagaagactgtgtcaagatccttatcaagatgtaa

SEQ ID NO: 2175 - protein, 377 aa, Populus balsamifera subsp. trichocarpa
  misc_feature (1)..(377): Ceres ANNOT ID no. 1532164
  misc_feature (193)..(336): Pfam Name: ADH_zinc_N Pfam Description: Zinc-binding dehydrogenase
  misc_feature: SWISSPROT Homolog: ADH1_PETHY Alcohol dehydrogenase 1 (EC 1.1.1.1) with e-value of 2.5e-95 and BLAST sequence identity of 51.5
  misc_feature: SWISSPROT Homolog: ADH1_PENAM Alcohol dehydrogenase 1 (EC 1.1.1.1) (ADH slow-allele) with e-value of 4.1e-93 and BLAST sequence identity of 50.5
  misc_feature: SWISSPROT Homolog: ADH_MALDO Alcohol dehydrogenase (EC 1.1.1.1) with e-value of 8.6e-93 and BLAST sequence identity of 51.2
  misc_feature: SWISSPROT Homolog: ADH1_MAIZE Alcohol dehydrogenase 1 (EC 1.1.1.1) with e-value of 1.1e-92 and BLAST sequence identity of 50.8
  misc_feature: SWISSPROT Homolog: ADH1_ARATH Alcohol dehydrogenase (EC 1.1.1.1) with e-value of 2.9e-92 and BLAST sequence identity of 50.1
  misc_feature 243691:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature (1)..(377): Functional Homolog of  Ceres CLONE ID no. 100047 at SEQ ID NO. 2217 with e-value of 4.70E-91 and BLAST sequence identity of 50.1
MSKSSSSQVITCKAAVCWGVGEPLKVEEIQVEPPKFSEIRVKVLCASLCHTDTLYAKGSLIPLFPRVLGHEGVGVVESIGEGVRDLKEGDLVIPAYLGECQECENCTSGKTNLCLKYPLILNGLMPDGTSRMSINGQKLYHLITCSTWSEYMVIDTNYVVKIDPSIDLPHASFLSCGFSTGFGSAWREANVEKGSSVAVIGLGAVGLGAIEGARMQGAAKIIGIDKNEKKREKGQAFGMTDFINPDEYFNKPISELIKDITGGLGVDYCFECTGVGPLINEALLATKPGKGETFVVGAGADLTVSIDFLPLICGGNLKGSIFGGLQIKSHLPILLDKSKNKEFNLDELLTHQVMLEDINKAFQLLKQEDCVKILIKM

SEQ ID NO: 2176 - DNA, 1137 bp, Populus balsamifera subsp. trichocarpa
  misc_feature (1)..(1137): Ceres ANNOT ID no. 1479341
  misc_feature 243824:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
atgtcaaagagccgcagctcacagattataacatgtaaagcggcagtaatatggggaagtggggagccattgaaggttgaagagatacaaatagaaccgccaaaatcgactgaagttcgagtgaggatgctatatgcaagcgtgtgtcacactgatatcttacttgccaaacgcaaaggagatcccgttccaccttttcctcgagtcctgggccacgaaggcgttggaacggtggagagctttggggatgaagtcaatggtcttgaagaaggagattatgtgataccaacaatgttagcagagtgtgaagcctgcgagaattgtacatcagcgaacaccaatttatgcctgacataccctttaagccgtagtggtctaatgttagatggcacttcaagaatgtccatcaaagggcagaagttgtatcacatgtttacttgctccacttggtccgaatacatggttattgattccaattatgtaaacaagatcgatccaagcatacctctgcctcatgccagtgttttatcatgtggattttcaactggatttggagcagcttggaaggaagctcaggttaaaatgggatcaactgtggctgttttaggccttggtgctgttggactcggggtcacagaaggagctcgaatgctaggggcagctaagataatcggcgttgataagaatagcatgaaaaaagacaaggggctagcttttggaatgaccgatttcattaaccctgatgagtgttcggataaatctatttcgcaaatgataaaagacctgactggtggaatgggagtggattattgctttgagtgcgttggtgccgagtccttgattaatcaagccatccaagccacaaaagagggaaaaggaaaagcaattgttataggcggaggaatcaacagcgtaaagatcgattatgctcctcttttgagtggaagaaccctaaaggggtccgtttttggagggctcaaagtaaaatctgaccttcccatcctcatggagaaatgcaaaaataaggaattcgatcttgatgaactcttgactcatgaagttacattacaagatatcgagaaagcatttgagctgttaaagcaaccagattgcgtgaaggtgctcatcaagatttga

SEQ ID NO: 2177 - protein, 378 aa, Populus balsamifera subsp. trichocarpa
  misc_feature (1)..(378): Ceres ANNOT ID no. 1479341
  misc_feature (195)..(341): Pfam Name: ADH_zinc_N Pfam Description: Zinc-binding dehydrogenase
  misc_feature: SWISSPROT Homolog: ADH1_PETHY Alcohol dehydrogenase 1 (EC 1.1.1.1) with e-value of 2.5e-95 and BLAST sequence identity of 51.5
  misc_feature: SWISSPROT Homolog: ADH1_PENAM Alcohol dehydrogenase 1 (EC 1.1.1.1) (ADH slow-allele) with e-value of 4.1e-93 and BLAST sequence identity of 50.5
  misc_feature: SWISSPROT Homolog: ADH_MALDO Alcohol dehydrogenase (EC 1.1.1.1) with e-value of 8.6e-93 and BLAST sequence identity of 51.2
  misc_feature: SWISSPROT Homolog: ADH1_MAIZE Alcohol dehydrogenase 1 (EC 1.1.1.1) with e-value of 1.1e-92 and BLAST sequence identity of 50.8
  misc_feature: SWISSPROT Homolog: ADH1_ARATH Alcohol dehydrogenase (EC 1.1.1.1) with e-value of 2.9e-92 and BLAST sequence identity of 50.1
  misc_feature 243961:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature (1)..(378): Functional Homolog of  Ceres CLONE ID no. 100047 at SEQ ID NO. 2217 with e-value of 4.80E-89 and BLAST sequence identity of 48.6
MSKSRSSQIITCKAAVIWGSGEPLKVEEIQIEPPKSTEVRVRMLYASVCHTDILLAKRKGDPVPPFPRVLGHEGVGTVESFGDEVNGLEEGDYVIPTMLAECEACENCTSANTNLCLTYPLSRSGLMLDGTSRMSIKGQKLYHMFTCSTWSEYMVIDSNYVNKIDPSIPLPHASVLSCGFSTGFGAAWKEAQVKMGSTVAVLGLGAVGLGVTEGARMLGAAKIIGVDKNSMKKDKGLAFGMTDFINPDECSDKSISQMIKDLTGGMGVDYCFECVGAESLINQAIQATKEGKGKAIVIGGGINSVKIDYAPLLSGRTLKGSVFGGLKVKSDLPILMEKCKNKEFDLDELLTHEVTLQDIEKAFELLKQPDCVKVLIKI

SEQ ID NO: 2178 - DNA, 1170 bp, Populus balsamifera subsp. trichocarpa
  misc_feature (1)..(1170): Ceres ANNOT ID no. 1479350
  misc_feature 244094:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
atgtcaaagagccgcagctcacagattataacatgtaaagtcgttaacttgccatctgggcttcttctgacagcggcagtaatatggggaagtggggagccattgaaggttgaagagatacaaatagaaccaccaaaatcaactgaagttcgagtgaggatgctatatgcaagcgtgtgtcacactgatgtcttacgtgccagacgcaaaggagatcctgttccactttttcctcgagtcctgggccacgaaggcgttggaatggtggagagcttcggggatgaagtcaatggtcttgaagaaggagattatgtgataccaacaatgatagcagagtgtgaagcctgcgagaattgtacatcagcgaacactaatttatgcctgacataccctttaagccgtagtggtctaatgttagatggcacttcaagaatgtccatcaacgggcagaagttgtatcacatgtttacctgctccacttggtccgaatacatggttattgattccaattatgtaaacaagatcgatccaagcatacctctgcctcatgccagtgttttatcatgtggattttctactggatttggagcagcttggaaggaagctcaggttaaaatgggatcaactgtggctgttttaggccttggtgctgttggactcggggtcacagaaggagctcgaatgctaggggcagctaagataatcggcgttgataagaatagcatgaaaaaagacaaggggctagcttttggaatgaccgatttcattaaccctgatgagtgttcggataaatctatttcgcaaatgataaaagacctgactggtggaatgggagtggattattgctttgagtgcgttggtgccgagtccttgattaatcaagccatccaagccacaaaagagggaaaaggaaaaacaattgttataggcggaggaatcagcagcgtaaagatcgattaccttcctctgttgagtggaagaaccctaaaggggtccctttttggagggctcaaagtaaaatctgaccttcccatcctctttcagaaatgcaaaaataaggaattcgatcttgatgaactcttgactcatgaagttacattacaagatatcgagaaagcatttgagctgttaaatcaaccagattgtgtgaaggtgctcatcaagatttga

SEQ ID NO: 2179 - protein, 389 aa, Populus balsamifera subsp. trichocarpa
  misc_feature (1)..(389): Ceres ANNOT ID no. 1479350
  misc_feature (206)..(348): Pfam Name: ADH_zinc_N Pfam Description: Zinc-binding dehydrogenase
  misc_feature: SWISSPROT Homolog: ADH1_PETHY Alcohol dehydrogenase 1 (EC 1.1.1.1) with e-value of 2.5e-95 and BLAST sequence identity of 51.5
  misc_feature: SWISSPROT Homolog: ADH1_PENAM Alcohol dehydrogenase 1 (EC 1.1.1.1) (ADH slow-allele) with e-value of 4.1e-93 and BLAST sequence identity of 50.5
  misc_feature: SWISSPROT Homolog: ADH_MALDO Alcohol dehydrogenase (EC 1.1.1.1) with e-value of 8.6e-93 and BLAST sequence identity of 51.2
  misc_feature: SWISSPROT Homolog: ADH1_MAIZE Alcohol dehydrogenase 1 (EC 1.1.1.1) with e-value of 1.1e-92 and BLAST sequence identity of 50.8
  misc_feature: SWISSPROT Homolog: ADH1_ARATH Alcohol dehydrogenase (EC 1.1.1.1) with e-value of 2.9e-92 and BLAST sequence identity of 50.1
  misc_feature 244233:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature (1)..(389): Functional Homolog of  Ceres CLONE ID no. 100047 at SEQ ID NO. 2217 with e-value of 1.49E-87 and BLAST sequence identity of 48.8
MSKSRSSQIITCKVVNLPSGLLLTAAVIWGSGEPLKVEEIQIEPPKSTEVRVRMLYASVCHTDVLRARRKGDPVPLFPRVLGHEGVGMVESFGDEVNGLEEGDYVIPTMIAECEACENCTSANTNLCLTYPLSRSGLMLDGTSRMSINGQKLYHMFTCSTWSEYMVIDSNYVNKIDPSIPLPHASVLSCGFSTGFGAAWKEAQVKMGSTVAVLGLGAVGLGVTEGARMLGAAKIIGVDKNSMKKDKGLAFGMTDFINPDECSDKSISQMIKDLTGGMGVDYCFECVGAESLINQAIQATKEGKGKTIVIGGGISSVKIDYLPLLSGRTLKGSLFGGLKVKSDLPILFQKCKNKEFDLDELLTHEVTLQDIEKAFELLNQPDCVKVLIKI

SEQ ID NO: 2180 - DNA, 1134 bp, Populus balsamifera subsp. trichocarpa
  misc_feature (1)..(1134): Ceres ANNOT ID no. 1442450
  misc_feature 244369:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
atggatggagagaaattctcagtcgaagcagggaaaccaattctatgcaaagctgcggtggctcgcaaaccaggagagcctctcgtaatagaggagataatcgtggctcctccgagtcatcatgaagttcgtgttcgaattatctgcacctctctctgtcaaagtgatgtcactttttggaaattgaaggatcttcctgctgtttttccaagaatacttggccatgaggctatcggatccagtcaaggggccccgaaggctgtagctttgacagctacaaccaaccttctgttgccattgactgtgccctctcatggccaatacaaaaccatagttgtggagagtgtaggggaggatgtagatgaggtcgtcgaaggagatgttgtgattcctgtattcttgccagattgtggagattgtgcagactgcaaatcaaaaaagagtaacctttgttcgaaacttcccttccaggtctctccttggatgcctagagataagaccagtagattcaccaacctaaaaggagaggttctataccatttcctaaatgtatcgagttttagtgagtatactgtggtggacactgcccatattgtaaagattgatccttcaatcccaccaagtaaagcatgcctactcagttgtggagtatcaacagcaaaaaaatttggagtcacagactttgtcaatgttggagaatgcggggataaacctgtgagccaggtgatcaatgaaatgactggtgggggagcagactattgctttgaatgtgttggtttggtgtccttgatggagcaagcatatgcttgctgtcgaaagggatggggaaagacaatcatcttaggagtggaaaaaccagagtcacgggtctcccttccgtgtgcggatgtccttcagagtgggaaaaccctcactggagccttgttcggtggtctcaaagctaaatctgatattccaattctcctaaagcgttacatggacaaggaactggagttggataagtatgtgacccatgagatcaattttaaagacattaacaaagccttcgatttattacttgaaggaaagagtctccgatgtgtaatttggatggacaaacaagcaagctactccaaaggtgtttgtatatcatga

SEQ ID NO: 2181 - protein, 377 aa, Populus balsamifera subsp. trichocarpa
  misc_feature (1)..(377): Ceres ANNOT ID no. 1442450
  misc_feature (220)..(323): Pfam Name: ADH_zinc_N Pfam Description: Zinc-binding dehydrogenase
  misc_feature: SWISSPROT Homolog: ADH1_PETHY Alcohol dehydrogenase 1 (EC 1.1.1.1) with e-value of 2.5e-95 and BLAST sequence identity of 51.5
  misc_feature: SWISSPROT Homolog: ADH1_PENAM Alcohol dehydrogenase 1 (EC 1.1.1.1) (ADH slow-allele) with e-value of 4.1e-93 and BLAST sequence identity of 50.5
  misc_feature: SWISSPROT Homolog: ADH_MALDO Alcohol dehydrogenase (EC 1.1.1.1) with e-value of 8.6e-93 and BLAST sequence identity of 51.2
  misc_feature: SWISSPROT Homolog: ADH1_MAIZE Alcohol dehydrogenase 1 (EC 1.1.1.1) with e-value of 1.1e-92 and BLAST sequence identity of 50.8
  misc_feature: SWISSPROT Homolog: ADH1_ARATH Alcohol dehydrogenase (EC 1.1.1.1) with e-value of 2.9e-92 and BLAST sequence identity of 50.1
  misc_feature 244506:<222: Transcription Factor
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature (1)..(377): Functional Homolog of  Ceres CLONE ID no. 100047 at SEQ ID NO. 2217 with e-value of 2.19E-84 and BLAST sequence identity of 60.3
MDGEKFSVEAGKPILCKAAVARKPGEPLVIEEIIVAPPSHHEVRVRIICTSLCQSDVTFWKLKDLPAVFPRILGHEAIGSSQGAPKAVALTATTNLLLPLTVPSHGQYKTIVVESVGEDVDEVVEGDVVIPVFLPDCGDCADCKSKKSNLCSKLPFQVSPWMPRDKTSRFTNLKGEVLYHFLNVSSFSEYTVVDTAHIVKIDPSIPPSKACLLSCGVSTAKKFGVTDFVNVGECGDKPVSQVINEMTGGGADYCFECVGLVSLMEQAYACCRKGWGKTIILGVEKPESRVSLPCADVLQSGKTLTGALFGGLKAKSDIPILLKRYMDKELELDKYVTHEINFKDINKAFDLLLEGKSLRCVIWMDKQASYSKGVCIS

SEQ ID NO: 2182 - protein, 363 aa, Arabidopsis thaliana
  misc_feature (1)..(363): Ceres CLONE ID no. 100245
  misc_feature (4)..(260): Pfam Name: Pkinase Pfam Description: Protein kinase domain
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: SILIQUES - Bent Useful for modifying fruit shape, composition and seed yield
  misc_feature: Phenotype: SILIQUES - Clubbed Useful for modifying fruit shape, composition and seed yield
  misc_feature: Phenotype: INFLORESCENCE - Short Useful for modulating plant height
MDKYELVKDIGAGNFGVARLMKVKNSKELVAMKYIERGPKIDENVAREIINHRSLRHPNIIRFKEVVLTPTHLAIAMEYAAGGELFERICSAGRFSEDEARYFFQQLISGVSYCHAMQICHRDLKLENTLLDGSPAPRLKICDFGYSKSSLLHSRPKSTVGTPAYIAPEVLSRREYDGKMADVWSCGVTLYVMLVGAYPFEDQEDPKNFRKTIQKIMAVQYKIPDYVHISQDCKNLLSRIFVANSLKRITIAEIKKHSWFLKNLPRELTETAQAAYFKKENPTFSLQTVEEIMKIVADAKTPPPVSRSIGGFGWGGNGDADGKEEDAEDVEEEEEEVEEEEDDEDEYDKTVKEVHASGEVRIS

SEQ ID NO: 2183 - DNA, 1071 bp, Populus balsamifera subsp. trichocarpa
  misc_feature (1)..(1071): Ceres ANNOT ID no. 1535451
  misc_feature 244778:<222: Transcription Factor
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: SILIQUES - Bent Useful for modifying fruit shape, composition and seed yield
  misc_feature: Phenotype: SILIQUES - Clubbed Useful for modifying fruit shape, composition and seed yield
  misc_feature: Phenotype: INFLORESCENCE - Short Useful for modulating plant height
atggagaggtacgagctggtgaaagacataggatctggtaattttggagtggcaaggctgatgaggcacaagcaaaccaaagaacttgtcgccatgaaatacatcgagcgtggcctcaagattgatgaaaatgtagcaagggagattatcaatcacagatcgcttcgccatcctaacataattcggttcaaggaggtggttgtgacgcctactcatcttgctatcatcatggagtatgctgccggaggagagctgttcgagcgaatttgcaatgctggaaggttcagtgaagatgagcttatttcaggagttagttactgtcactctatgcaaatatgccatagagatttgaagctggaaaataccttgttggatggaagcccggcaccgcggttgaaaatctgtgattttggttattctaagtcgtctttgctgcattcaagacccaaatctacagttggcactcctgcttatattgctccagaggttctctctcggagagaatacgatggcaagttggcagatgtgtggtcttgtggggtgactctgtatgttatgctggtgggagcatatccattcgaggaccaggaggacccaaagaatttcaggaaaacaatcaatagaataatggcagttcaatacaagatccccgactatgtccacatatctcaggattgcagacatctcctctctcgcatattcgttgcaaatccaatccggaggatcacaattaaagaaatcaagagccatccatggttcttgaagaacttgccaagggaactgacagaggcagctcaagccatgtactacaggaaagaaaacccaaccttttcccttcaaagtgttgaagaaatcatgaagatcgtggaagaggccaagattcctcccccagtatcccgatctattggaggctttggctgggtaggagaagaagatgatgacgtgaaggaagatgatgcagagggtgttgaagaaaagggcggagaagaagaagaagaagaagaagaagaagatgagtatgagaagagagttaaggaggcacaagcaagtggggaggttcatgtcagttaa

SEQ ID NO: 2184 - protein, 356 aa, Populus balsamifera subsp. trichocarpa
  misc_feature (1)..(356): Ceres ANNOT ID no. 1535451
  misc_feature (4)..(253): Pfam Name: Pkinase Pfam Description: Protein kinase domain
  misc_feature: SWISSPROT Homolog: ASK1_ARATH Serine/threonine-protein kinase ASK1 chloroplast precursor (EC 2.7.11.1) with e-value of 2.9e-195 and BLAST sequence identity of 100.0
  misc_feature: SWISSPROT Homolog: SAPK7_ORYSA Serine/threonine-protein kinase SAPK7 chloroplast precursor with e-value of 6.0e-156 and BLAST sequence identity of 79.5
  misc_feature: SWISSPROT Homolog: SAPK7_ORYSA EC 2.7.11.1 Osmotic stress/abscisic acid-activated protein kinase 7
  misc_feature: SWISSPROT Homolog: SAPK6_ORYSA Serine/threonine-protein kinase SAPK6 chloroplast precursor with e-value of 6.2e-154 and BLAST sequence identity of 78.7
  misc_feature: SWISSPROT Homolog: SAPK6_ORYSA EC 2.7.11.1 Osmotic stress/abscisic acid-activated protein kinase 6
  misc_feature: SWISSPROT Homolog: ASK2_ARATH Serine/threonine-protein kinase ASK2 chloroplast precursor (EC 2.7.11.1) with e-value of 1.2e-148 and BLAST sequence identity of 78.0
  misc_feature: SWISSPROT Homolog: SAPK4_ORYSA Serine/threonine-protein kinase SAPK4 chloroplast precursor with e-value of 8.6e-148 and BLAST sequence identity of 76.7
  misc_feature: SWISSPROT Homolog: SAPK4_ORYSA EC 2.7.11.1 Osmotic stress/abscisic acid-activated protein kinase 4
  misc_feature 244951:<222: Transcription Factor
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: SILIQUES - Bent Useful for modifying fruit shape, composition and seed yield
  misc_feature: Phenotype: SILIQUES - Clubbed Useful for modifying fruit shape, composition and seed yield
  misc_feature: Phenotype: INFLORESCENCE - Short Useful for modulating plant height
  misc_feature (1)..(356): Functional Homolog of  Ceres CLONE ID no. 100245 at SEQ ID NO. 2226 with e-value of 1.19E-163 and BLAST sequence identity of 85.9
MERYELVKDIGSGNFGVARLMRHKQTKELVAMKYIERGLKIDENVAREIINHRSLRHPNIIRFKEVVVTPTHLAIIMEYAAGGELFERICNAGRFSEDELISGVSYCHSMQICHRDLKLENTLLDGSPAPRLKICDFGYSKSSLLHSRPKSTVGTPAYIAPEVLSRREYDGKLADVWSCGVTLYVMLVGAYPFEDQEDPKNFRKTINRIMAVQYKIPDYVHISQDCRHLLSRIFVANPIRRITIKEIKSHPWFLKNLPRELTEAAQAMYYRKENPTFSLQSVEEIMKIVEEAKIPPPVSRSIGGFGWVGEEDDDVKEDDAEGVEEKGGEEEEEEEEEDEYEKRVKEAQASGEVHVS

SEQ ID NO: 2185 - DNA, 1062 bp, Populus balsamifera subsp. trichocarpa
  misc_feature (1)..(1062): Ceres ANNOT ID no. 1532285
  misc_feature 245095:<222: Transcription Factor
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: SILIQUES - Bent Useful for modifying fruit shape, composition and seed yield
  misc_feature: Phenotype: SILIQUES - Clubbed Useful for modifying fruit shape, composition and seed yield
  misc_feature: Phenotype: INFLORESCENCE - Short Useful for modulating plant height
atggagaaatatgagttggtgaaggatttaggagctgggaattttggggtagcaaggcttttgaggcacaaagagaccaaagaacttgttgccatgaaatacattgaaagaggtcataagatagatgagaacgtggcaagggagattataaatcacagatcattaaggcaccccaatataattcggttcaaggaggtggttttgaccccaacacacttggcaattgtgatggagtatgcagctggtggagaactctttgaaagaatctgcaatgctggtagatttagtgaagatgaggctagatatttctttcagcagctgatctctggggttaattactgtcacaacatgcaaatctgccatagagatctgaaactggaaaacacactgttagatggaagtccggcacctcgcttgaaaatctgtgatttcggttactctaagtcctctttgctgcattcaaggccgaaatcaacggtaggaactccggcttacatagcaccggaagttctctctcggagagagtatgatggcaagctggcagatgtttggtcatgtggagttactctttatgtgatgctggtaggggcatacccatttgaagaccaagatgaccctagaaattttaggaaaacaattcagagaataatggctgtgcaatacaaaatccctgactatgttcatgtatctcaagcttgcagaaacctgctatctcgcatattcgttgcaaactcttccaggagaatttcactctcagaaattaaaagccacccatggttcttaaagaacttgccaaaggaactgacggagccagcacaagccatctattaccagagagataatccaagcttttctcttcaaagtgtggatgagataatgaaaattgtggctgaggcaagacaacagcctccatcatcaaagcctgtcaaaggtttcggttgggaagttgaagaagatgaagaggaagacatcgatgcagaggtagaagaggaagatgacgaagatgaatatgacaagagggtcaaggaggttcatgcaagtggagagtatcaaatcagttga

SEQ ID NO: 2186 - protein, 353 aa, Populus balsamifera subsp. trichocarpa
  misc_feature (1)..(353): Ceres ANNOT ID no. 1532285
  misc_feature (4)..(191): Pfam Name: Pkinase_Tyr Pfam Description: Protein tyrosine kinase
  misc_feature: SWISSPROT Homolog: ASK1_ARATH Serine/threonine-protein kinase ASK1 chloroplast precursor (EC 2.7.11.1) with e-value of 2.9e-195 and BLAST sequence identity of 100.0
  misc_feature: SWISSPROT Homolog: SAPK7_ORYSA Serine/threonine-protein kinase SAPK7 chloroplast precursor with e-value of 6.0e-156 and BLAST sequence identity of 79.5
  misc_feature: SWISSPROT Homolog: SAPK7_ORYSA EC 2.7.11.1 Osmotic stress/abscisic acid-activated protein kinase 7
  misc_feature: SWISSPROT Homolog: SAPK6_ORYSA Serine/threonine-protein kinase SAPK6 chloroplast precursor with e-value of 6.2e-154 and BLAST sequence identity of 78.7
  misc_feature: SWISSPROT Homolog: SAPK6_ORYSA EC 2.7.11.1 Osmotic stress/abscisic acid-activated protein kinase 6
  misc_feature: SWISSPROT Homolog: ASK2_ARATH Serine/threonine-protein kinase ASK2 chloroplast precursor (EC 2.7.11.1) with e-value of 1.2e-148 and BLAST sequence identity of 78.0
  misc_feature: SWISSPROT Homolog: SAPK4_ORYSA Serine/threonine-protein kinase SAPK4 chloroplast precursor with e-value of 8.6e-148 and BLAST sequence identity of 76.7
  misc_feature: SWISSPROT Homolog: SAPK4_ORYSA EC 2.7.11.1 Osmotic stress/abscisic acid-activated protein kinase 4
  misc_feature 245268:<222: Transcription Factor
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: SILIQUES - Bent Useful for modifying fruit shape, composition and seed yield
  misc_feature: Phenotype: SILIQUES - Clubbed Useful for modifying fruit shape, composition and seed yield
  misc_feature: Phenotype: INFLORESCENCE - Short Useful for modulating plant height
  misc_feature (1)..(353): Functional Homolog of  Ceres CLONE ID no. 100245 at SEQ ID NO. 2226 with e-value of 7.90E-160 and BLAST sequence identity of 83.5
MEKYELVKDLGAGNFGVARLLRHKETKELVAMKYIERGHKIDENVAREIINHRSLRHPNIIRFKEVVLTPTHLAIVMEYAAGGELFERICNAGRFSEDEARYFFQQLISGVNYCHNMQICHRDLKLENTLLDGSPAPRLKICDFGYSKSSLLHSRPKSTVGTPAYIAPEVLSRREYDGKLADVWSCGVTLYVMLVGAYPFEDQDDPRNFRKTIQRIMAVQYKIPDYVHVSQACRNLLSRIFVANSSRRISLSEIKSHPWFLKNLPKELTEPAQAIYYQRDNPSFSLQSVDEIMKIVAEARQQPPSSKPVKGFGWEVEEDEEEDIDAEVEEEDDEDEYDKRVKEVHASGEYQIS

SEQ ID NO: 2187 - DNA, 1083 bp, Populus balsamifera subsp. trichocarpa
  misc_feature (1)..(1083): Ceres ANNOT ID no. 1480241
  misc_feature 245412:<222: Transcription Factor
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: SILIQUES - Bent Useful for modifying fruit shape, composition and seed yield
  misc_feature: Phenotype: SILIQUES - Clubbed Useful for modifying fruit shape, composition and seed yield
  misc_feature: Phenotype: INFLORESCENCE - Short Useful for modulating plant height
atggagaaatatgagttggtgaaagatttaggagctgggaattttggggtggcaaggcttttgaggcacaaagaaaccaaagaacttgttgccatgaaatacatagaaagaggtcacaagatagacgagaatgttgcaagggagattataaatcacagatcattaaggcaccctaatataattcgattcaaggaggcaagtactagaaatatggtggttttgaccccaactcatttggtaattgtgatggagtatgcagctggtggagaactctttgaaagaatctgcaatgctggtagattcagtgaagatgaggctagatatttctttcagcagctgatctctggggttaatttttgtcacaacatgcaaatctgccatagagatttgaaactggaaaatactctgttagatggaagtcctgcgcctcgattgaaaatctgtgattttggttactctaagtcctctttgctgcattcaaggccgaaatcaactgtaggaactccggcatacatagcaccggaagttctctctcggagagagtatgacggaaagatggcagatgtttggtcatgtggagttactctttatgtgatgctggtgggggcatacccatttgaagaccaagatgaccccaaaaattttaggaaaacaattcagaaaattatggctgtccaatacaaaattcctgactatgttcatgtatctcaagcttgcagacacctgctatctcgtatattcgttgcaaacccttccaggagaatttcactctcagaaatcaaaagccactcatggttcttaaagaacttgccaaaggaactgagtgaatcatcacaagccatttattaccagagagataatccaagcttttctgttcaaagtgtggaggagatcatgaaaattgtggccgaggcaagacagccacctccatcatccaagcctgtcagaagttttggttgggaagtagaagaagatgaagatgatgaagacatcgatgcagaggtagaagaggacgacggagaagatgagtatgataagagggtcaaggaggttcatgcaagtggagagtttcatatcagttaa

SEQ ID NO: 2188 - protein, 360 aa, Populus balsamifera subsp. trichocarpa
  misc_feature (1)..(360): Ceres ANNOT ID no. 1480241
  misc_feature (4)..(267): Pfam Name: Pkinase_Tyr Pfam Description: Protein tyrosine kinase
  misc_feature: SWISSPROT Homolog: ASK1_ARATH Serine/threonine-protein kinase ASK1 chloroplast precursor (EC 2.7.11.1) with e-value of 2.9e-195 and BLAST sequence identity of 100.0
  misc_feature: SWISSPROT Homolog: SAPK7_ORYSA Serine/threonine-protein kinase SAPK7 chloroplast precursor with e-value of 6.0e-156 and BLAST sequence identity of 79.5
  misc_feature: SWISSPROT Homolog: SAPK7_ORYSA EC 2.7.11.1 Osmotic stress/abscisic acid-activated protein kinase 7
  misc_feature: SWISSPROT Homolog: SAPK6_ORYSA Serine/threonine-protein kinase SAPK6 chloroplast precursor with e-value of 6.2e-154 and BLAST sequence identity of 78.7
  misc_feature: SWISSPROT Homolog: SAPK6_ORYSA EC 2.7.11.1 Osmotic stress/abscisic acid-activated protein kinase 6
  misc_feature: SWISSPROT Homolog: ASK2_ARATH Serine/threonine-protein kinase ASK2 chloroplast precursor (EC 2.7.11.1) with e-value of 1.2e-148 and BLAST sequence identity of 78.0
  misc_feature: SWISSPROT Homolog: SAPK4_ORYSA Serine/threonine-protein kinase SAPK4 chloroplast precursor with e-value of 8.6e-148 and BLAST sequence identity of 76.7
  misc_feature: SWISSPROT Homolog: SAPK4_ORYSA EC 2.7.11.1 Osmotic stress/abscisic acid-activated protein kinase 4
  misc_feature 245587:<222: Transcription Factor
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: SILIQUES - Bent Useful for modifying fruit shape, composition and seed yield
  misc_feature: Phenotype: SILIQUES - Clubbed Useful for modifying fruit shape, composition and seed yield
  misc_feature: Phenotype: INFLORESCENCE - Short Useful for modulating plant height
  misc_feature (1)..(360): Functional Homolog of  Ceres CLONE ID no. 100245 at SEQ ID NO. 2226 with e-value of 3.20E-156 and BLAST sequence identity of 83.3
MEKYELVKDLGAGNFGVARLLRHKETKELVAMKYIERGHKIDENVAREIINHRSLRHPNIIRFKEASTRNMVVLTPTHLVIVMEYAAGGELFERICNAGRFSEDEARYFFQQLISGVNFCHNMQICHRDLKLENTLLDGSPAPRLKICDFGYSKSSLLHSRPKSTVGTPAYIAPEVLSRREYDGKMADVWSCGVTLYVMLVGAYPFEDQDDPKNFRKTIQKIMAVQYKIPDYVHVSQACRHLLSRIFVANPSRRISLSEIKSHSWFLKNLPKELSESSQAIYYQRDNPSFSVQSVEEIMKIVAEARQPPPSSKPVRSFGWEVEEDEDDEDIDAEVEEDDGEDEYDKRVKEVHASGEFHIS

SEQ ID NO: 2189 - DNA, 1044 bp, Populus balsamifera subsp. trichocarpa
  misc_feature (1)..(1044): Ceres ANNOT ID no. 1446025
  misc_feature 245731:<222: Transcription Factor
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: SILIQUES - Bent Useful for modifying fruit shape, composition and seed yield
  misc_feature: Phenotype: SILIQUES - Clubbed Useful for modifying fruit shape, composition and seed yield
  misc_feature: Phenotype: INFLORESCENCE - Short Useful for modulating plant height
atggagaattacgagctggtgaaagacataggatctggtaattttggagtggcaaggctgatgaggcacaagcaaaccagagaactggttgccatgaaatacatcgagcgtggccgcaagattgatgagaatgtggcaagagagattatcaatcacaaatcgcttcgccatcccaacataattcggtttagagaggtggtgttgacgccaactcatcttgctatcgtgatggagtatgctgctggaggagagctgttcgagcggatttgcaatgctggacgattcagcgaagacgaggcgaggtatttttttcagcagcttatttctggagttagttactgccactctatgcaaatatgccatagagatttgaagctggaaaatacgttgttggatggaagcccagcaccgcagttgaaaatatgtgattttggttattctaagtcgtctttgctgcattcgagacccaaatctacagttggtactccggcttatattgctccggaggttctttctcggagagaatatgatggcaagttggcggatgtctggtcttgtggggtgactctgtatgttatgctggtgggagcatatccgttcgaagatcatgaggacccaaagaatttcaggaaaacaatcaataggataatggcagttcaatacaagatccctgactatgtccacatatctcaagattgcagacatctcctctctcacatatttgttgcaaatccgtcccggaggatcaccattaaagaaattaagagccatccatggttcttgaagaacttgccaagggaactgacagaagcagctcaggccatgtactacaggagagaaaatcccaccttttctcttcaaagtgttgaagaaatcatgaagatcatggaagaggaaaaaattcccccactagtatccagatctattggaggctttggctgggaaggagaagaagatggtgacatgaagaaaaaatcaataacgtggaagatgagtatgagaagagagttaaggaggcacaagcacgtggggagtttcatgtga

SEQ ID NO: 2190 - protein, 347 aa, Populus balsamifera subsp. trichocarpa
  misc_feature (1)..(347): Ceres ANNOT ID no. 1446025
  misc_feature (4)..(260): Pfam Name: Pkinase Pfam Description: Protein kinase domain
  misc_feature: SWISSPROT Homolog: ASK1_ARATH Serine/threonine-protein kinase ASK1 chloroplast precursor (EC 2.7.11.1) with e-value of 2.9e-195 and BLAST sequence identity of 100.0
  misc_feature: SWISSPROT Homolog: SAPK7_ORYSA Serine/threonine-protein kinase SAPK7 chloroplast precursor with e-value of 6.0e-156 and BLAST sequence identity of 79.5
  misc_feature: SWISSPROT Homolog: SAPK7_ORYSA EC 2.7.11.1 Osmotic stress/abscisic acid-activated protein kinase 7
  misc_feature: SWISSPROT Homolog: SAPK6_ORYSA Serine/threonine-protein kinase SAPK6 chloroplast precursor with e-value of 6.2e-154 and BLAST sequence identity of 78.7
  misc_feature: SWISSPROT Homolog: SAPK6_ORYSA EC 2.7.11.1 Osmotic stress/abscisic acid-activated protein kinase 6
  misc_feature: SWISSPROT Homolog: ASK2_ARATH Serine/threonine-protein kinase ASK2 chloroplast precursor (EC 2.7.11.1) with e-value of 1.2e-148 and BLAST sequence identity of 78.0
  misc_feature: SWISSPROT Homolog: SAPK4_ORYSA Serine/threonine-protein kinase SAPK4 chloroplast precursor with e-value of 8.6e-148 and BLAST sequence identity of 76.7
  misc_feature: SWISSPROT Homolog: SAPK4_ORYSA EC 2.7.11.1 Osmotic stress/abscisic acid-activated protein kinase 4
  misc_feature 245904:<222: Transcription Factor
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: SILIQUES - Bent Useful for modifying fruit shape, composition and seed yield
  misc_feature: Phenotype: SILIQUES - Clubbed Useful for modifying fruit shape, composition and seed yield
  misc_feature: Phenotype: INFLORESCENCE - Short Useful for modulating plant height
  misc_feature (1)..(347): Functional Homolog of  Ceres CLONE ID no. 100245 at SEQ ID NO. 2226 with e-value of 1.09E-151 and BLAST sequence identity of 85.5
MENYELVKDIGSGNFGVARLMRHKQTRELVAMKYIERGRKIDENVAREIINHKSLRHPNIIRFREVVLTPTHLAIVMEYAAGGELFERICNAGRFSEDEARYFFQQLISGVSYCHSMQICHRDLKLENTLLDGSPAPQLKICDFGYSKSSLLHSRPKSTVGTPAYIAPEVLSRREYDGKLADVWSCGVTLYVMLVGAYPFEDHEDPKNFRKTINRIMAVQYKIPDYVHISQDCRHLLSHIFVANPSRRITIKEIKSHPWFLKNLPRELTEAAQAMYYRRENPTFSLQSVEEIMKIMEEEKIPPLVSRSIGGFGWEGEEDGDMKKKSITWKMSMRRELRRHKHVGSFM

SEQ ID NO: 2191 - protein, 263 aa, Arabidopsis thaliana
  misc_feature (1)..(263): Ceres CLONE ID no. 100319
  misc_feature (1)..(263): Also Known As Ceres CDNA ID no. 23389186
  misc_feature (1)..(263): Also Known As Ceres GEMINI ID 533D2
  misc_feature (54)..(83): Pfam Name: zf-C3HC4 Pfam Description: Zinc finger, C3HC4 type (RING finger)
  misc_feature 246065:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers
  misc_feature: Phenotype: INFLORESCENCE - Other Useful for making ornamental plants with modified flowers
MLSIPDTRMWNLASSYLTGNIGPKNDIRRPVHAHAECSDDDVSSVGSKDEGLECPICWESFNIVENVPYVLWCGHTMCKNCILGLQWAIVKLPTHPVQLPLFISCPWCNLLSFRLVFRGTLRFPHKNYFVLWMVERMNGERRNSPGGAQTDGNNDHTRETPSPCLHNRHHRSQPEPSRSVNDHRIPRDNIQTSLRKSLVFFVQLTAKFPLVVIFLLIILYAIPTSAAILAMYILVTLLLALPSFLILYFAYPCLDWLVREIVT

SEQ ID NO: 2192 - DNA, 801 bp, Populus balsamifera subsp. trichocarpa
  misc_feature (1)..(801): Ceres ANNOT ID no. 1503141
  misc_feature 246205:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers
  misc_feature: Phenotype: INFLORESCENCE - Other Useful for making ornamental plants with modified flowers
atgttgaattttgcatccaattgcctagctggaagtgttagtatgaacaattctacaaagcctactcaagtcccatcagaatactcagacgatgaggcatcttcttttagcagagaagaagctctagagtgcccaatatgctgggaatccttcaatattgtggaaaatgtgccttatgttttatggtgtggccatactctttgcaaaaattgcgtcctagggcttcaatgggctgtagtgaaattccccacattacctattcggcttcctctctttatttcttgcccgtggtgcaatttatcatctttccgctttgtttatagagggaacctcaaatttcctcgcaagaattattttctactttggatggttgagagcaagaatggtgacagagacaagtctcctggcaccttctgtgaagatcaccaaccgcactggtcatcagacagtaatttagctcatggaagtcgggtaagccgtggtaacatcaggagaggacactatattcatcactctgaaccatcagggacacaccatgatcataatcatgtcaacagttacctcaatgtggagagaatacattcttcccttcagaaatcactggctttctttgttagtctgacagcaaagttcccattggtcatcatattccttttgatcatcttatatgtaatacctgccagtgcaagcattttggccctgtacattcttatcactgttctgtttgccctcccatcatttctcattctttactttgcttatcctagtttggattggcttgtgagagaaatcatcacttga

SEQ ID NO: 2193 - protein, 266 aa, Populus balsamifera subsp. trichocarpa
  misc_feature (1)..(266): Ceres ANNOT ID no. 1503141
  misc_feature 246322:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers
  misc_feature: Phenotype: INFLORESCENCE - Other Useful for making ornamental plants with modified flowers
  misc_feature (1)..(266): Functional Homolog of  Ceres CLONE ID no. 100319 at SEQ ID NO. 2235 with e-value of 1.79E-82 and BLAST sequence identity of 63.2
MLNFASNCLAGSVSMNNSTKPTQVPSEYSDDEASSFSREEALECPICWESFNIVENVPYVLWCGHTLCKNCVLGLQWAVVKFPTLPIRLPLFISCPWCNLSSFRFVYRGNLKFPRKNYFLLWMVESKNGDRDKSPGTFCEDHQPHWSSDSNLAHGSRVSRGNIRRGHYIHHSEPSGTHHDHNHVNSYLNVERIHSSLQKSLAFFVSLTAKFPLVIIFLLIILYVIPASASILALYILITVLFALPSFLILYFAYPSLDWLVREIIT

SEQ ID NO: 2194 - DNA, 801 bp, Populus balsamifera subsp. trichocarpa
  misc_feature (1)..(801): Ceres ANNOT ID no. 1521524
  misc_feature 246470:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers
  misc_feature: Phenotype: INFLORESCENCE - Other Useful for making ornamental plants with modified flowers
atgttggattttgcttccaaattcattagaggaaccattaggttgaagcatgactttttaaagccaaggcaagctctttcaggtcagtgctcagatgatgaaccttctttaaacagcagcagagaggacagattggaatgcccaatttgctgggaatccttcaatattgtggagaatgttccttatgttttatggtgcggtcacagcctctgtaagaattgtgtgctaggcctgcaatgggcccttgttaaactccccacactacctatcctgcttccgtttttcatctcttgtccatggtgtaatatgttatcattcaggcttgtttacaaggggattctcagattcccttgtaaaaattattttcttttgtggatggttgagagcatgaatggtgataggtcatctttctcctcattccacaatgatcatcagcctgtcgctcccttgaacaataatccaaccacaggaaatcaggttaaccccgaagtagggaacaggcatgccatgcgcgttcaaatcccttcagaacaatccctacctaaccgcgaccctagctacttcaattctgagagacttcacttatcactccgcaagtctctggtattttttgctcacatgacagctaagtttccattaatcgtcatgtttcttctgattgttctgtatgcaatacccactagtgccgcgatcttagccctctacatccttatcactcttgtgtttgccctcccttcttttctcatcttgtacttttccttacctagtctggattggctggtcagagaaatcatcacctga

SEQ ID NO: 2195 - protein, 266 aa, Populus balsamifera subsp. trichocarpa
  misc_feature (1)..(266): Ceres ANNOT ID no. 1521524
  misc_feature 246587:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature: Phenotype: SILIQUES - Short Useful for increasing seed/fruit yield or modifying fruit content
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: FLOWER - Other Useful for making ornamental plants with modified flowers
  misc_feature: Phenotype: INFLORESCENCE - Other Useful for making ornamental plants with modified flowers
  misc_feature (1)..(266): Functional Homolog of  Ceres CLONE ID no. 100319 at SEQ ID NO. 2235 with e-value of 4.30E-81 and BLAST sequence identity of 62.5
MLDFASKFIRGTIRLKHDFLKPRQALSGQCSDDEPSLNSSREDRLECPICWESFNIVENVPYVLWCGHSLCKNCVLGLQWALVKLPTLPILLPFFISCPWCNMLSFRLVYKGILRFPCKNYFLLWMVESMNGDRSSFSSFHNDHQPVAPLNNNPTTGNQVNPEVGNRHAMRVQIPSEQSLPNRDPSYFNSERLHLSLRKSLVFFAHMTAKFPLIVMFLLIVLYAIPTSAAILALYILITLVFALPSFLILYFSLPSLDWLVREIIT

SEQ ID NO: 2196 - protein, 272 aa, Arabidopsis thaliana
  misc_feature (1)..(272): Ceres CLONE ID no. 100465
  misc_feature (70)..(130): Pfam Name: WRKY Pfam Description: WRKY DNA -binding domain
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Weak Useful for making stronger plants
MHRRAAIQESDDEEDETYNDVVPESPSSCEDSKISKPTPKKSRRNVEKRVVSVPIADVEGSKSRGEVYPPSDSWAWRKYGQKPIKGSPYPRGYYRCSSSKGCPARKQVERSRVDPSKLMITYACDHNHPFPSSSANTKSHHRSSVVLKTAKKEEEYEEEEEELTVTAAEEPPAGLDLSHVDSPLLLGGCYSEIGEFGWFYDASISSSSGSSNFLDVTLERGFSVGQEEDESLFGDLGDLPDCASVFRRGTVATEEQHRRCDFGAIPFCDSSR

SEQ ID NO: 2197 - DNA, 807 bp, Populus balsamifera subsp. trichocarpa
  misc_feature (1)..(807): Ceres ANNOT ID no. 1466439
  misc_feature 246838:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Weak Useful for making stronger plants
atggacaggaggttcaacatcaaccctctgatcactgagcaagaagaaaatgacaatagtgctcaggaaagcggtccagaatcacctccttctaacgatatgaagatgccttctacttcctctcccaaacgaagtaagaaggccatgcaaaaaagagttgtctcagtgccaatcaaggacttagaaggctcaaggctgaagggcgaaaatgcttcaccgccgtctgattcttgggcttggagaaagtatggccaaaagccaatcaaaggctcaccttaccccagaggctactataggtgtagtagttcaaagggctgtccagctagaaaacaagtagagaggagtaaagtggacccaacaatgctagttatcacctactcctgtgaacacaaccacccttggccacctccttctagatcccacaaccaccataagaaccaccataactcctcctctccaaaacacaacactaccaccaaacccgaagtctccacaacccatcctgataacccagagcctgagcatgaagaaaagttcacggatcttggaaacgacgggtcactcatatctacgactacaacttcagatgaattttcttggtttggtgaaatcgagacaacctcttcaactatacttgagacacctttttttgcagagggagaggccgatgctgacatggcatcaatgtttttcccgatgagagatgaggatgagtcgttgtttgccgatcttggagagttgccggagtgctcgtcggtgttcaggcatcagcgtagtggtgttggaccacaggttcagatctgctga

SEQ ID NO: 2198 - protein, 268 aa, Populus balsamifera subsp. trichocarpa
  misc_feature (1)..(268): Ceres ANNOT ID no. 1466439
  misc_feature (74)..(134): Pfam Name: WRKY Pfam Description: WRKY DNA -binding domain
  misc_feature: SWISSPROT Homolog: WRK69_ARATH Probable WRKY transcription factor 69 (WRKY DNA-binding protein 69) with e-value of 4.8e-147 and BLAST sequence identity of 99.6
  misc_feature: SWISSPROT Homolog: WRK65_ARATH Probable WRKY transcription factor 65 (WRKY DNA-binding protein 65) with e-value of 6.4e-49 and BLAST sequence identity of 47.6
  misc_feature: SWISSPROT Homolog: WRK14_ARATH Probable WRKY transcription factor 14 WRKY DNA-binding protein 14 (AR411) with e-value of 5.3e-34 and BLAST sequence identity of 62.5
  misc_feature: SWISSPROT Homolog: WRK35_ARATH Probable WRKY transcription factor 35 (WRKY DNA-binding protein 35) with e-value of 2.4e-33 and BLAST sequence identity of 57.5
  misc_feature: SWISSPROT Homolog: WRK22_ARATH WRKY transcription factor 22 (WRKY DNA-binding protein 22) with e-value of 6.1e-28 and BLAST sequence identity of 36.3
  misc_feature 246958:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Weak Useful for making stronger plants
  misc_feature (1)..(268): Functional Homolog of  Ceres CLONE ID no. 100465 at SEQ ID NO. 2240 with e-value of 9.39E-54 and BLAST sequence identity of 51.8
MDRRFNINPLITEQEENDNSAQESGPESPPSNDMKMPSTSSPKRSKKAMQKRVVSVPIKDLEGSRLKGENASPPSDSWAWRKYGQKPIKGSPYPRGYYRCSSSKGCPARKQVERSKVDPTMLVITYSCEHNHPWPPPSRSHNHHKNHHNSSSPKHNTTTKPEVSTTHPDNPEPEHEEKFTDLGNDGSLISTTTTSDEFSWFGEIETTSSTILETPFFAEGEADADMASMFFPMRDEDESLFADLGELPECSSVFRHQRSGVGPQVQIC

SEQ ID NO: 2199 - DNA, 807 bp, Populus balsamifera subsp. trichocarpa
  misc_feature (1)..(807): Ceres ANNOT ID no. 1448977
  misc_feature 247063:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Weak Useful for making stronger plants
atggatagtaggttcatcatcaacccattaatatgtgagcaagaagaaaatgacaatagtactcaagaaagtggtccagaatcatctccttctaacgatatgaagatggcttccacttcctccccaaaaagaagcaagaaggccatgcaaaaaagaatagtctcagtaccaatcaaggacttagaaggcccaaggctgaagggtgaaaatgcttcaccaccgtctgattcctgggcttggagaaagtatggccaaaaacccatcaaaggctcgccttaccccagaggatactataggtgtagtagttcaaagggttgtccagctagaaaacaagtagagaggagcaagctggacccaacaatgctagtggtcacctactcctgtgagcacaaccacccttggccacctccttctagaagtacccaccaccacaactcctctccaaaacacaacaccaccaaacctgaagtctccgcaacccaacctgaaaacccagaatctgaacctgaagaaaagttcacggatcttggaaacggcgagccgcttatatctaacactacaacttcagatgagttttcgtggtttggtgtcatggagacaacctcttcaactatacttgagacgcccatttttgcagaggcagaggcggatgctgacatggcatcgatgtttttcccgatgagagaggaggacgagtcgttgtttgccgatcttggagagttgccggagtgctcgtcggtgttcaggcaccaccggagaggtgttggaccacaggttctaagagctttgggatttaaatccaattaa

SEQ ID NO: 2200 - protein, 268 aa, Populus balsamifera subsp. trichocarpa
  misc_feature (1)..(268): Ceres ANNOT ID no. 1448977
  misc_feature (74)..(134): Pfam Name: WRKY Pfam Description: WRKY DNA -binding domain
  misc_feature: SWISSPROT Homolog: WRK69_ARATH Probable WRKY transcription factor 69 (WRKY DNA-binding protein 69) with e-value of 4.8e-147 and BLAST sequence identity of 99.6
  misc_feature: SWISSPROT Homolog: WRK65_ARATH Probable WRKY transcription factor 65 (WRKY DNA-binding protein 65) with e-value of 6.4e-49 and BLAST sequence identity of 47.6
  misc_feature: SWISSPROT Homolog: WRK14_ARATH Probable WRKY transcription factor 14 WRKY DNA-binding protein 14 (AR411) with e-value of 5.3e-34 and BLAST sequence identity of 62.5
  misc_feature: SWISSPROT Homolog: WRK35_ARATH Probable WRKY transcription factor 35 (WRKY DNA-binding protein 35) with e-value of 2.4e-33 and BLAST sequence identity of 57.5
  misc_feature: SWISSPROT Homolog: WRK22_ARATH WRKY transcription factor 22 (WRKY DNA-binding protein 22) with e-value of 6.1e-28 and BLAST sequence identity of 36.3
  misc_feature 247183:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Weak Useful for making stronger plants
  misc_feature (1)..(268): Functional Homolog of  Ceres CLONE ID no. 100465 at SEQ ID NO. 2240 with e-value of 3.19E-53 and BLAST sequence identity of 51.7
MDSRFIINPLICEQEENDNSTQESGPESSPSNDMKMASTSSPKRSKKAMQKRIVSVPIKDLEGPRLKGENASPPSDSWAWRKYGQKPIKGSPYPRGYYRCSSSKGCPARKQVERSKLDPTMLVVTYSCEHNHPWPPPSRSTHHHNSSPKHNTTKPEVSATQPENPESEPEEKFTDLGNGEPLISNTTTSDEFSWFGVMETTSSTILETPIFAEAEADADMASMFFPMREEDESLFADLGELPECSSVFRHHRRGVGPQVLRALGFKSN

SEQ ID NO: 2201 - DNA, 795 bp, Populus balsamifera subsp. trichocarpa
  misc_feature (1)..(795): Ceres ANNOT ID no. 1519767
  misc_feature 247288:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Weak Useful for making stronger plants
atggacaggaggttcaacatcaaccctctgatcactgagcaagaagaaaatgacaatagtgctcaggaaagcggtccagaatcacctccttctaacgatatgaagatgccttctacttcctctcccaaacgaagtaagaaggccatgcaaaaaagagttgtctcagtgccaatcaaggacttagaaggctcaaggctgaagggcgaaaatgcttcaccgccgtctgattcttgggcttggagaaagtatggccaaaagccaatcaaaggctcaccttaccccaggtgtagtagttcaaagggctgtccagctagaaaacaagtagagaggagtaaagtggacccaacaatgctagttatcacctactcctgtgaacacaaccacccttggccacctccttctagatcccacaaccaccataagaaccaccataactcctcctctccaaaacacaacactaccaccaaacccgaagtctccacaacccatcctgataacccagagcctgagcatgaagaaaagttcacggatcttggaaacgacgggtcactcatatctacgactacaacttcagatgaattttcttggtttggtgaaatcgagacaacctcttcaactatacttgagacacctttttttgcagagggagaggccgatgctgacatggcatcaatgtttttcccgatgagagatgaggatgagtcgttgtttgccgatcttggagagttgccggagtgctcgtcggtgttcaggcatcagcgtagtggtgttggaccacaggttcagatctgctga

SEQ ID NO: 2202 - protein, 264 aa, Populus balsamifera subsp. trichocarpa
  misc_feature (1)..(264): Ceres ANNOT ID no. 1519767
  misc_feature (74)..(130): Pfam Name: WRKY Pfam Description: WRKY DNA -binding domain
  misc_feature: SWISSPROT Homolog: WRK69_ARATH Probable WRKY transcription factor 69 (WRKY DNA-binding protein 69) with e-value of 4.8e-147 and BLAST sequence identity of 99.6
  misc_feature: SWISSPROT Homolog: WRK65_ARATH Probable WRKY transcription factor 65 (WRKY DNA-binding protein 65) with e-value of 6.4e-49 and BLAST sequence identity of 47.6
  misc_feature: SWISSPROT Homolog: WRK14_ARATH Probable WRKY transcription factor 14 WRKY DNA-binding protein 14 (AR411) with e-value of 5.3e-34 and BLAST sequence identity of 62.5
  misc_feature: SWISSPROT Homolog: WRK35_ARATH Probable WRKY transcription factor 35 (WRKY DNA-binding protein 35) with e-value of 2.4e-33 and BLAST sequence identity of 57.5
  misc_feature: SWISSPROT Homolog: WRK22_ARATH WRKY transcription factor 22 (WRKY DNA-binding protein 22) with e-value of 6.1e-28 and BLAST sequence identity of 36.3
  misc_feature 247408:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Weak Useful for making stronger plants
  misc_feature (1)..(264): Functional Homolog of  Ceres CLONE ID no. 100465 at SEQ ID NO. 2240 with e-value of 1.59E-49 and BLAST sequence identity of 51.0
MDRRFNINPLITEQEENDNSAQESGPESPPSNDMKMPSTSSPKRSKKAMQKRVVSVPIKDLEGSRLKGENASPPSDSWAWRKYGQKPIKGSPYPRCSSSKGCPARKQVERSKVDPTMLVITYSCEHNHPWPPPSRSHNHHKNHHNSSSPKHNTTTKPEVSTTHPDNPEPEHEEKFTDLGNDGSLISTTTTSDEFSWFGEIETTSSTILETPFFAEGEADADMASMFFPMRDEDESLFADLGELPECSSVFRHQRSGVGPQVQIC

SEQ ID NO: 2203 - DNA, 777 bp, Populus balsamifera subsp. trichocarpa
  misc_feature (1)..(777): Ceres ANNOT ID no. 1501982
  misc_feature 247513:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Weak Useful for making stronger plants
atggatagtaggttcatcatcaacccattaatatgtgagcaagaagaaaatgacaatagtactcaagaaagtggtccagaatcatctccttctaacgatatgaagatggcttccacttcctccccaaaaagaagcaagaaggccatgcaaaaaagaatagtctcagtaccaatcaaggacttagaaggcccaaggctgaagggtgaaaatgcttcaccaccgtctgattcctgggcttggagaaagtatggccaaaaacccatcaaaggctcgccttaccccaggtgtagtagttcaaagggttgtccagctagaaaacaagtagagaggagcaagctggacccaacaatgctagtggtcacctactcctgtgagcacaaccacccttggccacctccttctagaagtacccaccaccacaactcctctccaaaacacaacaccaccaaacctgaagtctccgcaacccaacctgaaaacccagaatctgaacctgaagaaaagttcacggatcttggaaacggcgagccgcttatatctaacactacaacttcagatgagttttcgtggtttggtgtcatggagacaacctcttcaactatacttgagacgcccatttttgcagaggcagaggcggatgctgacatggcatcgatgtttttcccgatgagagaggaggacgagtcgttgtttgccgatcttggagagttgccggagtgctcgtcggtgttcaggcaccaccggagaggtgttggaccacaggtacagacgtgctaa

SEQ ID NO: 2204 - protein, 258 aa, Populus balsamifera subsp. trichocarpa
  misc_feature (1)..(258): Ceres ANNOT ID no. 1501982
  misc_feature (74)..(130): Pfam Name: WRKY Pfam Description: WRKY DNA -binding domain
  misc_feature: SWISSPROT Homolog: WRK69_ARATH Probable WRKY transcription factor 69 (WRKY DNA-binding protein 69) with e-value of 4.8e-147 and BLAST sequence identity of 99.6
  misc_feature: SWISSPROT Homolog: WRK65_ARATH Probable WRKY transcription factor 65 (WRKY DNA-binding protein 65) with e-value of 6.4e-49 and BLAST sequence identity of 47.6
  misc_feature: SWISSPROT Homolog: WRK14_ARATH Probable WRKY transcription factor 14 WRKY DNA-binding protein 14 (AR411) with e-value of 5.3e-34 and BLAST sequence identity of 62.5
  misc_feature: SWISSPROT Homolog: WRK35_ARATH Probable WRKY transcription factor 35 (WRKY DNA-binding protein 35) with e-value of 2.4e-33 and BLAST sequence identity of 57.5
  misc_feature: SWISSPROT Homolog: WRK22_ARATH WRKY transcription factor 22 (WRKY DNA-binding protein 22) with e-value of 6.1e-28 and BLAST sequence identity of 36.3
  misc_feature 247631:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Weak Useful for making stronger plants
  misc_feature (1)..(258): Functional Homolog of  Ceres CLONE ID no. 100465 at SEQ ID NO. 2240 with e-value of 3.40E-49 and BLAST sequence identity of 48.9
MDSRFIINPLICEQEENDNSTQESGPESSPSNDMKMASTSSPKRSKKAMQKRIVSVPIKDLEGPRLKGENASPPSDSWAWRKYGQKPIKGSPYPRCSSSKGCPARKQVERSKLDPTMLVVTYSCEHNHPWPPPSRSTHHHNSSPKHNTTKPEVSATQPENPESEPEEKFTDLGNGEPLISNTTTSDEFSWFGVMETTSSTILETPIFAEAEADADMASMFFPMREEDESLFADLGELPECSSVFRHHRRGVGPQVQTC

SEQ ID NO: 2205 - protein, 276 aa, Arabidopsis thaliana
  misc_feature (1)..(276): Ceres CLONE ID no. 101250
  misc_feature (169)..(242): Pfam Name: Ribosomal_S5_C Pfam Description: Ribosomal protein S5, C-terminal domain
  misc_feature (86)..(152): Pfam Name: Ribosomal_S5 Pfam Description: Ribosomal protein S5, N-terminal domain
  misc_feature: Phenotype: FLOWER - Aborted fertility Useful for sterility, genetic confinement systems
  misc_feature: Phenotype: SILIQUES - Other Useful for increasing seed/fruit yield or modifying fruit content
MAERGVERGGDRGDFGRGFGGRGGGRGGPRGRGRRAGRAPEEEKWVPVTKLGRLVKEGKITKIEQIYLHSLPVKEYQIIDLLVGPSLKDEVMKIMPVQKQTRAGQRTRFKAFIVVGDSNGHVGLGVKCSKEVATAIRGAIILAKLSVVPIRRGYWGNKIGKPHTVPCKVTGKCGSVTVRMVPAPRGSGIVAARVPKKVLQFAGIDDVFTSSRGSTKTLGNFVKATFDCLQKTYGFLTPEFWKETRFSKSPYQEHTDFLLIPPGVKISEVVVDKSVE

SEQ ID NO: 2206 - DNA, 813 bp, Populus balsamifera subsp. trichocarpa; identical to SEQ ID NO: 2067
  misc_feature (1)..(813): Ceres ANNOT ID no. 1506849
  misc_feature 247831:<222: Transcription Factor
  misc_feature: Phenotype: FLOWER - Aborted fertility Useful for sterility, genetic confinement systems
  misc_feature: Phenotype: SILIQUES - Other Useful for increasing seed/fruit yield or modifying fruit content

SEQ ID NO: 2207 - protein, 270 aa, Populus balsamifera subsp. trichocarpa; identical to SEQ ID NO: 2068
  misc_feature (1)..(270): Ceres ANNOT ID no. 1506849
  misc_feature (166)..(239): Pfam Name: Ribosomal_S5_C Pfam Description: Ribosomal protein S5, C-terminal domain
  misc_feature (83)..(149): Pfam Name: Ribosomal_S5 Pfam Description: Ribosomal protein S5, N-terminal domain
  misc_feature: SWISSPROT Homolog: RS2_ARATH 40S ribosomal protein S2 with e-value of 2.8e-126 and BLAST sequence identity of 91.2
  misc_feature: SWISSPROT Homolog: RS2_MOUSE 40S ribosomal protein S2 (S4) (LLRep3 protein) with e-value of 3.7e-101 and BLAST sequence identity of 74.0
  misc_feature: SWISSPROT Homolog: RS2_RAT 40S ribosomal protein S2 with e-value of 3.7e-101 and BLAST sequence identity of 74.0
  misc_feature: SWISSPROT Homolog: RS2_HUMAN 40S ribosomal protein S2 (S4) (LLRep3 protein) with e-value of 5.9e-101 and BLAST sequence identity of 74.0
  misc_feature: SWISSPROT Homolog: RS2_BOVIN 40S ribosomal protein S2 (Fragment) with e-value of 1.1e-99 and BLAST sequence identity of 73.2
  misc_feature 247941:<222: Transcription Factor
  misc_feature: Phenotype: FLOWER - Aborted fertility Useful for sterility, genetic confinement systems
  misc_feature: Phenotype: SILIQUES - Other Useful for increasing seed/fruit yield or modifying fruit content
  misc_feature (1)..(270): Functional Homolog of  Ceres CLONE ID no. 101250 at SEQ ID NO. 2249 with e-value of 3.50E-118 and BLAST sequence identity of 84.9

SEQ ID NO: 2208 - DNA, 831 bp, Populus balsamifera subsp. trichocarpa; identical to SEQ ID NO: 2065
  misc_feature (1)..(831): Ceres ANNOT ID no. 1474944
  misc_feature 248032:<222: Transcription Factor
  misc_feature: Phenotype: FLOWER - Aborted fertility Useful for sterility, genetic confinement systems
  misc_feature: Phenotype: SILIQUES - Other Useful for increasing seed/fruit yield or modifying fruit content

SEQ ID NO: 2209 - protein, 276 aa, Populus balsamifera subsp. trichocarpa; identical to SEQ ID NO: 2066
  misc_feature (1)..(276): Ceres ANNOT ID no. 1474944
  misc_feature (172)..(245): Pfam Name: Ribosomal_S5_C Pfam Description: Ribosomal protein S5, C-terminal domain
  misc_feature (89)..(155): Pfam Name: Ribosomal_S5 Pfam Description: Ribosomal protein S5, N-terminal domain
  misc_feature: SWISSPROT Homolog: RS2_ARATH 40S ribosomal protein S2 with e-value of 2.8e-126 and BLAST sequence identity of 91.2
  misc_feature: SWISSPROT Homolog: RS2_MOUSE 40S ribosomal protein S2 (S4) (LLRep3 protein) with e-value of 3.7e-101 and BLAST sequence identity of 74.0
  misc_feature: SWISSPROT Homolog: RS2_RAT 40S ribosomal protein S2 with e-value of 3.7e-101 and BLAST sequence identity of 74.0
  misc_feature: SWISSPROT Homolog: RS2_HUMAN 40S ribosomal protein S2 (S4) (LLRep3 protein) with e-value of 5.9e-101 and BLAST sequence identity of 74.0
  misc_feature: SWISSPROT Homolog: RS2_BOVIN 40S ribosomal protein S2 (Fragment) with e-value of 1.1e-99 and BLAST sequence identity of 73.2
  misc_feature 248142:<222: Transcription Factor
  misc_feature: Phenotype: FLOWER - Aborted fertility Useful for sterility, genetic confinement systems
  misc_feature: Phenotype: SILIQUES - Other Useful for increasing seed/fruit yield or modifying fruit content
  misc_feature (1)..(276): Functional Homolog of  Ceres CLONE ID no. 101250 at SEQ ID NO. 2249 with e-value of 7.30E-118 and BLAST sequence identity of 85.8

SEQ ID NO: 2210 - DNA, 897 bp, Populus balsamifera subsp. trichocarpa; identical to SEQ ID NO: 2069
  misc_feature (1)..(897): Ceres ANNOT ID no. 1492957
  misc_feature 248236:<222: Transcription Factor
  misc_feature: Phenotype: FLOWER - Aborted fertility Useful for sterility, genetic confinement systems
  misc_feature: Phenotype: SILIQUES - Other Useful for increasing seed/fruit yield or modifying fruit content

SEQ ID NO: 2211 - protein, 298 aa, Populus balsamifera subsp. trichocarpa; identical to SEQ ID NO: 2070
  misc_feature (1)..(298): Ceres ANNOT ID no. 1492957
  misc_feature (109)..(175): Pfam Name: Ribosomal_S5 Pfam Description: Ribosomal protein S5, N-terminal domain
  misc_feature (192)..(265): Pfam Name: Ribosomal_S5_C Pfam Description: Ribosomal protein S5, C-terminal domain
  misc_feature: SWISSPROT Homolog: RS2_ARATH 40S ribosomal protein S2 with e-value of 2.8e-126 and BLAST sequence identity of 91.2
  misc_feature: SWISSPROT Homolog: RS2_MOUSE 40S ribosomal protein S2 (S4) (LLRep3 protein) with e-value of 3.7e-101 and BLAST sequence identity of 74.0
  misc_feature: SWISSPROT Homolog: RS2_RAT 40S ribosomal protein S2 with e-value of 3.7e-101 and BLAST sequence identity of 74.0
  misc_feature: SWISSPROT Homolog: RS2_HUMAN 40S ribosomal protein S2 (S4) (LLRep3 protein) with e-value of 5.9e-101 and BLAST sequence identity of 74.0
  misc_feature: SWISSPROT Homolog: RS2_BOVIN 40S ribosomal protein S2 (Fragment) with e-value of 1.1e-99 and BLAST sequence identity of 73.2
  misc_feature 248348:<222: Transcription Factor
  misc_feature: Phenotype: FLOWER - Aborted fertility Useful for sterility, genetic confinement systems
  misc_feature: Phenotype: SILIQUES - Other Useful for increasing seed/fruit yield or modifying fruit content
  misc_feature (1)..(298): Functional Homolog of  Ceres CLONE ID no. 101250 at SEQ ID NO. 2249 with e-value of 1.19E-108 and BLAST sequence identity of 84.7

SEQ ID NO: 2212 - protein, 464 aa, Arabidopsis thaliana
  misc_feature (1)..(464): Ceres CLONE ID no. 101686
  misc_feature (184)..(220): Pfam Name: E3_binding Pfam Description: e3 binding domain
  misc_feature (240)..(464): Pfam Name: 2-oxoacid_dh Pfam Description: 2-oxoacid dehydrogenases acyltransferase catalytic domain)
  misc_feature (40)..(113): Pfam Name: Biotin_lipoyl Pfam Description: Biotin-requiring enzyme
  misc_feature: Phenotype: WHOLE PLANT - High Anthocyanin Useful for modulating anthocyanin content
  misc_feature: Phenotype: INFLORESCENCE - Reduced Apical Dominance Useful for modifying plant structure, ie increased branching
  misc_feature: Phenotype: INFLORESCENCE - Other Useful for making ornamental plants with modified flowers
MSRLLQTPFLPSVSLPTKTRSSVTGFRVKPRIIPIQAKIREIFMPALSSTMTEGKIVSWVKSEGDKLNKGESVVVVESDKADMDVETFYDGYLAAIMVEEGGVAPVGSAIALLAETEDEIADAKAKASGGGGDSKAPPPASPPTATVVAPVAVEKKIAAPPVAIKAVAASAVHPASEGGKRIVASPYAKKLAKELNVELAGLVGSGPMGRIVAKDVEAVAAGGGVQAAVAVKEVVAVPGVELGSVVPFTTMQGAVSRNMVESLAVPTFRVGYTISTDALDALYKKIKSKGVTMTALLAKATALALAKHPVVNSSCRDGNSFVYNSSINVAVAVAIDGGLITPVLQNADKVDIYSLSRKWKELVDKARAKQLQPQEYNTGTFTLSNLGMFGVDRFDAILPPGTGAIMAVGASQPSVVATKDGRIGMKNQMQVNVTADHRVIYGADLAQFLQTLASIIEDPKDLTF

SEQ ID NO: 2213 - DNA, 1416 bp, Populus balsamifera subsp. trichocarpa
  misc_feature (1)..(1416): Ceres ANNOT ID no. 1479756
  misc_feature 248590:<222: Transcription Factor
  misc_feature: Phenotype: WHOLE PLANT - High Anthocyanin Useful for modulating anthocyanin content
  misc_feature: Phenotype: INFLORESCENCE - Reduced Apical Dominance Useful for modifying plant structure, ie increased branching
  misc_feature: Phenotype: INFLORESCENCE - Other Useful for making ornamental plants with modified flowers
atggctcaccttctccacaccacattccttccttcctcctcttctctccctcaaaaaccctgtctttcttcaagcccatctcacatttcctcttcaagaacccgggtccatgccaagatccgcgaaatcttcatgcctgctttgagctctactatgactgaaggaaagattgttgcttgggtcaaatccgaaggtgacaagctttctaaaggtgaaagtgttgtcgttgttgaatccgataaggctgacatggatgttgagactttctatgatggttacttggctgccatcatggtcgaggaaggtggtgttgctgcaattggatcggctattgctttattagctgaatcccaggaggaaatcgaggaggccaagtctaaagctgctgcttcttcgtcttcttcttctccagctccggatcagaatccatccgcggcggctccggctctggaatccaccgttgctgttgataaggctgttgtggtggcgccgccttctccgtcggtggtggcatcggctgtgcacccagcgtcggagggagggaagagggtggtcgcgtcgccgtatgccaagaagcttgggaatgagttgaaggttgagttggggagagtgatagggagtgggcctaatgggagaattgtggctaaggatgttgaggctgcggcggcagcggctgctgaattgggttcaacaggtgcaaaggtttcgggggcaccttctgtacacgcacggcctgggattgagttgggatcggtggtgccttttacgacaatgcaaggggcagtgagtaggaatatggtggagagtttgtcagtgcctacatttagagtggggtatactattaccactgatgcacttgatgctctttacaagaagatcaagtccaagggagtgacgatgacagcattacttgcaaaggcaaccgcactggcattggttaagcatcctttaataaactccagttgccgagatggtaatagctttacatataatagtagcgtcaacattgcagttgctgtggctatggatggtggcttgattacacctgtgcttcaagatgctgataaggttgacatttactcattgtcaagaaaatggaaggagttagtcgataaggcccgggccaagcaactgcaacctcaagaatacaacacaggtactttcacactttctaacttgggaatgtttggtgtggatcgatttgatgccattctgccccctggaactggagcaattatggctgttggagcatcacagccaactgttgtaggaaccaaggacggccggattggcatgaagaatcagatgcaggtaaatgttacagccgatcatcgggtaatctatggtgctgatcttgctgccttcttgcaaacactggcaaagattatcgaggaccccaaagatcttaccttctaa

SEQ ID NO: 2214 - protein, 471 aa, Populus balsamifera subsp. trichocarpa
  misc_feature (1)..(471): Ceres ANNOT ID no. 1479756
  misc_feature (186)..(222): Pfam Name: E3_binding Pfam Description: e3 binding domain
  misc_feature (247)..(471): Pfam Name: 2-oxoacid_dh Pfam Description: 2-oxoacid dehydrogenases acyltransferase catalytic domain)
  misc_feature (41)..(114): Pfam Name: Biotin_lipoyl Pfam Description: Biotin-requiring enzyme
  misc_feature: SWISSPROT Homolog: ODP2_ZYMMO Dihydrolipoyllysine-residue acetyltransferase component of pyruvate dehydrogenase complex with e-value of 1.9e-56 and BLAST sequence identity of 34.3
  misc_feature: SWISSPROT Homolog: ODP2_ZYMMO EC 2.3.1.12 (E2) (Dihydrolipoamide acetyltransferase component of pyruvate dehydrogenase complex)
  misc_feature: SWISSPROT Homolog: ODP2_RICCN Dihydrolipoyllysine-residue acetyltransferase component of pyruvate dehydrogenase complex with e-value of 4.0e-56 and BLAST sequence identity of 35.0
  misc_feature: SWISSPROT Homolog: ODP2_RICCN EC 2.3.1.12 (E2) (Dihydrolipoamide acetyltransferase component of pyruvate dehydrogenase complex)
  misc_feature: SWISSPROT Homolog: ODP2_RAT Dihydrolipoyllysine-residue acetyltransferase component of pyruvate dehydrogenase complex with e-value of 2.0e-54 and BLAST sequence identity of 33.8
  misc_feature: SWISSPROT Homolog: ODP2_RAT EC 2.3.1.12 (E2) (Dihydrolipoamide acetyltransferase component of pyruvate dehydrogenase complex) ( PDC-E2)
  misc_feature: SWISSPROT Homolog: ODP2_RICPR Dihydrolipoyllysine-residue acetyltransferase component of pyruvate dehydrogenase complex with e-value of 4.6e-54 and BLAST sequence identity of 34.5
  misc_feature: SWISSPROT Homolog: ODP2_RICPR EC 2.3.1.12 (E2) (Dihydrolipoamide acetyltransferase component of pyruvate dehydrogenase complex)
  misc_feature: SWISSPROT Homolog: ODP2_HUMAN Dihydrolipoyllysine-residue acetyltransferase component of pyruvate dehydrogenase complex, with e-value of 6.9e-52 and BLAST sequence identity of 32.7
  misc_feature: SWISSPROT Homolog: ODP2_HUMAN EC 2.3.1.12 (Pyruvate dehydrogenase complex E2 subunit) ( PDCE2) (E2) (Dihydrolipoamide S-acetyltransferase component
  misc_feature 248777:<222: Transcription Factor
  misc_feature: Phenotype: WHOLE PLANT - High Anthocyanin Useful for modulating anthocyanin content
  misc_feature: Phenotype: INFLORESCENCE - Reduced Apical Dominance Useful for modifying plant structure, ie increased branching
  misc_feature: Phenotype: INFLORESCENCE - Other Useful for making ornamental plants with modified flowers
  misc_feature (1)..(471): Functional Homolog of  Ceres CLONE ID no. 101686 at SEQ ID NO. 2256 with e-value of 7.20E-182 and BLAST sequence identity of 78.6
MAHLLHTTFLPSSSSLPQKPCLSSSPSHISSSRTRVHAKIREIFMPALSSTMTEGKIVAWVKSEGDKLSKGESVVVVESDKADMDVETFYDGYLAAIMVEEGGVAAIGSAIALLAESQEEIEEAKSKAAASSSSSSPAPDQNPSAAAPALESTVAVDKAVVVAPPSPSVVASAVHPASEGGKRVVASPYAKKLGNELKVELGRVIGSGPNGRIVAKDVEAAAAAAAELGSTGAKVSGAPSVHARPGIELGSVVPFTTMQGAVSRNMVESLSVPTFRVGYTITTDALDALYKKIKSKGVTMTALLAKATALALVKHPLINSSCRDGNSFTYNSSVNIAVAVAMDGGLITPVLQDADKVDIYSLSRKWKELVDKARAKQLQPQEYNTGTFTLSNLGMFGVDRFDAILPPGTGAIMAVGASQPTVVGTKDGRIGMKNQMQVNVTADHRVIYGADLAAFLQTLAKIIEDPKDLTF

SEQ ID NO: 2215 - DNA, 1428 bp, Populus balsamifera subsp. trichocarpa
  misc_feature (1)..(1428): Ceres ANNOT ID no. 1540137
  misc_feature 248914:<222: Transcription Factor
  misc_feature: Phenotype: WHOLE PLANT - High Anthocyanin Useful for modulating anthocyanin content
  misc_feature: Phenotype: INFLORESCENCE - Reduced Apical Dominance Useful for modifying plant structure, ie increased branching
  misc_feature: Phenotype: INFLORESCENCE - Other Useful for making ornamental plants with modified flowers
atggctctcttcctccaaaccacatttcttacttcctcctcttctcttcgccaaaaaccctgtctttcttcctgggcttcccacatttcctcttcaagaacccgcacccgcacccgcgttcatgccaagatccgcgaaatcttcatgcctgctttgagttctactatgactgaaggcaagattgtttcttgggtcaagtccgaaggtgataagctttctaaaggtgaaagtgttgttgttgttgaatccgacaaggctgacatggacgttgagactttctatgatggttacttggctgccatcatggtcgaggaaggtggtgttgctgccgttggatcggccattgctttgttagctgaatccccggaggaaattgaagaggctaagtctaaagctgcttcttcttctccggctacatctccagccccggcggtggcggcggctccggtttcggaatccaccactggttctggggctgttgagaaggcagtcgtggtgacgccaccgtctccgtcggtggtggcatcggcggtgcatccggcgtcggagggagggaaaagggtggtggcgtcgccgtatgccaagaagctcgcgaaggatttgaaggtggatttggggagagtgatagggagtgggcctaatggcagaattgttgccaaggatgttgaggctgctgctgcagtggctgctgaattgggttccccagcagcgaaggtttcggcggcacctgctgtgcaggcaccgcccgggattgagttgggatcggtggtgccttttacgacgatgcaaggggcagtatgtaggaatatggtggagagtttgtcagtgcctacatttagagttgggtatactattactactgatgcacttgatgctctttacaagaaggtcaagtccaagggagtgacaatgacagcattacttgcaaaggcaactgcactggcattggttaagcatccagtaataaactctagttgccgagatggtaatagctttacatataatagtagcatcaacattgcagttgctgtggctattgatggtggcttgattacacctgtgcttcaagatgctgataaggttgacatttactccctgtcaagaaaatggaaggagttagttgataaggcccgagccaagcaactgcaacctcaagaatacaacacgggcactttcacgctgtctaacctgggaatgtttggtgtggatcgatttgatgccattctgcctcctggaactggagcaattatggctgtcggagcatcacagccaactgttgtaggtaccaaagatggccggattggtatgaagaaccagatgcaggtaaatgttacagctgatcatcgtgtaatctatggtgctgatctggctgccttcttgcgaacactggcaaagattattgaggaccccaaagaccttaccttctaa

SEQ ID NO: 2216 - protein, 475 aa, Populus balsamifera subsp. trichocarpa
  misc_feature (1)..(475): Ceres ANNOT ID no. 1540137
  misc_feature (190)..(226): Pfam Name: E3_binding Pfam Description: e3 binding domain
  misc_feature (251)..(475): Pfam Name: 2-oxoacid_dh Pfam Description: 2-oxoacid dehydrogenases acyltransferase catalytic domain)
  misc_feature (45)..(118): Pfam Name: Biotin_lipoyl Pfam Description: Biotin-requiring enzyme
  misc_feature: SWISSPROT Homolog: ODP2_ZYMMO Dihydrolipoyllysine-residue acetyltransferase component of pyruvate dehydrogenase complex with e-value of 1.9e-56 and BLAST sequence identity of 34.3
  misc_feature: SWISSPROT Homolog: ODP2_ZYMMO EC 2.3.1.12 (E2) (Dihydrolipoamide acetyltransferase component of pyruvate dehydrogenase complex)
  misc_feature: SWISSPROT Homolog: ODP2_RICCN Dihydrolipoyllysine-residue acetyltransferase component of pyruvate dehydrogenase complex with e-value of 4.0e-56 and BLAST sequence identity of 35.0
  misc_feature: SWISSPROT Homolog: ODP2_RICCN EC 2.3.1.12 (E2) (Dihydrolipoamide acetyltransferase component of pyruvate dehydrogenase complex)
  misc_feature: SWISSPROT Homolog: ODP2_RAT Dihydrolipoyllysine-residue acetyltransferase component of pyruvate dehydrogenase complex with e-value of 2.0e-54 and BLAST sequence identity of 33.8
  misc_feature: SWISSPROT Homolog: ODP2_RAT EC 2.3.1.12 (E2) (Dihydrolipoamide acetyltransferase component of pyruvate dehydrogenase complex) ( PDC-E2)
  misc_feature: SWISSPROT Homolog: ODP2_RICPR Dihydrolipoyllysine-residue acetyltransferase component of pyruvate dehydrogenase complex with e-value of 4.6e-54 and BLAST sequence identity of 34.5
  misc_feature: SWISSPROT Homolog: ODP2_RICPR EC 2.3.1.12 (E2) (Dihydrolipoamide acetyltransferase component of pyruvate dehydrogenase complex)
  misc_feature: SWISSPROT Homolog: ODP2_HUMAN Dihydrolipoyllysine-residue acetyltransferase component of pyruvate dehydrogenase complex, with e-value of 6.9e-52 and BLAST sequence identity of 32.7
  misc_feature: SWISSPROT Homolog: ODP2_HUMAN EC 2.3.1.12 (Pyruvate dehydrogenase complex E2 subunit) ( PDCE2) (E2) (Dihydrolipoamide S-acetyltransferase component
  misc_feature 249101:<222: Transcription Factor
  misc_feature: Phenotype: WHOLE PLANT - High Anthocyanin Useful for modulating anthocyanin content
  misc_feature: Phenotype: INFLORESCENCE - Reduced Apical Dominance Useful for modifying plant structure, ie increased branching
  misc_feature: Phenotype: INFLORESCENCE - Other Useful for making ornamental plants with modified flowers
  misc_feature (1)..(475): Functional Homolog of  Ceres CLONE ID no. 101686 at SEQ ID NO. 2256 with e-value of 3.20E-179 and BLAST sequence identity of 79.8
MALFLQTTFLTSSSSLRQKPCLSSWASHISSSRTRTRTRVHAKIREIFMPALSSTMTEGKIVSWVKSEGDKLSKGESVVVVESDKADMDVETFYDGYLAAIMVEEGGVAAVGSAIALLAESPEEIEEAKSKAASSSPATSPAPAVAAAPVSESTTGSGAVEKAVVVTPPSPSVVASAVHPASEGGKRVVASPYAKKLAKDLKVDLGRVIGSGPNGRIVAKDVEAAAAVAAELGSPAAKVSAAPAVQAPPGIELGSVVPFTTMQGAVCRNMVESLSVPTFRVGYTITTDALDALYKKVKSKGVTMTALLAKATALALVKHPVINSSCRDGNSFTYNSSINIAVAVAIDGGLITPVLQDADKVDIYSLSRKWKELVDKARAKQLQPQEYNTGTFTLSNLGMFGVDRFDAILPPGTGAIMAVGASQPTVVGTKDGRIGMKNQMQVNVTADHRVIYGADLAAFLRTLAKIIEDPKDLTF

SEQ ID NO: 2217 - DNA, 1515 bp, Populus balsamifera subsp. trichocarpa
  misc_feature (1)..(1515): Ceres ANNOT ID no. 1486722
  misc_feature 249238:<222: Transcription Factor
  misc_feature: Phenotype: WHOLE PLANT - High Anthocyanin Useful for modulating anthocyanin content
  misc_feature: Phenotype: INFLORESCENCE - Reduced Apical Dominance Useful for modifying plant structure, ie increased branching
  misc_feature: Phenotype: INFLORESCENCE - Other Useful for making ornamental plants with modified flowers
atggctctcttcctccaaaccacatttcttacttcctcctcttctcttcgccaaaaaccctgtctttcttcctgggcttcccacatttcctcttcaagaacccgcacccgcacccgcgttcatgccaagatccgcgaaatcttcatgcctgctttgagttctactatgactgaaggcaagattgtttcttgggtcaagtccgaaggtgataagctttctaaaggtgaaagtgttgttgttgttgaatccgacaaggctgacatggacgttgagactttctatgatggttacttggctgccatcatggtcgaggaaggtggtgttgctgccgttggatcggccattgctttgttagctgaatccccggaggaaattgaagaggctaagtctaaagctgcttcttcttctccggctacatctccagccccggcggtggcggcggctccggtttcggaatccaccactggttctggggctgttgagaaggcagtcgtggtgacgccaccgtctccgtcggtggtggcatcggcggtgcatccggcgtcggagggagggaaaagggtggtggcgtcgccgtatgccaagaagctcgcgaaggatttgaaggtggatttggggagagtgatagggagtgggcctaatggcagaattgttgccaaggatgttgaggctgctgctgcagtggctgctgaattgggttccccagcagcgaaggtttcggcggcacctgctgtgcaggcaccgcccgggattgagttgggatcggtggtgccttttacgacgatgcaaggggcagtatgtaggaatatggtggagagtttgtcagtgcctacatttagagttgggtatactattactactgatgcacttgatgctctttacaagaaggtcaagtccaagggagtgacaatgacagcattacttgcaaaggcaactgcactggcattggttaagcatccagtaataaactctagttgccgagatggtaatagctttacatataatagtagcatcaacattgcagttgctgtggctattgatggtggcttgattacacctgtgcttcaagatgctgataaggttgacatttactccctgtcaagaaaatggaaggagttagttgataaggcccgagccaagcaactgcaacctcaagaatacaacacggttcaaaaccttgatgtgatgaagtttccatgtgtttctcatttgcctttctcagtgattcataggcatggctgttctctggttgctggcactttcacgctgtctaacctgggaatgtttggtgtggatcgatttgatgccattctgcctcctggaactggagcaattatggctgtcggagcatcacagccaactgttgtaggtaccaaagatggccggattggtatgaagaaccagatgcaggtaaatgttacagctgatcatcgtgtaatctatggtgctgatctggctgccttcttgcgaacactggcaaagattattgaggaccccaaagaccttaccttctaa

SEQ ID NO: 2218 - protein, 504 aa, Populus balsamifera subsp. trichocarpa
  misc_feature (1)..(504): Ceres ANNOT ID no. 1486722
  misc_feature (190)..(226): Pfam Name: E3_binding Pfam Description: e3 binding domain
  misc_feature (419)..(504): Pfam Name: 2-oxoacid_dh Pfam Description: 2-oxoacid dehydrogenases acyltransferase catalytic domain)
  misc_feature (45)..(118): Pfam Name: Biotin_lipoyl Pfam Description: Biotin-requiring enzyme
  misc_feature: SWISSPROT Homolog: ODP2_ZYMMO Dihydrolipoyllysine-residue acetyltransferase component of pyruvate dehydrogenase complex with e-value of 1.9e-56 and BLAST sequence identity of 34.3
  misc_feature: SWISSPROT Homolog: ODP2_ZYMMO EC 2.3.1.12 (E2) (Dihydrolipoamide acetyltransferase component of pyruvate dehydrogenase complex)
  misc_feature: SWISSPROT Homolog: ODP2_RICCN Dihydrolipoyllysine-residue acetyltransferase component of pyruvate dehydrogenase complex with e-value of 4.0e-56 and BLAST sequence identity of 35.0
  misc_feature: SWISSPROT Homolog: ODP2_RICCN EC 2.3.1.12 (E2) (Dihydrolipoamide acetyltransferase component of pyruvate dehydrogenase complex)
  misc_feature: SWISSPROT Homolog: ODP2_RAT Dihydrolipoyllysine-residue acetyltransferase component of pyruvate dehydrogenase complex with e-value of 2.0e-54 and BLAST sequence identity of 33.8
  misc_feature: SWISSPROT Homolog: ODP2_RAT EC 2.3.1.12 (E2) (Dihydrolipoamide acetyltransferase component of pyruvate dehydrogenase complex) ( PDC-E2)
  misc_feature: SWISSPROT Homolog: ODP2_RICPR Dihydrolipoyllysine-residue acetyltransferase component of pyruvate dehydrogenase complex with e-value of 4.6e-54 and BLAST sequence identity of 34.5
  misc_feature: SWISSPROT Homolog: ODP2_RICPR EC 2.3.1.12 (E2) (Dihydrolipoamide acetyltransferase component of pyruvate dehydrogenase complex)
  misc_feature: SWISSPROT Homolog: ODP2_HUMAN Dihydrolipoyllysine-residue acetyltransferase component of pyruvate dehydrogenase complex, with e-value of 6.9e-52 and BLAST sequence identity of 32.7
  misc_feature: SWISSPROT Homolog: ODP2_HUMAN EC 2.3.1.12 (Pyruvate dehydrogenase complex E2 subunit) ( PDCE2) (E2) (Dihydrolipoamide S-acetyltransferase component
  misc_feature 249429:<222: Transcription Factor
  misc_feature: Phenotype: WHOLE PLANT - High Anthocyanin Useful for modulating anthocyanin content
  misc_feature: Phenotype: INFLORESCENCE - Reduced Apical Dominance Useful for modifying plant structure, ie increased branching
  misc_feature: Phenotype: INFLORESCENCE - Other Useful for making ornamental plants with modified flowers
  misc_feature (1)..(504): Functional Homolog of  Ceres CLONE ID no. 101686 at SEQ ID NO. 2256 with e-value of 2.49E-172 and BLAST sequence identity of 79.8
MALFLQTTFLTSSSSLRQKPCLSSWASHISSSRTRTRTRVHAKIREIFMPALSSTMTEGKIVSWVKSEGDKLSKGESVVVVESDKADMDVETFYDGYLAAIMVEEGGVAAVGSAIALLAESPEEIEEAKSKAASSSPATSPAPAVAAAPVSESTTGSGAVEKAVVVTPPSPSVVASAVHPASEGGKRVVASPYAKKLAKDLKVDLGRVIGSGPNGRIVAKDVEAAAAVAAELGSPAAKVSAAPAVQAPPGIELGSVVPFTTMQGAVCRNMVESLSVPTFRVGYTITTDALDALYKKVKSKGVTMTALLAKATALALVKHPVINSSCRDGNSFTYNSSINIAVAVAIDGGLITPVLQDADKVDIYSLSRKWKELVDKARAKQLQPQEYNTVQNLDVMKFPCVSHLPFSVIHRHGCSLVAGTFTLSNLGMFGVDRFDAILPPGTGAIMAVGASQPTVVGTKDGRIGMKNQMQVNVTADHRVIYGADLAAFLRTLAKIIEDPKDLTF

SEQ ID NO: 2219 - protein, 115 aa, Arabidopsis thaliana
  misc_feature (1)..(115): Ceres CLONE ID no. 101798
  misc_feature (27)..(111): Pfam Name: Tryp_alpha_amyl Pfam Description: Protease inhibitor/seed storage/LTP family
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
MAFALRFFTCLVLTVCIVASVDAAISCGTVAGSLAPCATYLSKGGLVPPSCCAGVKTLNSMAKTTPDRQQACRCIQSTAKSISGLNPSLASGLPGKCGVSIPYPISMSTNCNNIK

SEQ ID NO: 2220 - DNA, 357 bp, Populus balsamifera subsp. trichocarpa
  misc_feature (1)..(357): Ceres ANNOT ID no. 1449432
  misc_feature 249645:<222: Transcription Factor
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
atggcttcttcaatgggcttgaagctgacctatgccatgcttatagcgatggttgttagtgcacctctagcagaagctgccatctcttgtggccaagtgtcaagcagcttggcacaatgtataggctacctccagaaaggtggggctttgcctgcagcttgctgcagtgggttgaaagcacttaattctgcatccaagaccacccctgaccgccaaggggtctgcaactgtttgaaatccttggctggtaagatctctggcctcaactatggcttggctgctggcctcccttcaaagtgtggtgtatccatctcctacaaaatcagtccttccacagattgcaaaagcgtgaagtga

SEQ ID NO: 2221 - protein, 114 aa, Populus balsamifera subsp. trichocarpa
  misc_feature (1)..(114): Ceres ANNOT ID no. 1449432
  misc_feature (26)..(110): Pfam Name: Tryp_alpha_amyl Pfam Description: Protease inhibitor/seed storage/LTP family
  misc_feature: SWISSPROT Homolog: NLTP3_ARATH Nonspecific lipid-transfer protein 3 precursor (LTP 3) with e-value of 7.0e-59 and BLAST sequence identity of 100.0
  misc_feature: SWISSPROT Homolog: NLTP4_ARATH Nonspecific lipid-transfer protein 4 precursor (LTP 4) with e-value of 1.4e-46 and BLAST sequence identity of 81.7
  misc_feature: SWISSPROT Homolog: NLTP_MALDO Nonspecific lipid-transfer protein precursor (LTP) (Allergen Mal d 3) with e-value of 5.7e-32 and BLAST sequence identity of 57.1
  misc_feature: SWISSPROT Homolog: NLTP_PYRCO Nonspecific lipid-transfer protein precursor (LTP) (Allergen Pyr c 3) with e-value of 7.3e-32 and BLAST sequence identity of 56.2
  misc_feature: SWISSPROT Homolog: NLTP_HELAN Nonspecific lipid-transfer protein precursor (LTP) (NsLTP) (SDI-9) with e-value of 4.0e-31 and BLAST sequence identity of 56.0
  misc_feature 249749:<222: Transcription Factor
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature (1)..(114): Functional Homolog of  Ceres CLONE ID no. 101798 at SEQ ID NO. 2263 with e-value of 5.89E-29 and BLAST sequence identity of 55.5
MGLKLTYAMLIAMVVSAPLAEAAISCGQVSSSLAQCIGYLQKGGALPAACCSGLKALNSASKTTPDRQGVCNCLKSLAGKISGLNYGLAAGLPSKCGVSISYKISPSTDCKSVK

SEQ ID NO: 2222 - DNA, 357 bp, Populus balsamifera subsp. trichocarpa
  misc_feature (1)..(357): Ceres ANNOT ID no. 1449431
  misc_feature 249827:<222: Transcription Factor
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
atggcttcttcaatgagcttgaagctggcctgtgccatgcttgtagcgatggttgttagtgcaccactagcagaagctgccatctcatgtggccaggtgtcaagcagcttggcacaatgtataacctacctccagaagggtggggctgtgcctgcagcttgctgcagtgggttgaaaggacttaattctgcagccacgaccaccgccgaccgccaaggggtctgcaactgtttgaaatccttggctggtaagatctctggcatcaactatggcgtggctgctggcctcccttcaaagtgtggtgtatccatctcctacaaaatcagtccttccacagattgcaaaagcgtgaagtga

SEQ ID NO: 2223 - protein, 118 aa, Populus balsamifera subsp. trichocarpa
  misc_feature (1)..(118): Ceres ANNOT ID no. 1449431
  misc_feature (30)..(114): Pfam Name: Tryp_alpha_amyl Pfam Description: Protease inhibitor/seed storage/LTP family
  misc_feature: SWISSPROT Homolog: NLTP3_ARATH Nonspecific lipid-transfer protein 3 precursor (LTP 3) with e-value of 7.0e-59 and BLAST sequence identity of 100.0
  misc_feature: SWISSPROT Homolog: NLTP4_ARATH Nonspecific lipid-transfer protein 4 precursor (LTP 4) with e-value of 1.4e-46 and BLAST sequence identity of 81.7
  misc_feature: SWISSPROT Homolog: NLTP_MALDO Nonspecific lipid-transfer protein precursor (LTP) (Allergen Mal d 3) with e-value of 5.7e-32 and BLAST sequence identity of 57.1
  misc_feature: SWISSPROT Homolog: NLTP_PYRCO Nonspecific lipid-transfer protein precursor (LTP) (Allergen Pyr c 3) with e-value of 7.3e-32 and BLAST sequence identity of 56.2
  misc_feature: SWISSPROT Homolog: NLTP_HELAN Nonspecific lipid-transfer protein precursor (LTP) (NsLTP) (SDI-9) with e-value of 4.0e-31 and BLAST sequence identity of 56.0
  misc_feature 249931:<222: Transcription Factor
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature (1)..(118): Functional Homolog of  Ceres CLONE ID no. 101798 at SEQ ID NO. 2263 with e-value of 1.20E-28 and BLAST sequence identity of 56.6
MASSMSLKLACAMLVAMVVSAPLAEAAISCGQVSSSLAQCITYLQKGGAVPAACCSGLKGLNSAATTTADRQGVCNCLKSLAGKISGINYGVAAGLPSKCGVSISYKISPSTDCKSVK

SEQ ID NO: 2224 - DNA, 360 bp, Populus balsamifera subsp. trichocarpa
  misc_feature (1)..(360): Ceres ANNOT ID no. 1502439
  misc_feature 250009:<222: Transcription Factor
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
atggcttcttcaatgagcttgaagctggcctgtgccatgcttgtagcgatggttgttagtgcaccactagcagaagctgccatctcatgtggccaggtgtcaagcagcttggcacaatgtataacctacctccagaagggtggggctgtgcctgcagcttgctgcagtgggttgaaaggacttaattctgcagccacgaccaccgccgaccgccaaggggtctgcaactgtttgaaatccttggctggtaagatctctggcatcaactatggcgtggctgctggcctcccttcaaagtgtggtgtatccatctcctacaaaatcagtccttccacagattgcaaaagtacgatattgtag

SEQ ID NO: 2225 - protein, 119 aa, Populus balsamifera subsp. trichocarpa
  misc_feature (1)..(119): Ceres ANNOT ID no. 1502439
  misc_feature (30)..(114): Pfam Name: Tryp_alpha_amyl Pfam Description: Protease inhibitor/seed storage/LTP family
  misc_feature: SWISSPROT Homolog: NLTP3_ARATH Nonspecific lipid-transfer protein 3 precursor (LTP 3) with e-value of 7.0e-59 and BLAST sequence identity of 100.0
  misc_feature: SWISSPROT Homolog: NLTP4_ARATH Nonspecific lipid-transfer protein 4 precursor (LTP 4) with e-value of 1.4e-46 and BLAST sequence identity of 81.7
  misc_feature: SWISSPROT Homolog: NLTP_MALDO Nonspecific lipid-transfer protein precursor (LTP) (Allergen Mal d 3) with e-value of 5.7e-32 and BLAST sequence identity of 57.1
  misc_feature: SWISSPROT Homolog: NLTP_PYRCO Nonspecific lipid-transfer protein precursor (LTP) (Allergen Pyr c 3) with e-value of 7.3e-32 and BLAST sequence identity of 56.2
  misc_feature: SWISSPROT Homolog: NLTP_HELAN Nonspecific lipid-transfer protein precursor (LTP) (NsLTP) (SDI-9) with e-value of 4.0e-31 and BLAST sequence identity of 56.0
  misc_feature 250115:<222: Transcription Factor
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature (1)..(119): Functional Homolog of  Ceres CLONE ID no. 101798 at SEQ ID NO. 2263 with e-value of 8.60E-28 and BLAST sequence identity of 56.7
MASSMSLKLACAMLVAMVVSAPLAEAAISCGQVSSSLAQCITYLQKGGAVPAACCSGLKGLNSAATTTADRQGVCNCLKSLAGKISGINYGVAAGLPSKCGVSISYKISPSTDCKSTIL

SEQ ID NO: 2226 - protein, 216 aa, Arabidopsis thaliana
  misc_feature (1)..(216): Ceres CLONE ID no. 102017
  misc_feature (15)..(176): Pfam Name: Ras Pfam Description: Ras family
  misc_feature: Phenotype: WHOLE PLANT - Small Useful for modulating plant size
MAGYRADDEYDYLFKVVLIGDSGVGKSNLLSLFTKNEFSLESKSTIGVEFATRSLNVDDKVIKAQIWDTAGQERYRAITSAYYRGAVGALLVYDVTRHSTFENVETWLKELRNHTDPNIVVMLVGNKSDLRHLVAVQTEDAKSFAEKESLYFMETSAFEATNVENAFAEVLTQIHHIVSKKAMEAASESANVPSKGDKIDIGKDVSAVKKGGCCSN

SEQ ID NO: 2227 - DNA, 657 bp, Populus balsamifera subsp. trichocarpa
  misc_feature (1)..(657): Ceres ANNOT ID no. 1448974
  misc_feature 250263:<222: Transcription Factor
  misc_feature: Phenotype: WHOLE PLANT - Small Useful for modulating plant size
atggcagggtacagagccgaagatgactatgattacctgttcaaggttgtacttattggcgactcaggtgtgggcaagtccaatcttctttcaagattcactcgtaatgagttcagtttggagtcgaagtctactattggtgttgagttcgctactcgcagcttgaatgttgattccaaggtcattaaggcccagatttgggacactgctggccaagaaaggtaccgtgccataactagtgcttattaccggggagcagtgggtgcattgcttgtgtatgatgttacccggcactcaacatttgaaaatgttgaaaggtggctaagggagttgagggatcatacagatcctaacattgttgtcatgctcatcggcaataaatcagatcttcgccacctggtggctgtctcaactgaggatggaaaatcctttgccgagagggagtccctctacttcatggaaacatctgctttggaagctactaatgttgacaatgcatttgctgaagttcttaatcagatctatagtattgtgagcaagaaagctatggagacaggtgacaatgcagcagcttcagctgttccatccaaaggtgagaaaatcgatgtcaataaagatgtttccgctatgaagagggtggggtgctgttcaagctag

SEQ ID NO: 2228 - protein, 218 aa, Populus balsamifera subsp. trichocarpa
  misc_feature (1)..(218): Ceres ANNOT ID no. 1448974
  misc_feature (9)..(174): Pfam Name: Arf Pfam Description: ADP-ribosylation factor family
  misc_feature: SWISSPROT Homolog: RIC2_ORYSA Ras-related protein RIC2 with e-value of 9.6e-94 and BLAST sequence identity of 84.1
  misc_feature: SWISSPROT Homolog: RB11B_ARATH Ras-related protein Rab11 with e-value of 1.3e-89 and BLAST sequence identity of 81.1
  misc_feature: SWISSPROT Homolog: ARA2_ARATH Ras-related protein ARA-2 with e-value of 3.4e-89 and BLAST sequence identity of 77.3
  misc_feature: SWISSPROT Homolog: RB11D_LOTJA Ras-related protein Rab11D with e-value of 4.4e-89 and BLAST sequence identity of 79.7
  misc_feature: SWISSPROT Homolog: YPT3_NICPL Ras-related protein YPT3 with e-value of 7.2e-89 and BLAST sequence identity of 79.8
  misc_feature 250351:<222: Transcription Factor
  misc_feature: Phenotype: WHOLE PLANT - Small Useful for modulating plant size
  misc_feature (1)..(218): Functional Homolog of  Ceres CLONE ID no. 102017 at SEQ ID NO. 2270 with e-value of 1.70E-95 and BLAST sequence identity of 86.1
MAGYRAEDDYDYLFKVVLIGDSGVGKSNLLSRFTRNEFSLESKSTIGVEFATRSLNVDSKVIKAQIWDTAGQERYRAITSAYYRGAVGALLVYDVTRHSTFENVERWLRELRDHTDPNIVVMLIGNKSDLRHLVAVSTEDGKSFAERESLYFMETSALEATNVDNAFAEVLNQIYSIVSKKAMETGDNAAASAVPSKGEKIDVNKDVSAMKRVGCCSS

SEQ ID NO: 2229 - protein, 183 aa, Arabidopsis thaliana
  misc_feature (1)..(183): Ceres CLONE ID no. 102248
  misc_feature: Phenotype: INFLORESCENCE - Short Internode Useful for making modulating plant height and plants with modified flowers
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: CAULINE LEAVES - Oval Shaped Useful for making plants with increased biomass and foliage
  misc_feature: Phenotype: ROSETTE LEAVES - Oval Shaped Useful for making plants with increased biomass and foliage
MACLEMYNSNGGGGTPMSPRISFSNDFVEIRPETTKTTRSSPLSKQEGSSSSFSDNFEFSVSNYTMMPADELFSKGKLLPFKETNQVQRTLREELLVEEDEEEGPRDATNIFSLKPPIFSSSSSSSSSSKGRWKGLLGLKRAHVGSKNNDERFVHHMINNNKQSQEAIGGREGSSCREMKKSM

SEQ ID NO: 2230 - DNA, 528 bp, Populus balsamifera subsp. trichocarpa
  misc_feature (1)..(528): Ceres ANNOT ID no. 1456981
  misc_feature 250512:<222: Transcription Factor
  misc_feature: Phenotype: INFLORESCENCE - Short Internode Useful for making modulating plant height and plants with modified flowers
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: CAULINE LEAVES - Oval Shaped Useful for making plants with increased biomass and foliage
  misc_feature: Phenotype: ROSETTE LEAVES - Oval Shaped Useful for making plants with increased biomass and foliage
atggcatgtttagacatgtacaactccgagcacaaaggtcattgccctcccatgagccctagaatctccttttctaatgattttgttgattcccaacagattatgaagcaagaaaggagctcaagagagaccccagtgtccactgactttgaattctcagtgacaaactactccatgatgagtgccgatgagcttttcttcaagggcaggctcttgccattcaaagataatggcagcaaccaaatgcaaaggactattagagatgaacttcttgttgacgatgatgagggtgatgaagtttcaccgaggccacctaaaggttctacaaggtggaaagggctcctgggcctaaagagaagccacattggctccaagaaagttgataagagtgaagggtctatggagagatcagttggtgaaagtagaaggtccggttttgtccatgaggaagtgcaacatagcaagagttcacaggagattgtgagtgaaggaggatcaagttgcagagacgtggagattggaatatag

SEQ ID NO: 2231 - protein, 175 aa, Populus balsamifera subsp. trichocarpa
  misc_feature (1)..(175): Ceres ANNOT ID no. 1456981
  misc_feature 250583:<222: Transcription Factor
  misc_feature: Phenotype: INFLORESCENCE - Short Internode Useful for making modulating plant height and plants with modified flowers
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: CAULINE LEAVES - Oval Shaped Useful for making plants with increased biomass and foliage
  misc_feature: Phenotype: ROSETTE LEAVES - Oval Shaped Useful for making plants with increased biomass and foliage
  misc_feature (1)..(175): Functional Homolog of  Ceres CLONE ID no. 102248 at SEQ ID NO. 2273 with e-value of 8.09E-32 and BLAST sequence identity of 62.5
MACLDMYNSEHKGHCPPMSPRISFSNDFVDSQQIMKQERSSRETPVSTDFEFSVTNYSMMSADELFFKGRLLPFKDNGSNQMQRTIRDELLVDDDEGDEVSPRPPKGSTRWKGLLGLKRSHIGSKKVDKSEGSMERSVGESRRSGFVHEEVQHSKSSQEIVSEGGSSCRDVEIGI

SEQ ID NO: 2232 - protein, 176 aa, Arabidopsis thaliana
  misc_feature (1)..(176): Ceres CLONE ID no. 103581
  misc_feature (1)..(176): Also Known As Ceres CDNA ID no. 23462890
  misc_feature (1)..(176): Also Known As Ceres GEMINI ID 532G12
  misc_feature (24)..(86): Pfam Name: zf-Dof Pfam Description: Dof domain, zinc finger
  misc_feature 250697:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Short Useful for increasing seed/fruit yield or modifying fruit content
  misc_feature: Phenotype: ROSETTE LEAVES - Oval Shaped Useful for making plants with increased biomass and foliage
MPSEPNQTRPTRVQPSTAAYPPPNLAEPLPCPRCNSTTTKFCYYNNYNLAQPRYYCKSCRRYWTQGGTLRDVPVGGGTRRSSSKRHRSFSTTVTSSSSSSSVITSTTQEPATTEASQIKVSNVTSGHGSFASLLGLGSGNGGLDYGFGYGYGLEDMSIGYLGDSSVGEIPVVDGCG

SEQ ID NO: 2233 - DNA, 786 bp, Populus balsamifera subsp. trichocarpa
  misc_feature (1)..(786): Ceres ANNOT ID no. 1486398
  misc_feature 250807:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Short Useful for increasing seed/fruit yield or modifying fruit content
  misc_feature: Phenotype: ROSETTE LEAVES - Oval Shaped Useful for making plants with increased biomass and foliage
atgccaacagaaataagccagggacacccaacagaagcccaaaacaccatgggggctacacaccaaccaccaaaaacgactgagccactgccttgtccaaggtgtaactccaccaccacgaagttttgctattacaataactataacctctctcaacctcgccatttctgcaagtcatgccgccgttactggacacaaggtggaactctccgtgatgtccctgttggtggcggtacacgcaagaattccaagcgctctcgctcaacttcaaataattcttcatcaatatctacctcatcttctaattctacttcctcgaattctgcaactttgactgctttcaccaccactcatgaacccgaatccatgcccgtggttttatcctcgactactgactctggtttagcagctgtgaaaactgaggtaccagccgggttaaatctgaatgacggattaccttctgaagatggaaacttcatttcgctcatgaactctaacgatcagcatgggtttactggtcttggcgggtatggatacgcgtcaggttttggattcgggcctagtgaaatgggtattggatttggtggaagaggatcttggtcctgtcctgtaatggaaaatgttcttgttaatggtggtacttctggatgtcatccctggcagcttgattgtgatcatgttgaaggaggggggcttcaagctggatttacagcagatactgaaaattactttggttcttggcctgatcttgttatgtctgctccagcaggaaagggtttgaactga

SEQ ID NO: 2234 - protein, 261 aa, Populus balsamifera subsp. trichocarpa
  misc_feature (1)..(261): Ceres ANNOT ID no. 1486398
  misc_feature (25)..(87): Pfam Name: zf-Dof Pfam Description: Dof domain, zinc finger
  misc_feature: SWISSPROT Homolog: DOF16_ARATH Hypothetical Dof zinc finger protein DOF1.6 (AtDOF1.6) with e-value of 1.8e-92 and BLAST sequence identity of 96.0
  misc_feature: SWISSPROT Homolog: DOF34_ARATH Dof zinc finger protein DOF3.4 (AtDOF3.4) (OBF-binding protein 1) with e-value of 1.7e-30 and BLAST sequence identity of 50.4
  misc_feature: SWISSPROT Homolog: DOF58_ARATH Hypothetical Dof zinc finger protein DOF5.8 (AtDOF5.8) with e-value of 2.6e-29 and BLAST sequence identity of 43.0
  misc_feature: SWISSPROT Homolog: DOF56_ARATH Dof zinc finger protein DOF5.6 (AtDOF5.6) with e-value of 1.2e-28 and BLAST sequence identity of 43.2
  misc_feature: SWISSPROT Homolog: DOF36_ARATH Dof zinc finger protein DOF3.6 (AtDOF3.6) (OBF-binding protein 3) with e-value of 1.3e-27 and BLAST sequence identity of 47.1
  misc_feature 250955:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Short Useful for increasing seed/fruit yield or modifying fruit content
  misc_feature: Phenotype: ROSETTE LEAVES - Oval Shaped Useful for making plants with increased biomass and foliage
  misc_feature (1)..(261): Functional Homolog of  Ceres CLONE ID no. 103581 at SEQ ID NO. 2276 with e-value of 1.50E-39 and BLAST sequence identity of 58.4
MPTEISQGHPTEAQNTMGATHQPPKTTEPLPCPRCNSTTTKFCYYNNYNLSQPRHFCKSCRRYWTQGGTLRDVPVGGGTRKNSKRSRSTSNNSSSISTSSSNSTSSNSATLTAFTTTHEPESMPVVLSSTTDSGLAAVKTEVPAGLNLNDGLPSEDGNFISLMNSNDQHGFTGLGGYGYASGFGFGPSEMGIGFGGRGSWSCPVMENVLVNGGTSGCHPWQLDCDHVEGGGLQAGFTADTENYFGSWPDLVMSAPAGKGLN

SEQ ID NO: 2235 - DNA, 828 bp, Populus balsamifera subsp. trichocarpa
  misc_feature (1)..(828): Ceres ANNOT ID no. 1496840
  misc_feature 251088:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Short Useful for increasing seed/fruit yield or modifying fruit content
  misc_feature: Phenotype: ROSETTE LEAVES - Oval Shaped Useful for making plants with increased biomass and foliage
atgccatcagaaataagccagacacacccaaacgaagcccaaaacaccatggggactgcacccccaccaccaaaaacgactgagccactgccctgtccaaggtgtaactccaccatcaccaagttttgctacttcaacaactataacctctctcaacctcgctatttctgcaagtcatgccgacgttactggacaaaaggtgggaccctccgtgatgtgcctgttggtggtggttcacgcaagaactccaagcgctctcgctcatcttctaataattcttcaccatctacctcatcttccaactccactgcctcaaatcctgcaactttgactgcttttaccgccatccatgagcccgaatcaatacccgtggttgtatcctcgactacagactctggtgcagctgctgtgaagactgagatgccagcgggcataaatctgaatgaggggttggctgaaaatggaaacttcatctcgcttataagctctaatgatcaacatgggttcaatggtcttggcgggtacggttacggatcaggatttggactggggccttgtgaagtgggtcttggatttggtgcaagagggttttggtcctttcctggaatggaaaatgtttctgttaatggtggaaccatagggggttgtacttctgggtgcaatacttggcagctgcagggtgatcatgttgaaggagggggtagtcaaggtgggtttgcagctgatggtgagaattactttggttcttggcctggtcttgttatttctgctccagcagagaaaggcatggtctgtgtaagtgacctgttactgccgggtggtcgatag

SEQ ID NO: 2236 - protein, 275 aa, Populus balsamifera subsp. trichocarpa
  misc_feature (1)..(275): Ceres ANNOT ID no. 1496840
  misc_feature (25)..(87): Pfam Name: zf-Dof Pfam Description: Dof domain, zinc finger
  misc_feature: SWISSPROT Homolog: DOF16_ARATH Hypothetical Dof zinc finger protein DOF1.6 (AtDOF1.6) with e-value of 1.8e-92 and BLAST sequence identity of 96.0
  misc_feature: SWISSPROT Homolog: DOF34_ARATH Dof zinc finger protein DOF3.4 (AtDOF3.4) (OBF-binding protein 1) with e-value of 1.7e-30 and BLAST sequence identity of 50.4
  misc_feature: SWISSPROT Homolog: DOF58_ARATH Hypothetical Dof zinc finger protein DOF5.8 (AtDOF5.8) with e-value of 2.6e-29 and BLAST sequence identity of 43.0
  misc_feature: SWISSPROT Homolog: DOF56_ARATH Dof zinc finger protein DOF5.6 (AtDOF5.6) with e-value of 1.2e-28 and BLAST sequence identity of 43.2
  misc_feature: SWISSPROT Homolog: DOF36_ARATH Dof zinc finger protein DOF3.6 (AtDOF3.6) (OBF-binding protein 3) with e-value of 1.3e-27 and BLAST sequence identity of 47.1
  misc_feature 251236:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: ROSETTE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Short Useful for increasing seed/fruit yield or modifying fruit content
  misc_feature: Phenotype: ROSETTE LEAVES - Oval Shaped Useful for making plants with increased biomass and foliage
  misc_feature (1)..(275): Functional Homolog of  Ceres CLONE ID no. 103581 at SEQ ID NO. 2276 with e-value of 9.39E-38 and BLAST sequence identity of 58.1
MPSEISQTHPNEAQNTMGTAPPPPKTTEPLPCPRCNSTITKFCYFNNYNLSQPRYFCKSCRRYWTKGGTLRDVPVGGGSRKNSKRSRSSSNNSSPSTSSSNSTASNPATLTAFTAIHEPESIPVVVSSTTDSGAAAVKTEMPAGINLNEGLAENGNFISLISSNDQHGFNGLGGYGYGSGFGLGPCEVGLGFGARGFWSFPGMENVSVNGGTIGGCTSGCNTWQLQGDHVEGGGSQGGFAADGENYFGSWPGLVISAPAEKGMVCVSDLLLPGGR

SEQ ID NO: 2237 - protein, 317 aa, Arabidopsis thaliana
  misc_feature (1)..(317): Ceres CLONE ID no. 104929
  misc_feature (51)..(89): Pfam Name: WD40 Pfam Description: WD domain, G-beta repeat
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Serrate Margins Useful for making plants with increased biomass and foliage
MPVFKAPFNGYSVKFSPFYESRLAVATAQNFGILGNGRIHVLELAPGAPGVTESVSYDTADAVYDVCWSESHDSVLIAAIGDGSVKIYDTALPPPSNPIRSFQEHAREVQSVDYNPTRRDSFLTSSWDDTVKLWAMDRPASVRTFKEHAYCVYQAVWNPKHGDVFASASGDCTLRIWDVREPGSTMIIPAHDFEILSCDWNKYDDCILATSSVDKTVKVWDVRSYRVPLAVLNGHGYAVRKVKFSPHRRSLIASCSYDMSVCLWDYMVEDALVGRYDHHTEFAVGIDMSVLVEGLMASTGWDELVYVWQQGMDPRAS

SEQ ID NO: 2238 - DNA, 957 bp, Populus balsamifera subsp. trichocarpa
  misc_feature (1)..(957): Ceres ANNOT ID no. 1449020
  misc_feature 251481:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Serrate Margins Useful for making plants with increased biomass and foliage
atgccagtcttcaaaaccccattcaatggctactccgtcaaattcagcccattttacgaatcccgtctcgccgtcgccactgcccagaacttcggaatcctcggcaacggtcgtctccacgtcctctccttacctccagcaccctcctcccctctaaccgaactcatctccttcgacactgctgatggcatctacgaccttgcctggtctgaatcccacgattccctcttaatcgcagctgtggccgatgggtccgtcaagctttacgacaccgccttacccccaacacaaaacccaattcgttccctccaggaacacacgcgtgaagtccactcagtcgattacaatcccacgcgccgtgattcttttattaccgcttcctgggatgacacgattaaattatggacccttgacaggccggcgagtattcgtacgtttaaagaacacgcgtattgtgtttattctgctgcgtggaacccgaggcatacggatgtttttgcatctgcttccggggactgtactgtgcgaatctgggacgtgcgtgagccggggagtacgatgattattccaggtcatgattttgagattttgtgttgtgattggaataaatatgatgattgtattattgctactgcatcggtggataagagtattaaagtatgggatgtaaggagtttcagagctccgatttcggttttgaatggacatgggtatgctgttaggaaagttaagttttcgccccatcataggaatttgatggtttcgtgttcgtatgatatgagtgtttgtatgtgggattttatggttgaagatgcattggttgggaggtatgatcatcatactgagtttgctgttggagttgatatcagtgtgcttgttgatgggttgatggcaagcactgggtgggatgagttggtttatgtttggcagcatgggacggacccgagagcaccttga

SEQ ID NO: 2239 - protein, 318 aa, Populus balsamifera subsp. trichocarpa
  misc_feature (1)..(318): Ceres ANNOT ID no. 1449020
  misc_feature (53)..(90): Pfam Name: WD40 Pfam Description: WD domain, G-beta repeat
  misc_feature: SWISSPROT Homolog: PEX7_HUMAN Peroxisomal targeting signal 2 receptor (PTS2 receptor) (Peroxin-7) with e-value of 2.5e-70 and BLAST sequence identity of 44.9
  misc_feature: SWISSPROT Homolog: PEX7_CRIGR Peroxisomal targeting signal 2 receptor (PTS2 receptor) (Peroxin-7) with e-value of 6.9e-68 and BLAST sequence identity of 42.9
  misc_feature: SWISSPROT Homolog: PEX7_MOUSE Peroxisomal targeting signal 2 receptor (PTS2 receptor) (Peroxin-7) with e-value of 6.9e-68 and BLAST sequence identity of 43.2
  misc_feature: SWISSPROT Homolog: PEX7_SCHPO Peroxisomal targeting signal 2 receptor (PTS2 receptor) (Peroxin-7) with e-value of 2.9e-44 and BLAST sequence identity of 32.0
  misc_feature: SWISSPROT Homolog: PEX7_YEAST Peroxisomal targeting signal 2 receptor (PTS2 receptor) (Peroxisome import protein PAS7) (Peroxin-7) with e-value of 3.0e-41 and BLAST sequence identity of 41.6
  misc_feature 251605:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Serrate Margins Useful for making plants with increased biomass and foliage
  misc_feature (1)..(318): Functional Homolog of  Ceres CLONE ID no. 104929 at SEQ ID NO. 2281 with e-value of 6.99E-152 and BLAST sequence identity of 82.8
MPVFKTPFNGYSVKFSPFYESRLAVATAQNFGILGNGRLHVLSLPPAPSSPLTELISFDTADGIYDLAWSESHDSLLIAAVADGSVKLYDTALPPTQNPIRSLQEHTREVHSVDYNPTRRDSFITASWDDTIKLWTLDRPASIRTFKEHAYCVYSAAWNPRHTDVFASASGDCTVRIWDVREPGSTMIIPGHDFEILCCDWNKYDDCIIATASVDKSIKVWDVRSFRAPISVLNGHGYAVRKVKFSPHHRNLMVSCSYDMSVCMWDFMVEDALVGRYDHHTEFAVGVDISVLVDGLMASTGWDELVYVWQHGTDPRAP

SEQ ID NO: 2240 - protein, 215 aa, Arabidopsis thaliana
  misc_feature (1)..(215): Ceres CLONE ID no. 105104
  misc_feature: Phenotype: WHOLE PLANT - Misc. Dwarf Useful for modulating plant size
MVYLHSSISVCNSVDPMIMSHSSPKSRNTRNKSSSSPTCSKFPVCDGSQSAAIDVVILIAVITACGFLFFPYVKLITLKSIEVFSDLSLLVKQEILQNPIVYGSLALSIFCAAISTWLVILLCTMQRCGKPNCKGLRKAVEFDIQLETEECVKSSSNKRGMFELPRVHHRELEAELKKMAPPNGRAVLVFRARCGCSVRRLVVSGPKKQQRKIKK

SEQ ID NO: 2241 - DNA, 708 bp, Populus balsamifera subsp. trichocarpa
  misc_feature (1)..(708): Ceres ANNOT ID no. 1476817
  misc_feature 251783:<222: Transcription Factor
  misc_feature: Phenotype: WHOLE PLANT - Misc. Dwarf Useful for modulating plant size
atggtctatttccatagctcgatctcggtctgcaactcagttgaccaatcatcaacaacttccatggcaaatcctgtgaattccaatgagtttaatccaaaatcaaggcacaacaataatcatgtgcataagaataggaagacagcgaatggttcaagttgtaaaactatacctgtctgtgatcgatctcgatcagctgttattgatgttgtgatcttgattgctgttattggtgcctgtggattcttgttatttccttatatcaagcttgtaattcttggtttgattgaatttgtcgctgctattcattatgtggtcaaagaagaggttatgagaaacccactgatatttggatctatagggattagtactttttgtgccggaatagttgcctggatagtgattttgtgtactactaggaaatgtgggaatccaaactgtaagggtttaaggaaggcggcagagttcgatattcagttggagaccgaggagtgtatgaagaattctaatggtactttggtgaaagatgggctgaaaaggggcctttttgaattgcctcgtgatcaccaccgtgaattggaggctgaattgaagaagatggcaccggctaatggaagagctgttcttgtgtttcgagcaaggtgtggatgttctgttggaagattggaggttccaggaactaagaagccaaagaagatcaagaagtag

SEQ ID NO: 2242 - protein, 235 aa, Populus balsamifera subsp. trichocarpa
  misc_feature (1)..(235): Ceres ANNOT ID no. 1476817
  misc_feature 251832:<222: Transcription Factor
  misc_feature: Phenotype: WHOLE PLANT - Misc. Dwarf Useful for modulating plant size
  misc_feature (1)..(235): Functional Homolog of  Ceres CLONE ID no. 105104 at SEQ ID NO. 2284 with e-value of 5.90E-68 and BLAST sequence identity of 66.6
MVYFHSSISVCNSVDQSSTTSMANPVNSNEFNPKSRHNNNHVHKNRKTANGSSCKTIPVCDRSRSAVIDVVILIAVIGACGFLLFPYIKLVILGLIEFVAAIHYVVKEEVMRNPLIFGSIGISTFCAGIVAWIVILCTTRKCGNPNCKGLRKAAEFDIQLETEECMKNSNGTLVKDGLKRGLFELPRDHHRELEAELKKMAPANGRAVLVFRARCGCSVGRLEVPGTKKPKKIKK

SEQ ID NO: 2243 - DNA, 708 bp, Populus balsamifera subsp. trichocarpa
  misc_feature (1)..(708): Ceres ANNOT ID no. 1503063
  misc_feature 251910:<222: Transcription Factor
  misc_feature: Phenotype: WHOLE PLANT - Misc. Dwarf Useful for modulating plant size
atggtctatttccatagctcaatctcggtctgcaactcatttgaccagtcatcaacagcttccatggcaaattctgtgaattccagtgagtttaatccaaaatcaaggcacaacaataatcatgtgcacaagaataggaagacagtgaatggctcgaattgtaaaactatacctgtttgtgatagatctcaatcagctgttattgatgttgtgatcttgatagctgtcattggtgcttgtggattcttgttatttccttatatccggattgtaactcttggttttattgaatttgttgctgctattcattatgtggtcaaagaggaggttatgagaaatccagtgatatacggatctatagggattagttctttatgtgctgcaatagttgcctggatagtgattttgtgtgctgctaggaaatgtgggaatccgaactgcaagggcttaaggaaggcagcagaattcgatatccagttggagaccgaggagtgtgtgaagaattctaatggtaccttggtgaaagatggactgaaaaggggcctttttgaattgcctcacgatcatcatcgagaattggaggctgaattgaagaagatggcaccaactaatggaagagctgttcttgtgtttcgagcaaggtgtggatgttctgttggaagattggaggttccgggacctaagaagacaaagaagatcaagaagtag

SEQ ID NO: 2244 - protein, 235 aa, Populus balsamifera subsp. trichocarpa
  misc_feature (1)..(235): Ceres ANNOT ID no. 1503063
  misc_feature 251959:<222: Transcription Factor
  misc_feature: Phenotype: WHOLE PLANT - Misc. Dwarf Useful for modulating plant size
  misc_feature (1)..(235): Functional Homolog of  Ceres CLONE ID no. 105104 at SEQ ID NO. 2284 with e-value of 1.60E-67 and BLAST sequence identity of 67.1
MVYFHSSISVCNSFDQSSTASMANSVNSSEFNPKSRHNNNHVHKNRKTVNGSNCKTIPVCDRSQSAVIDVVILIAVIGACGFLLFPYIRIVTLGFIEFVAAIHYVVKEEVMRNPVIYGSIGISSLCAAIVAWIVILCAARKCGNPNCKGLRKAAEFDIQLETEECVKNSNGTLVKDGLKRGLFELPHDHHRELEAELKKMAPTNGRAVLVFRARCGCSVGRLEVPGPKKTKKIKK

SEQ ID NO: 2245 - DNA, 645 bp, Populus balsamifera subsp. trichocarpa
  misc_feature (1)..(645): Ceres ANNOT ID no. 1450022
  misc_feature 252037:<222: Transcription Factor
  misc_feature: Phenotype: WHOLE PLANT - Misc. Dwarf Useful for modulating plant size
atggcaaattctgtgaattccagtgagtttaatccaaaatcaaggcacaacaataatcatgtgcacaagaataggaagacagtgaatggctcgaattgtaaaactatacctgtttgtgatagatctcaatcagctgttattgatgttgtgatcttgatagctgtcattggtgcttgtggattcttgttatttccttatatccggattgtaactcttggttttattgaatttgttgctgctattcattatgtggtcaaagaggaggttatgagaaatccagtgatatacggatctatagggattagttctttatgtgctgcaatagttgcctggatagtgattttgtgtgctgctaggaaatgtgggaatccgaactgcaagggcttaaggaaggcagcagaattcgatatccagttggagaccgaggagtgtgtgaagaattctaatggtaccttggtgaaagatggactgaaaaggggcctttttgaattgcctcacgatcatcatcgagaattggaggctgaattgaagaagatggcaccaactaatggaagagctgttcttgtgtttcgagcaaggtgtggatgttctgttggaagattggaggttccgggacctaagaagacaaagaagatcaagaagtag

SEQ ID NO: 2246 - protein, 214 aa, Populus balsamifera subsp. trichocarpa
  misc_feature (1)..(214): Ceres ANNOT ID no. 1450022
  misc_feature 252084:<222: Transcription Factor
  misc_feature: Phenotype: WHOLE PLANT - Misc. Dwarf Useful for modulating plant size
  misc_feature (1)..(214): Functional Homolog of  Ceres CLONE ID no. 105104 at SEQ ID NO. 2284 with e-value of 2.09E-63 and BLAST sequence identity of 65.6
MANSVNSSEFNPKSRHNNNHVHKNRKTVNGSNCKTIPVCDRSQSAVIDVVILIAVIGACGFLLFPYIRIVTLGFIEFVAAIHYVVKEEVMRNPVIYGSIGISSLCAAIVAWIVILCAARKCGNPNCKGLRKAAEFDIQLETEECVKNSNGTLVKDGLKRGLFELPHDHHRELEAELKKMAPTNGRAVLVFRARCGCSVGRLEVPGPKKTKKIKK

SEQ ID NO: 2247 - protein, 262 aa, Arabidopsis thaliana
  misc_feature (1)..(262): Ceres CLONE ID no. 105554
  misc_feature (96)..(166): Pfam Name: RRM_1 Pfam Description: RNA recognition motif. (a.k.a. RRM RBD, or RNP domain)
  misc_feature: Phenotype: CAULINE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: FLOWER - Large Useful for making ornamental plants with modified flowers
  misc_feature: Phenotype: CAULINE LEAVES - Large Useful for making plants with increased biomass and foliage
  misc_feature: Phenotype: INFLORESCENCE - Multi-Inflorescence Fusion Useful for making ornamental plants with modified flowers
  misc_feature: Phenotype: INFLORESCENCE - Tall Useful for making taller plants and plants with longer inflorescences
  misc_feature: Phenotype: SILIQUES - Short Useful for increasing seed/fruit yield or modifying fruit content
  misc_feature: Phenotype: FLOWER - Other Useful for making ornamental plants with modified flowers
  misc_feature: Phenotype: ROSETTE LEAVES - Other Useful for making ornamental plants with modified leaves
MALLRLPGISLQILGHKSNQKNPNPNVAFTNHSLSLSTPSLCRLHRHATFPDSIPAKSRNLTSYFSTTTQEPVLESSSSSSSAPEVVEEEISKTRLIAQNVPWTSTPEDIRSLFEKYGSVIDIEMSMHKKERNRGLVFIEMASPEEAATALKSLESCEYEGRRLKVDYAKTKKKKTYAPRETPSPVPTFNLFVANLAFEARAKHLKEFFDADTGNVVSTEVIFHENPRRSSGYGFVSFKTKKQAEAALIEFQGKDFLGRPIH

SEQ ID NO: 2248 - DNA, 1104 bp, Populus balsamifera subsp. trichocarpa
  misc_feature (1)..(1104): Ceres ANNOT ID no. 1451783
  misc_feature 252302:<222: Transcription Factor
  misc_feature: Phenotype: CAULINE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: FLOWER - Large Useful for making ornamental plants with modified flowers
  misc_feature: Phenotype: CAULINE LEAVES - Large Useful for making plants with increased biomass and foliage
  misc_feature: Phenotype: INFLORESCENCE - Multi-Inflorescence Fusion Useful for making ornamental plants with modified flowers
  misc_feature: Phenotype: INFLORESCENCE - Tall Useful for making taller plants and plants with longer inflorescences
  misc_feature: Phenotype: SILIQUES - Short Useful for increasing seed/fruit yield or modifying fruit content
  misc_feature: Phenotype: FLOWER - Other Useful for making ornamental plants with modified flowers
  misc_feature: Phenotype: ROSETTE LEAVES - Other Useful for making ornamental plants with modified leaves
atggcttcacttcgtcttccatgttgtctctcatcaaaaacgccttccttctccattaatccaataacccccaagttatcttctctccataaccaccctaacaactttacttttaataccaacaccaacaacatctcattatctcactctctttgttttccaattagaaacaacaacaaattcaggcatttccttttgcatttctcttctacaactcaagaccacccggttgttgattcctcttcacttgatgatgttgtcaccgaataccaatcaaaggctgaagaaaaagaagaagagttttcgaaaaccagactgtttgcttcgaatgttccatggaattgtactgcagaagacattagggctctgtttcagaagtttgggacagttgtagatgttgagctttcaatgtatagcaagatcagaaacaggggcttggcgtttgtcactatgggctcccccgaagaggcagttgctgctcttaataacctcgaatcttatgagttcgagggccgtactttgaagatgaattatgcaaaggcaaaaaagaaaaaaccttcaccacctccaccacccaagccagggccaacgtttaacttgtttgtagcgaatttgccatttgaagcaaagtcgaaagatcttaaggagttctttattgcagaaggtgctaatgttgtttctgctgaaattatatttcatgataatcctagaaggccctccggttatggatttgtggcattcaaaactaaaaaagaagctgattacgccatttctactttctccgataaggaattcatgggaaggcaacttagagttgctcgcagtagacaatttgtcaaacaacgaaaagaagatgcagcacaatctgatggtacttcgggtgagttggaatctgaaaagcatccaacattggcctgtgtctctgagattctcattctactccagccaaagttctctggagaacaaaatgaaaaacagtcacagggaaatagtgaatctgatcccaggagtaggaagtctactgagcagctgctggccagagattggttggaacagatacctaatcaagaaattggaggcaaacttccaaataactcgaattga

SEQ ID NO: 2249 - protein, 367 aa, Populus balsamifera subsp. trichocarpa
  misc_feature (1)..(367): Ceres ANNOT ID no. 1451783
  misc_feature (106)..(176): Pfam Name: RRM_1 Pfam Description: RNA recognition motif. (a.k.a. RRM RBD, or RNP domain)
  misc_feature: SWISSPROT Homolog: ROC3_NICSY 28 kDa ribonucleoprotein, (28RNP) with e-value of 3.8e-19 and BLAST sequence identity of 27.8
  misc_feature: SWISSPROT Homolog: ROC5_NICSY 33 kDa ribonucleoprotein, with e-value of 6.5e-17 and BLAST sequence identity of 25.1
  misc_feature: SWISSPROT Homolog: ROC1_SPIOL 28 kDa ribonucleoprotein, chloroplast (28RNP) with e-value of 4.5e-16 and BLAST sequence identity of 28.0
  misc_feature: SWISSPROT Homolog: RRP2_SPIOL Plastid-specific 30S ribosomal protein 2, (PSRP-2) with e-value of 3.2e-15 and BLAST sequence identity of 28.6
  misc_feature: SWISSPROT Homolog: ROC1_NICSY 29 kDa ribonucleoprotein A, (CP29A) with e-value of 9.1e-15 and BLAST sequence identity of 28.3
  misc_feature 252474:<222: Transcription Factor
  misc_feature: Phenotype: CAULINE LEAVES - Curled 3 Useful for making ornamental plants with altered leaf shape
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: FLOWER - Large Useful for making ornamental plants with modified flowers
  misc_feature: Phenotype: CAULINE LEAVES - Large Useful for making plants with increased biomass and foliage
  misc_feature: Phenotype: INFLORESCENCE - Multi-Inflorescence Fusion Useful for making ornamental plants with modified flowers
  misc_feature: Phenotype: INFLORESCENCE - Tall Useful for making taller plants and plants with longer inflorescences
  misc_feature: Phenotype: SILIQUES - Short Useful for increasing seed/fruit yield or modifying fruit content
  misc_feature: Phenotype: FLOWER - Other Useful for making ornamental plants with modified flowers
  misc_feature: Phenotype: ROSETTE LEAVES - Other Useful for making ornamental plants with modified leaves
  misc_feature (1)..(367): Functional Homolog of  Ceres CLONE ID no. 105554 at SEQ ID NO. 2291 with e-value of 1.49E-62 and BLAST sequence identity of 56.8
MASLRLPCCLSSKTPSFSINPITPKLSSLHNHPNNFTFNTNTNNISLSHSLCFPIRNNNKFRHFLLHFSSTTQDHPVVDSSSLDDVVTEYQSKAEEKEEEFSKTRLFASNVPWNCTAEDIRALFQKFGTVVDVELSMYSKIRNRGLAFVTMGSPEEAVAALNNLESYEFEGRTLKMNYAKAKKKKPSPPPPPKPGPTFNLFVANLPFEAKSKDLKEFFIAEGANVVSAEIIFHDNPRRPSGYGFVAFKTKKEADYAISTFSDKEFMGRQLRVARSRQFVKQRKEDAAQSDGTSGELESEKHPTLACVSEILILLQPKFSGEQNEKQSQGNSESDPRSRKSTEQLLARDWLEQIPNQEIGGKLPNNSN

SEQ ID NO: 2250 - protein, 232 aa, Arabidopsis thaliana
  misc_feature (1)..(232): Ceres CLONE ID no. 106011
  misc_feature (12)..(84): Pfam Name: RRM_1 Pfam Description: RNA recognition motif. (a.k.a. RRM RBD, or RNP domain)
  misc_feature: Phenotype: FLOWER - Sterile Useful for sterility, genetic confinement systems
  misc_feature: Phenotype: INFLORESCENCE - Tall Useful for making taller plants and plants with longer inflorescences
MLTADIPPNHSIYIQNLNERIKKEELKRSLYCLFSQFGRILDVVALKTPKLRGQAWVTFSEVTAAGHAVRQMQNFPFYDKPMRLQYAKAKSDCLAKAEGTFVPKDKKRKQEEKVERKREESQRPNTANGPSANGPSANNGVPAPSFQPSGQETMPPNNILFIQNLPHETTSMMLQLLFEQYPGFKEIRMIDAKPGIAFVEYEDDVQASIAMQPLQGFKITPQNPMVISFAKK

SEQ ID NO: 2251 - DNA, 702 bp, Populus balsamifera subsp. trichocarpa
  misc_feature (1)..(702): Ceres ANNOT ID no. 1533498
  misc_feature 252720:<222: Transcription Factor
  misc_feature: Phenotype: FLOWER - Sterile Useful for sterility, genetic confinement systems
  misc_feature: Phenotype: INFLORESCENCE - Tall Useful for making taller plants and plants with longer inflorescences
atgctaacaggggacataccaccgaaccaaacaatttacattaagaacctcaacgagaaggtcaagaaagaagagttgaagaggtcactttattgtctgttctctcaatatgggaggattttggatgttgttgctttgaagacggcgaggcttcgagggcaagcatgggtagtgtttagtgaagttacggctgcgagtaatgctgtgcgacagatgcagggttttccgttttatgataaacctatgcggattcaatatgcaaaaacaaagtctgattgcattgcagaagcagaaggagtctatgatccaaatgcaaagaagaagaagaagcaagaggaaaaagctgagagaaagaaacgtgctgaagaagctcagcaatcagctccagctaatgggaaacctgctgaaagtaatgggggcccaacttctttccgccaaggaaaccagagtgcacaggaaaccgttccaccaaataatatattgtttattcaaaacttgccccatgaaaccactagcatgatgttgcaagtgctcttccagcaatacccaggatttagggaagtccgtatgattgaggcaaagccaggtatcgcatttgtggaatttgaagatgatgtgcaatcctccatggccatgcaggcccttcaaggtttcaaaattactccccagaaccctatggctattacttacgccaagaagtaa

SEQ ID NO: 2252 - protein, 233 aa, Populus balsamifera subsp. trichocarpa
  misc_feature (1)..(233): Ceres ANNOT ID no. 1533498
  misc_feature (161)..(228): Pfam Name: RRM_1 Pfam Description: RNA recognition motif. (a.k.a. RRM RBD, or RNP domain)
  misc_feature: SWISSPROT Homolog: RU2B_MOUSE U2 small nuclear ribonucleoprotein B" with e-value of 2.3e-60 and BLAST sequence identity of 52.6
  misc_feature: SWISSPROT Homolog: RU2B_HUMAN U2 small nuclear ribonucleoprotein B" with e-value of 4.8e-60 and BLAST sequence identity of 54.3
  misc_feature: SWISSPROT Homolog: SNRPA_XENLA U1 small nuclear ribonucleoprotein A (U1 snRNP protein A) (U1-A) with e-value of 5.1e-59 and BLAST sequence identity of 50.7
  misc_feature: SWISSPROT Homolog: SNRPA_DROME U1 small nuclear ribonucleoprotein A (U1 snRNP protein A) U1A protein (U1-A)(Sex determination protein snf) with e-value of 8.3e-56 and BLAST sequence identity of 52.0
  misc_feature: SWISSPROT Homolog: SNRPA_MOUSE U1 small nuclear ribonucleoprotein A (U1 snRNP protein A) U1A protein (U1-A) with e-value of 6.1e-37 and BLAST sequence identity of 52.4
  misc_feature 252821:<222: Transcription Factor
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature (1)..(233): Functional Homolog of  Ceres CLONE ID no. 106011 at SEQ ID NO. 2294 with e-value of 2.29E-89 and BLAST sequence identity of 77.0
MLTGDIPPNQTIYIKNLNEKVKKEELKRSLYCLFSQYGRILDVVALKTARLRGQAWVVFSEVTAASNAVRQMQGFPFYDKPMRIQYAKTKSDCIAEAEGVYDPNAKKKKKQEEKAERKKRAEEAQQSAPANGKPAESNGGPTSFRQGNQSAQETVPPNNILFIQNLPHETTSMMLQVLFQQYPGFREVRMIEAKPGIAFVEFEDDVQSSMAMQALQGFKITPQNPMAITYAKK

SEQ ID NO: 2253 - DNA, 765 bp, Populus balsamifera subsp. trichocarpa
  misc_feature (1)..(765): Ceres ANNOT ID no. 1524067
  misc_feature 252906:<222: Transcription Factor
  misc_feature: Phenotype: FLOWER - Sterile Useful for sterility, genetic confinement systems
  misc_feature: Phenotype: INFLORESCENCE - Tall Useful for making taller plants and plants with longer inflorescences
atgctaacaggagacataccaccgaaccaaacaatttacgttaagaacctcaacgagaaggtcaagaaagaagagttgaagagatcactttattgtttgttctctcaatacgggaggattttggatgttgttgctttgaagacggcaaagcttcgagggcaagcatgggttgtgtttagcgaagtgacggctgcaagtaatgctgtgcggcaaatgcagggttttccattttatgataaacctatggtacgttttgagatgcttggtcacttttgtttgcttgtcatggacaagcataacaggggaatgcgaatccagtatgcaaaaacaatgtctgattgcattacagaagcagaaggagtctatgatccaaatgcaaagaaaaagaagaagaacgaagaaaaagctgaaagaaaaagacgtgctgaagaatcccagcaatcagctccagctaatggtaaacctgctgaaagtaacgggggcccgacttctttccgccatggaaaccagggtgcacaagaaacagctccgccaaataatatattgtttattcaaaacttgccccatgaaaccactagcatgatgttgcaagtgctcttccagcaatacccaggatttagggaagtccgaatgattgaggcgaagccaggtattgcatttgtggaatttgaagatgatgtgcaatcctccatggccatgcaggcccttcaaggtttcaaaattactccccagaaccccatggctgttacttatgccaagaagtaa

SEQ ID NO: 2254 - protein, 254 aa, Populus balsamifera subsp. trichocarpa
  misc_feature (1)..(254): Ceres ANNOT ID no. 1524067
  misc_feature (12)..(84): Pfam Name: RRM_1 Pfam Description: RNA recognition motif. (a.k.a. RRM RBD, or RNP domain)
  misc_feature: SWISSPROT Homolog: RU2B_MOUSE U2 small nuclear ribonucleoprotein B" with e-value of 2.3e-60 and BLAST sequence identity of 52.6
  misc_feature: SWISSPROT Homolog: RU2B_HUMAN U2 small nuclear ribonucleoprotein B" with e-value of 4.8e-60 and BLAST sequence identity of 54.3
  misc_feature: SWISSPROT Homolog: SNRPA_XENLA U1 small nuclear ribonucleoprotein A (U1 snRNP protein A) U1A protein (U1-A) with e-value of 5.1e-59 and BLAST sequence identity of 50.7
  misc_feature: SWISSPROT Homolog: SNRPA_DROME U1 small nuclear ribonucleoprotein A (U1 snRNP protein A) U1A protein (U1-A)(Sex determination protein snf) with e-value of 8.3e-56 and BLAST sequence identity of 52.0
  misc_feature: SWISSPROT Homolog: SNRPA_MOUSE U1 small nuclear ribonucleoprotein A (U1 snRNP protein A) U1A protein (U1-A) with e-value of 6.1e-37 and BLAST sequence identity of 52.4
  misc_feature 253009:<222: Transcription Factor
  misc_feature: Phenotype: FLOWER - Sterile Useful for sterility, genetic confinement systems
  misc_feature: Phenotype: INFLORESCENCE - Tall Useful for making taller plants and plants with longer inflorescences
  misc_feature (1)..(254): Functional Homolog of  Ceres CLONE ID no. 106011 at SEQ ID NO. 2294 with e-value of 1.10E-82 and BLAST sequence identity of 75.7
MLTGDIPPNQTIYVKNLNEKVKKEELKRSLYCLFSQYGRILDVVALKTAKLRGQAWVVFSEVTAASNAVRQMQGFPFYDKPMVRFEMLGHFCLLVMDKHNRGMRIQYAKTMSDCITEAEGVYDPNAKKKKKNEEKAERKRRAEESQQSAPANGKPAESNGGPTSFRHGNQGAQETAPPNNILFIQNLPHETTSMMLQVLFQQYPGFREVRMIEAKPGIAFVEFEDDVQSSMAMQALQGFKITPQNPMAVTYAKK

SEQ ID NO: 2255 - protein, 368 aa, Arabidopsis thaliana
  misc_feature (1)..(368): Ceres CLONE ID no. 106078
  misc_feature (1)..(368): Also Known As Ceres CDNA ID no. 23372465
  misc_feature (1)..(368): Also Known As Ceres GEMINI ID 555H6
  misc_feature (124)..(165): Pfam Name: zf-C3HC4 Pfam Description: Zinc finger, C3HC4 type (RING finger)
  misc_feature 253117:<222: Transcription Factor
  misc_feature: Phenotype: Activates expression of the gene endogenous to the AtDXPR (SEQ ID NO 4143) regalutory region Useful for modulating Terpenoid Biosynthesis
MDPIKHISLPVLVLFLLLSVSAGQPGTPDQRHDPYAYSGSLSPAMAVVVVVVIAALFFMGFFTVYIRHCTGAVDGSVTPAGGARRRVTNATVARGLDVETIETFPTFVYSEVKTQKIGKGALECAICLNEFEDDETLRLLPKCDHVFHPHCIGAWLQGHVTCPVCRTNLAEQTPEPEVVVETDLEAQQQSAVPVPVVELPRVKFPRSHTTGHSVVLPGESTDRFTLRVPEELRKKIMANWKLNRSNSVFVLPRGGSSRSGKQVDRSRAKSDRWLFRKTPSFLWRNRDDGSIRLGGTGSVRGNSVTSPSGDSVRADRWAFLRNPSFLWRNTTPVPSPRVEVNNKDGEGTSSVQHIGTVGSTSGSLRLPV

SEQ ID NO: 2256 - DNA, 1161 bp, Populus balsamifera subsp. trichocarpa
  misc_feature (1)..(1161): Ceres ANNOT ID no. 1469354
  misc_feature 253214:<222: Transcription Factor
  misc_feature: Phenotype: Activates expression of the gene endogenous to the AtDXPR (SEQ ID NO 4143) regalutory region Useful for modulating Terpenoid Biosynthesis
atggattcttacacgttcatacacaggatccttcctctcttgattctcttcttccttgcaactccttgcggtgtcgtttcgcaaaacaacagctcgaacgacaggggaatgtacaacaactacgcgcaggtgacaccgtcgatggcgattatcattgtcgttttggtagctgctctcttctccatgggcttcttctcaatctacatccgccactgcaacgaagccagcgcaaacgggagtatcagggcattgggtgtagtcggactctctcgacgggccgccgcatcgcgtgggcttgatcctggcgttatcgagacgtttccgactttaatctactcggttgtgaaaggcttgaagattggtaaaggcgcgttagaatgcgccgtttgtttaaacgaattcgaagacgatgaaacgctgcgtttgattccgaattgtgaccacgtcttccatcctgattgcattgatgcttggctggagtctcacactacctgtcctgtttgtagagctgatttgaccaaacccgccgacacggtatcccaactcagtgaattgcacagccccgagttggacctcgaggcccaaaacggcgcccttgggatcgagccagaaaacgggaatgctaatgtggaagtgcaagtggttggacctgagcctgacgatgtgagtgtgaatgtgaataaaactttgaataggaaccggacacgtgggtcaagatcgggtaggccaccgaggtttcctcggtcacattcgaccgggcattctttggttcaaccgggagagaacaccgatcgctttactttgagattgccggttgaggttaggaaacaggtgatgaaccggaagttgaaccggtctacgagtatggtggtgctgcctagacaaggaagttcaaggaagggttataggaccggagttggtgaagggagttcaagaaaggtgttaaattataagagacttgagaaattggacctagaaccgaggtcagaccggtgggtttttggtaggaacccgtcattcttagcaagagcgtcgtcgtttctatcgagagcttcatcgtcggttaggtcaccaaaagtggtggctgctagtgaaaaccaagggggttcgtctagactcggtggatcagacggaggtgaatctagcagaccaccggtttag

SEQ ID NO: 2257 - protein, 386 aa, Populus balsamifera subsp. trichocarpa
  misc_feature (1)..(386): Ceres ANNOT ID no. 1469354
  misc_feature (127)..(168): Pfam Name: zf-C3HC4 Pfam Description: Zinc finger, C3HC4 type (RING finger)
  misc_feature: SWISSPROT Homolog: ATL5H_ARATH RING-H2 finger protein ATL5H precursor with e-value of 2.1e-199 and BLAST sequence identity of 99.7
  misc_feature: SWISSPROT Homolog: ATL3B_ARATH RING-H2 finger protein ATL3B precursor (RING-H2 finger protein ATL6) with e-value of 1.5e-65 and BLAST sequence identity of 52.8
  misc_feature: SWISSPROT Homolog: ATL1N_ARATH RING-H2 finger protein ATL1N precursor with e-value of 4.0e-47 and BLAST sequence identity of 50.8
  misc_feature: SWISSPROT Homolog: ATL2G_ARATH RING-H2 finger protein ATL2G precursor (RING-H2 finger protein ATL9) with e-value of 4.5e-46 and BLAST sequence identity of 45.9
  misc_feature: SWISSPROT Homolog: ATL4C_ARATH Putative RING-H2 finger protein ATL4C precursor with e-value of 4.4e-42 and BLAST sequence identity of 38.9
  misc_feature 253322:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(386): Functional Homolog of  Ceres CLONE ID no. 106078 at SEQ ID NO. 2299 with e-value of 5.60E-69 and BLAST sequence identity of 55.9
MDSYTFIHRILPLLILFFLATPCGVVSQNNSSNDRGMYNNYAQVTPSMAIIIVVLVAALFSMGFFSIYIRHCNEASANGSIRALGVVGLSRRAAASRGLDPGVIETFPTLIYSVVKGLKIGKGALECAVCLNEFEDDETLRLIPNCDHVFHPDCIDAWLESHTTCPVCRADLTKPADTVSQLSELHSPELDLEAQNGALGIEPENGNANVEVQVVGPEPDDVSVNVNKTLNRNRTRGSRSGRPPRFPRSHSTGHSLVQPGENTDRFTLRLPVEVRKQVMNRKLNRSTSMVVLPRQGSSRKGYRTGVGEGSSRKVLNYKRLEKLDLEPRSDRWVFGRNPSFLARASSFLSRASSSVRSPKVVAASENQGGSSRLGGSDGGESSRPPV

SEQ ID NO: 2258 - DNA, 1206 bp, Populus balsamifera subsp. trichocarpa
  misc_feature (1)..(1206): Ceres ANNOT ID no. 1522753
  misc_feature 253430:<222: Transcription Factor
  misc_feature: Phenotype: Activates expression of the gene endogenous to the AtDXPR (SEQ ID NO 4143) regalutory region Useful for modulating Terpenoid Biosynthesis
atggattcttacacgttcatacacaggatccttcctctcttgattctcttcttccttgcaactccttgcggtgtcgtttcgcaaaacaacagctcgaacgacaggggaatgtacaacaactacgcgcaggtgacaccgtcgatggcgattatcattgtcgttttggtagctgctctcttctccatgggcttcttctcaatctacatccgccactgcaacgaagccagcgcaaacgggagtatcagggcattgggtgtagtcggactctctcgacgggccgccgcatcgcgtgggcttgatcctggcgttatcgagacgtttccgactttaatctactcggttgtgaaaggcttgaagattggtaaaggcgcgttagaatgcgccgtttgtttaaacgaattcgaagacgatgaaacgctgcgtttgattccgaattgtgaccacgtcttccatcctgattgcattgatgcttggctggagtctcacactacctgtcctgtttgtagagctgatttgaccaaacccgccgacacggtatcccaactcagtgaattgcacagccccgagttggacctcgaggcccaaaacggcgcccttgggatcgagccagaaaacgggaatgctaatgtggaagtgcaagtggttggacctgagcctgacgatgtgagtgtgaatgtgaataaaactttgaataggaaccggacacgtgggtcaagatcgggtaggccaccgaggtttcctcggtcacattcgaccgggcattctttggttcaaccgggagagaacaccgatcgctttactttgagattgccggttgaggttaggaaacaggtgatgaaccggaagttgaaccggtctacgagtatggtggtgctgcctagacaaggaagttcaaggaagggttataggaccggagttggtgaagggagttcaagaaaggtgttaaattataagagacttgagaaattggacctagaaccgaggtcagaccggtgggtttttggtaggaacccgtcattcttagcaagagcgtcgtcgtttctatcgagagcttcatcgtcggttaggtcaccaaaagtgaatgcaatgccgcttatggaaccattacacttaggggcggaattagaggaggcaagtagaggttcgggtcctgtaaaagattttagatttttttattatttagtgtttaaatataggacggtataa

SEQ ID NO: 2259 - protein, 401 aa, Populus balsamifera subsp. trichocarpa
  misc_feature (1)..(401): Ceres ANNOT ID no. 1522753
  misc_feature (127)..(168): Pfam Name: zf-C3HC4 Pfam Description: Zinc finger, C3HC4 type (RING finger)
  misc_feature: SWISSPROT Homolog: ATL5H_ARATH RING-H2 finger protein ATL5H precursor with e-value of 2.1e-199 and BLAST sequence identity of 99.7
  misc_feature: SWISSPROT Homolog: ATL3B_ARATH RING-H2 finger protein ATL3B precursor (RING-H2 finger protein ATL6) with e-value of 1.5e-65 and BLAST sequence identity of 52.8
  misc_feature: SWISSPROT Homolog: ATL1N_ARATH RING-H2 finger protein ATL1N precursor with e-value of 4.0e-47 and BLAST sequence identity of 50.8
  misc_feature: SWISSPROT Homolog: ATL2G_ARATH RING-H2 finger protein ATL2G precursor (RING-H2 finger protein ATL9) with e-value of 4.5e-46 and BLAST sequence identity of 45.9
  misc_feature: SWISSPROT Homolog: ATL4C_ARATH Putative RING-H2 finger protein ATL4C precursor with e-value of 4.4e-42 and BLAST sequence identity of 38.9
  misc_feature 253540:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(401): Functional Homolog of  Ceres CLONE ID no. 106078 at SEQ ID NO. 2299 with e-value of 3.49E-67 and BLAST sequence identity of 58.0
MDSYTFIHRILPLLILFFLATPCGVVSQNNSSNDRGMYNNYAQVTPSMAIIIVVLVAALFSMGFFSIYIRHCNEASANGSIRALGVVGLSRRAAASRGLDPGVIETFPTLIYSVVKGLKIGKGALECAVCLNEFEDDETLRLIPNCDHVFHPDCIDAWLESHTTCPVCRADLTKPADTVSQLSELHSPELDLEAQNGALGIEPENGNANVEVQVVGPEPDDVSVNVNKTLNRNRTRGSRSGRPPRFPRSHSTGHSLVQPGENTDRFTLRLPVEVRKQVMNRKLNRSTSMVVLPRQGSSRKGYRTGVGEGSSRKVLNYKRLEKLDLEPRSDRWVFGRNPSFLARASSFLSRASSSVRSPKVNAMPLMEPLHLGAELEEASRGSGPVKDFRFFYYLVFKYRTV

SEQ ID NO: 2260 - DNA, 1149 bp, Populus balsamifera subsp. trichocarpa
  misc_feature (1)..(1149): Ceres ANNOT ID no. 1488939
  misc_feature 253651:<222: Transcription Factor
  misc_feature: Phenotype: Activates expression of the gene endogenous to the AtDXPR (SEQ ID NO 4143) regalutory region Useful for modulating Terpenoid Biosynthesis
atggattcttacaggttcacacacatgatcctccccctcttagttctcttcatcttgtcaacacctcatggtgtcgtttcccaaaccaccaacacgaacgacgggcagccgtacaactacgcgcgggtgactccatcgatggccataatcattgtcgttttgatagccgtactcttcatcatggggttcttttcaatctacatccgccattgcaacgaagccaacggcaacgggagtatccggccgctgggtatgggcggactctctcgacgggtcgccgcctcgcgtgggcttgatcctgccgttatcgagacgtttcccacgttaatttactcggtcgtgaaaggcttgaagattggtaaaggcgcgttagaatgcgccgtttgtttaaacgaatttgaagaggatgaaacgctgcgtttgattcctaattgtgaccacgtgttccatcctgattgcatcggtgcttggttggagtctcacactacctgtcctgtctgcagagctgatttgaccaagccagctgactcggtccctcaactcggtgagtcgcacgaccccgagctggacctggaggcccaaaatggggcagtgatggacgagccagaaaatgggaatgctaatgtggaagtggttggaccggagcctgaggttatgggtgcgagtgtggttaaaactttgaacaggaaccggacacgtgggtcgagatcgggtaggccattgaggtttactaggtcacattcgaccggacattctgtggttcaaccaggagagaataccgatcggtttactttgagattgccggttgaggttaggaaacaagtgatgaaccggaagttgaaccgggcgatgagcatggtggtgttgtccagacaaggaagttcagtgaaggggaacaagaacggagttggtgaagggagtcctaggaaggtgttaaattataagcgacttgagaaactggaccaagaagcaaggtcggaccggtgggtttttagtcggaacccgtcattgctagcaagagcgtcgtcattcctatcgagagcttcgtcatcggttaggtcaccaaaagtggctgctaatggcaaccaaggggattcacctagacaggttggaccgaatgcgggtgaatcgagcagaccgctggtttag

SEQ ID NO: 2261 - protein, 382 aa, Populus balsamifera subsp. trichocarpa
  misc_feature (1)..(382): Ceres ANNOT ID no. 1488939
  misc_feature (126)..(167): Pfam Name: zf-C3HC4 Pfam Description: Zinc finger, C3HC4 type (RING finger)
  misc_feature: SWISSPROT Homolog: ATL5H_ARATH RING-H2 finger protein ATL5H precursor with e-value of 2.1e-199 and BLAST sequence identity of 99.7
  misc_feature: SWISSPROT Homolog: ATL3B_ARATH RING-H2 finger protein ATL3B precursor (RING-H2 finger protein ATL6) with e-value of 1.5e-65 and BLAST sequence identity of 52.8
  misc_feature: SWISSPROT Homolog: ATL1N_ARATH RING-H2 finger protein ATL1N precursor with e-value of 4.0e-47 and BLAST sequence identity of 50.8
  misc_feature: SWISSPROT Homolog: ATL2G_ARATH RING-H2 finger protein ATL2G precursor (RING-H2 finger protein ATL9) with e-value of 4.5e-46 and BLAST sequence identity of 45.9
  misc_feature: SWISSPROT Homolog: ATL4C_ARATH Putative RING-H2 finger protein ATL4C precursor with e-value of 4.4e-42 and BLAST sequence identity of 38.9
  misc_feature 253759:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(382): Functional Homolog of  Ceres CLONE ID no. 106078 at SEQ ID NO. 2299 with e-value of 1.09E-64 and BLAST sequence identity of 56.8
MDSYRFTHMILPLLVLFILSTPHGVVSQTTNTNDGQPYNYARVTPSMAIIIVVLIAVLFIMGFFSIYIRHCNEANGNGSIRPLGMGGLSRRVAASRGLDPAVIETFPTLIYSVVKGLKIGKGALECAVCLNEFEEDETLRLIPNCDHVFHPDCIGAWLESHTTCPVCRADLTKPADSVPQLGESHDPELDLEAQNGAVMDEPENGNANVEVVGPEPEVMGASVVKTLNRNRTRGSRSGRPLRFTRSHSTGHSVVQPGENTDRFTLRLPVEVRKQVMNRKLNRAMSMVVLSRQGSSVKGNKNGVGEGSPRKVLNYKRLEKLDQEARSDRWVFSRNPSLLARASSFLSRASSSVRSPKVAANGNQGDSPRQVGPNAGESSRPLV

SEQ ID NO: 2262 - protein, 355 aa, Arabidopsis thaliana
  misc_feature (1)..(355): Ceres CLONE ID no. 106301
  misc_feature: Phenotype: WHOLE PLANT - Late Senescence Useful for delaying senescence
  misc_feature: Phenotype: SILIQUES - Short Useful for increasing seed/fruit yield or modifying fruit content
  misc_feature: Phenotype: INFLORESCENCE - Other Useful for making ornamental plants with modified flowers
MAAASARAFFMLSRVTDLSKKKLILHQPPPSSSPHRLPYAPNRAVSSSAVISCLSGGGVSSDDSYVSTRRSKLDRGFAVIANLVNRIQPLDTSVISKGLSDSAKDSMKQTISSMLGLLPSDQFSVSVTISEQPLYRLLISSIITGYTLWNAEYRVSLRRNFDIPIDPRKEEEDQSSKDNVRFGSEKGMSEDLGNCVEEFERLSPQVFGDLSPEALSYIQLLQSELSSMKEELDSQKKKALRIECEKGNRNDLLDYLRSLDPEMVTELSQLSSPEVEEIVNQLVQNVLERLFEDQTTSNFMQNPGIRTTDGGDGTGRKVDTSRDYLAKLLFWCMLLGHHLRGLENRLHLSCVVGLL

SEQ ID NO: 2263 - protein, 331 aa, Arabidopsis thaliana
  misc_feature (1)..(331): Ceres CLONE ID no. 107731
  misc_feature (199)..(331): Pfam Name: Tubulin_C Pfam Description: Tubulin/FtsZ family, C-terminal domain
  misc_feature (64)..(197): Pfam Name: Tubulin Pfam Description: Tubulin/FtsZ family, GTPase domain
  misc_feature: Phenotype: INFLORESCENCE - Asecondary Branching Useful for making ornamental plants with modified flowers
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - High Anthocyanin Useful for modulating anthocyanin content
  misc_feature (62)..(62): Xaa is any aa, unknown, or other
  misc_feature (63)..(63): Xaa is any aa, unknown, or other
MSISTKLAVESTFLALFLWIWSLVPWILSDLVRSVRFSVLITSSLVNLVPEITGRKVITPKXXELIDSVLDVVRKEAENSDCLQGFQVCHSLGGGTGSGMGTLLISKIREEYPDRMMMTFSVFPSPKVSDTVVEPYNATLSVHQLVENADECMVLDNEALYDICFRTLKLANPTFGDLNHLISATMSGVTCCLRFPGQLNSDLRKLAVNLIPFPRLHFFMVGFAPLTSRGSQQYSALSVPELTQQMWDAKNMMCAADPRHGRYLTASAVFRGKLSTKEVDEQMMNIQNKNSSYFVEWIPNNVKSSVCDIAPKGLKMASTFIGNSTSIQEMF

SEQ ID NO: 2264 - DNA, 1338 bp, Populus balsamifera subsp. trichocarpa; identical to SEQ ID NO: 1549
  misc_feature (1)..(1338): Ceres ANNOT ID no. 1480518
  misc_feature 254104:<222: Transcription Factor
  misc_feature: Phenotype: INFLORESCENCE - Asecondary Branching Useful for making ornamental plants with modified flowers
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - High Anthocyanin Useful for modulating anthocyanin content

SEQ ID NO: 2265 - protein, 373 aa, Populus balsamifera subsp. trichocarpa
  misc_feature (1)..(373): Ceres ANNOT ID no. 1480518
  misc_feature (1)..(172): Pfam Name: Tubulin Pfam Description: Tubulin/FtsZ family, GTPase domain
  misc_feature (174)..(311): Pfam Name: Tubulin_C Pfam Description: Tubulin/FtsZ family, C-terminal domain
  misc_feature: SWISSPROT Homolog: TBB4_ARATH Tubulin beta-4 chain (Beta-4 tubulin) with e-value of 3.1e-143 and BLAST sequence identity of 100.0
  misc_feature: SWISSPROT Homolog: TBB9_ARATH Tubulin beta-9 chain (Beta-9 tubulin) with e-value of 9.5e-142 and BLAST sequence identity of 98.5
  misc_feature: SWISSPROT Homolog: TBB3_SOYBN Tubulin beta chain (Beta tubulin) (Fragment) with e-value of 2.6e-139 and BLAST sequence identity of 96.3
  misc_feature: SWISSPROT Homolog: TBB5_ORYSA Tubulin beta-5 chain (Beta-5 tubulin) with e-value of 6.9e-139 and BLAST sequence identity of 95.9
  misc_feature: SWISSPROT Homolog: TBB5_GOSHI Tubulin beta-5 chain (Beta-5 tubulin) with e-value of 8.8e-139 and BLAST sequence identity of 95.9
  misc_feature 254255:<222: Transcription Factor
  misc_feature: Phenotype: INFLORESCENCE - Asecondary Branching Useful for making ornamental plants with modified flowers
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - High Anthocyanin Useful for modulating anthocyanin content
  misc_feature (1)..(373): Functional Homolog of  Ceres CLONE ID no. 107731 at SEQ ID NO. 2307 with e-value of 2.20E-139 and BLAST sequence identity of 96.2
MDSVRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPKGLKMASTFIGNSTSIQEMFRRVSEQFTAMFRRKAFLHWYTGEGMDEMEFTEAESNMNDLVAEYQQYQDATIDEEEYEEEEEEEHDT

SEQ ID NO: 2266 - DNA, 1608 bp, Populus balsamifera subsp. trichocarpa; identical to SEQ ID NO: 1551
  misc_feature (1)..(1608): Ceres ANNOT ID no. 1442194
  misc_feature 254388:<222: Transcription Factor
  misc_feature: Phenotype: INFLORESCENCE - Asecondary Branching Useful for making ornamental plants with modified flowers
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - High Anthocyanin Useful for modulating anthocyanin content

SEQ ID NO: 2267 - protein, 380 aa, Populus balsamifera subsp. trichocarpa
  misc_feature (1)..(380): Ceres ANNOT ID no. 1442194
  misc_feature (181)..(318): Pfam Name: Tubulin_C Pfam Description: Tubulin/FtsZ family, C-terminal domain
  misc_feature (2)..(179): Pfam Name: Tubulin Pfam Description: Tubulin/FtsZ family, GTPase domain
  misc_feature: SWISSPROT Homolog: TBB4_ARATH Tubulin beta-4 chain (Beta-4 tubulin) with e-value of 3.1e-143 and BLAST sequence identity of 100.0
  misc_feature: SWISSPROT Homolog: TBB9_ARATH Tubulin beta-9 chain (Beta-9 tubulin) with e-value of 9.5e-142 and BLAST sequence identity of 98.5
  misc_feature: SWISSPROT Homolog: TBB3_SOYBN Tubulin beta chain (Beta tubulin) (Fragment) with e-value of 2.6e-139 and BLAST sequence identity of 96.3
  misc_feature: SWISSPROT Homolog: TBB5_ORYSA Tubulin beta-5 chain (Beta-5 tubulin) with e-value of 6.9e-139 and BLAST sequence identity of 95.9
  misc_feature: SWISSPROT Homolog: TBB5_GOSHI Tubulin beta-5 chain (Beta-5 tubulin) with e-value of 8.8e-139 and BLAST sequence identity of 95.9
  misc_feature 254547:<222: Transcription Factor
  misc_feature: Phenotype: INFLORESCENCE - Asecondary Branching Useful for making ornamental plants with modified flowers
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - High Anthocyanin Useful for modulating anthocyanin content
  misc_feature (1)..(380): Functional Homolog of  Ceres CLONE ID no. 107731 at SEQ ID NO. 2307 with e-value of 9.70E-139 and BLAST sequence identity of 95.5
MDLEPGTMDSLRSGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNLIPFPRLHFFMVGFAPLTSRGSQQYRSLTVPELTQQMWDAKNMMCAADPRHGRYLTASAMFRGKMSTKEVDEQMINVQNKNSSYFVEWIPNNVKSSVCDIPPRGLKMASTFIGNSTSIQEMFRRVSEQFTAMFRRKAFLHWYTGEGMDEMEFTEAESNMNDLVAEYQQYQDATADDEEYEEEEEEEIGA

SEQ ID NO: 2268 - DNA, 1335 bp, Populus balsamifera subsp. trichocarpa; identical to SEQ ID NO: 1553
  misc_feature (1)..(1335): Ceres ANNOT ID no. 1454127
  misc_feature 254680:<222: Transcription Factor
  misc_feature: Phenotype: INFLORESCENCE - Asecondary Branching Useful for making ornamental plants with modified flowers
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - High Anthocyanin Useful for modulating anthocyanin content

SEQ ID NO: 2269 - protein, 372 aa, Populus balsamifera subsp. trichocarpa
  misc_feature (1)..(372): Ceres ANNOT ID no. 1454127
  misc_feature (1)..(172): Pfam Name: Tubulin Pfam Description: Tubulin/FtsZ family, GTPase domain
  misc_feature (174)..(311): Pfam Name: Tubulin_C Pfam Description: Tubulin/FtsZ family, C-terminal domain
  misc_feature: SWISSPROT Homolog: TBB4_ARATH Tubulin beta-4 chain (Beta-4 tubulin) with e-value of 3.1e-143 and BLAST sequence identity of 100.0
  misc_feature: SWISSPROT Homolog: TBB9_ARATH Tubulin beta-9 chain (Beta-9 tubulin) with e-value of 9.5e-142 and BLAST sequence identity of 98.5
  misc_feature: SWISSPROT Homolog: TBB3_SOYBN Tubulin beta chain (Beta tubulin) (Fragment) with e-value of 2.6e-139 and BLAST sequence identity of 96.3
  misc_feature: SWISSPROT Homolog: TBB5_ORYSA Tubulin beta-5 chain (Beta-5 tubulin) with e-value of 6.9e-139 and BLAST sequence identity of 95.9
  misc_feature: SWISSPROT Homolog: TBB5_GOSHI Tubulin beta-5 chain (Beta-5 tubulin) with e-value of 8.8e-139 and BLAST sequence identity of 95.9
  misc_feature 254831:<222: Transcription Factor
  misc_feature: Phenotype: INFLORESCENCE - Asecondary Branching Useful for making ornamental plants with modified flowers
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - High Anthocyanin Useful for modulating anthocyanin content
  misc_feature (1)..(372): Functional Homolog of  Ceres CLONE ID no. 107731 at SEQ ID NO. 2307 with e-value of 4.20E-138 and BLAST sequence identity of 95.1
MDSVRSGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYSALTVPELTQQMWDAKNMMCAADPRHGRYLTASAMFRGKMSTKEVDEQMINVQNKNSSYFVEWIPNNVKSTVCDIPPTGLKMASTFIGNSTSIQEMFRRVSEQFTAMFRRKAFLHWYTGEGMDEMEFTEAESNMNDLVSEYQQYQDATADEDYEDEEEELHDM

SEQ ID NO: 2270 - DNA, 1344 bp, Populus balsamifera subsp. trichocarpa; identical to SEQ ID NO: 1561
  misc_feature (1)..(1344): Ceres ANNOT ID no. 1461414
  misc_feature 254964:<222: Transcription Factor
  misc_feature: Phenotype: INFLORESCENCE - Asecondary Branching Useful for making ornamental plants with modified flowers
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - High Anthocyanin Useful for modulating anthocyanin content

SEQ ID NO: 2271 - protein, 375 aa, Populus balsamifera subsp. trichocarpa
  misc_feature (1)..(375): Ceres ANNOT ID no. 1461414
  misc_feature (1)..(172): Pfam Name: Tubulin Pfam Description: Tubulin/FtsZ family, GTPase domain
  misc_feature (174)..(311): Pfam Name: Tubulin_C Pfam Description: Tubulin/FtsZ family, C-terminal domain
  misc_feature: SWISSPROT Homolog: TBB4_ARATH Tubulin beta-4 chain (Beta-4 tubulin) with e-value of 3.1e-143 and BLAST sequence identity of 100.0
  misc_feature: SWISSPROT Homolog: TBB9_ARATH Tubulin beta-9 chain (Beta-9 tubulin) with e-value of 9.5e-142 and BLAST sequence identity of 98.5
  misc_feature: SWISSPROT Homolog: TBB3_SOYBN Tubulin beta chain (Beta tubulin) (Fragment) with e-value of 2.6e-139 and BLAST sequence identity of 96.3
  misc_feature: SWISSPROT Homolog: TBB5_ORYSA Tubulin beta-5 chain (Beta-5 tubulin) with e-value of 6.9e-139 and BLAST sequence identity of 95.9
  misc_feature: SWISSPROT Homolog: TBB5_GOSHI Tubulin beta-5 chain (Beta-5 tubulin) with e-value of 8.8e-139 and BLAST sequence identity of 95.9
  misc_feature 255115:<222: Transcription Factor
  misc_feature: Phenotype: INFLORESCENCE - Asecondary Branching Useful for making ornamental plants with modified flowers
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - High Anthocyanin Useful for modulating anthocyanin content
  misc_feature (1)..(375): Functional Homolog of  Ceres CLONE ID no. 107731 at SEQ ID NO. 2307 with e-value of 1.40E-137 and BLAST sequence identity of 94.7
MDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPRGLAMASTFIGNSTSIQEMFRRVSEQFTAMFRRKAFLHWYTGEGMDEMEFTEAESNMNDLVSEYQQYQDATADEEVDYEDEEEEDAAGM

SEQ ID NO: 2272 - DNA, 1341 bp, Populus balsamifera subsp. trichocarpa; identical to SEQ ID NO: 1563
  misc_feature (1)..(1341): Ceres ANNOT ID no. 1447424
  misc_feature 255248:<222: Transcription Factor
  misc_feature: Phenotype: INFLORESCENCE - Asecondary Branching Useful for making ornamental plants with modified flowers
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - High Anthocyanin Useful for modulating anthocyanin content

SEQ ID NO: 2273 - protein, 374 aa, Populus balsamifera subsp. trichocarpa
  misc_feature (1)..(374): Ceres ANNOT ID no. 1447424
  misc_feature (1)..(172): Pfam Name: Tubulin Pfam Description: Tubulin/FtsZ family, GTPase domain
  misc_feature (174)..(311): Pfam Name: Tubulin_C Pfam Description: Tubulin/FtsZ family, C-terminal domain
  misc_feature: SWISSPROT Homolog: TBB4_ARATH Tubulin beta-4 chain (Beta-4 tubulin) with e-value of 3.1e-143 and BLAST sequence identity of 100.0
  misc_feature: SWISSPROT Homolog: TBB9_ARATH Tubulin beta-9 chain (Beta-9 tubulin) with e-value of 9.5e-142 and BLAST sequence identity of 98.5
  misc_feature: SWISSPROT Homolog: TBB3_SOYBN Tubulin beta chain (Beta tubulin) (Fragment) with e-value of 2.6e-139 and BLAST sequence identity of 96.3
  misc_feature: SWISSPROT Homolog: TBB5_ORYSA Tubulin beta-5 chain (Beta-5 tubulin) with e-value of 6.9e-139 and BLAST sequence identity of 95.9
  misc_feature: SWISSPROT Homolog: TBB5_GOSHI Tubulin beta-5 chain (Beta-5 tubulin) with e-value of 8.8e-139 and BLAST sequence identity of 95.9
  misc_feature 255399:<222: Transcription Factor
  misc_feature: Phenotype: INFLORESCENCE - Asecondary Branching Useful for making ornamental plants with modified flowers
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - High Anthocyanin Useful for modulating anthocyanin content
  misc_feature (1)..(374): Functional Homolog of  Ceres CLONE ID no. 107731 at SEQ ID NO. 2307 with e-value of 6.09E-137 and BLAST sequence identity of 94.4
MDSVRSGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSTVCDIPPTGLTMASTFIGNSTSIQEMFRRVSEQFTAMFRRKAFLHWYTGEGMDEMEFTEAESNMNDLVSEYQQYQDATADEEGEYEDEEAYQDED

SEQ ID NO: 2274 - DNA, 1350 bp, Populus balsamifera subsp. trichocarpa; identical to SEQ ID NO: 1573
  misc_feature (1)..(1350): Ceres ANNOT ID no. 1452873
  misc_feature 255532:<222: Transcription Factor
  misc_feature: Phenotype: INFLORESCENCE - Asecondary Branching Useful for making ornamental plants with modified flowers
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - High Anthocyanin Useful for modulating anthocyanin content

SEQ ID NO: 2275 - protein, 374 aa, Populus balsamifera subsp. trichocarpa
  misc_feature (1)..(374): Ceres ANNOT ID no. 1452873
  misc_feature (1)..(172): Pfam Name: Tubulin Pfam Description: Tubulin/FtsZ family, GTPase domain
  misc_feature (174)..(311): Pfam Name: Tubulin_C Pfam Description: Tubulin/FtsZ family, C-terminal domain
  misc_feature: SWISSPROT Homolog: TBB4_ARATH Tubulin beta-4 chain (Beta-4 tubulin) with e-value of 3.1e-143 and BLAST sequence identity of 100.0
  misc_feature: SWISSPROT Homolog: TBB9_ARATH Tubulin beta-9 chain (Beta-9 tubulin) with e-value of 9.5e-142 and BLAST sequence identity of 98.5
  misc_feature: SWISSPROT Homolog: TBB3_SOYBN Tubulin beta chain (Beta tubulin) (Fragment) with e-value of 2.6e-139 and BLAST sequence identity of 96.3
  misc_feature: SWISSPROT Homolog: TBB5_ORYSA Tubulin beta-5 chain (Beta-5 tubulin) with e-value of 6.9e-139 and BLAST sequence identity of 95.9
  misc_feature: SWISSPROT Homolog: TBB5_GOSHI Tubulin beta-5 chain (Beta-5 tubulin) with e-value of 8.8e-139 and BLAST sequence identity of 95.9
  misc_feature 255683:<222: Transcription Factor
  misc_feature: Phenotype: INFLORESCENCE - Asecondary Branching Useful for making ornamental plants with modified flowers
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - High Anthocyanin Useful for modulating anthocyanin content
  misc_feature (1)..(374): Functional Homolog of  Ceres CLONE ID no. 107731 at SEQ ID NO. 2307 with e-value of 6.99E-136 and BLAST sequence identity of 92.9
MESIRSGPYGQIFRPDNFVHGQSGAGNNWAKGHYTEGAELIDAVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLSTPSFGDLNHLISETMSGVTCCLRFPGQLNSDLRKLAVNLIPFPRLHFFMVGFAPLTSRGSQGYISLTVPELTQQMWDSKNMMCAADPRHGRYLTASAMFRGKMSTKEVDEQMINVQNKNSSYFVEWIPNNVKSSVCDIPPKGLKMSSTFVGNSTSIQEMFRRVSEQFTAMFRRKAFLHWYTGEGMDEMEFTEAESNMNDLVAEYQQYQDATVEEDGEYEEEGEENYDD

SEQ ID NO: 2276 - DNA, 1380 bp, Populus balsamifera subsp. trichocarpa; identical to SEQ ID NO: 1581
  misc_feature (1)..(1380): Ceres ANNOT ID no. 1474708
  misc_feature 255816:<222: Transcription Factor
  misc_feature: Phenotype: INFLORESCENCE - Asecondary Branching Useful for making ornamental plants with modified flowers
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - High Anthocyanin Useful for modulating anthocyanin content

SEQ ID NO: 2277 - protein, 387 aa, Populus balsamifera subsp. trichocarpa
  misc_feature (1)..(387): Ceres ANNOT ID no. 1474708
  misc_feature (1)..(181): Pfam Name: Tubulin Pfam Description: Tubulin/FtsZ family, GTPase domain
  misc_feature (183)..(320): Pfam Name: Tubulin_C Pfam Description: Tubulin/FtsZ family, C-terminal domain
  misc_feature: SWISSPROT Homolog: TBB4_ARATH Tubulin beta-4 chain (Beta-4 tubulin) with e-value of 3.1e-143 and BLAST sequence identity of 100.0
  misc_feature: SWISSPROT Homolog: TBB9_ARATH Tubulin beta-9 chain (Beta-9 tubulin) with e-value of 9.5e-142 and BLAST sequence identity of 98.5
  misc_feature: SWISSPROT Homolog: TBB3_SOYBN Tubulin beta chain (Beta tubulin) (Fragment) with e-value of 2.6e-139 and BLAST sequence identity of 96.3
  misc_feature: SWISSPROT Homolog: TBB5_ORYSA Tubulin beta-5 chain (Beta-5 tubulin) with e-value of 6.9e-139 and BLAST sequence identity of 95.9
  misc_feature: SWISSPROT Homolog: TBB5_GOSHI Tubulin beta-5 chain (Beta-5 tubulin) with e-value of 8.8e-139 and BLAST sequence identity of 95.9
  misc_feature 255969:<222: Transcription Factor
  misc_feature: Phenotype: INFLORESCENCE - Asecondary Branching Useful for making ornamental plants with modified flowers
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - High Anthocyanin Useful for modulating anthocyanin content
  misc_feature (1)..(387): Functional Homolog of  Ceres CLONE ID no. 107731 at SEQ ID NO. 2307 with e-value of 2.69E-134 and BLAST sequence identity of 94.4
MDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSSHLDHYSLTVGDLNHLISATMSGVTCCLRFPGQLNSDLRKLAVNLIPFPRLHFFMVGFAPLTSRGSQQYRALTVPELTQQMWDSKNMMCAADPRHGRYLTASAMFRGKMSTKEVDEQMINVQNKNSSYFVEWIPNNVKSSVCDIPPRGLAMASTFIGNSTSIQEMFRRVSEQFTAMFRRKAFLHWYTGEGMDEMEFTEAESNMNDLVSEYQQYQDATADEEGEYDDEEEEEGQYAEQM

SEQ ID NO: 2278 - protein, 171 aa, Arabidopsis thaliana
  misc_feature (1)..(171): Ceres CLONE ID no. 107988
  misc_feature (15)..(156): Pfam Name: AWPM-19 Pfam Description: AWPM-19-like family
  misc_feature: Phenotype: ROSETTE LEAVES - Curled 2 Useful for making ornamental plants with altered leaf shape
  misc_feature: Phenotype: FLOWER - Reduced fertility Useful for sterility, genetic confinement systems
  misc_feature: Phenotype: ROSETTE LEAVES - Other Useful for making ornamental plants with modified leaves
MASGGSKSAAFMLLMLNLGLYFVITIIASWAVNHGIERTRESASTLSLPAKIFPIYFPVGNMATGFFVIFTLIAGVVGMATSLTGIINVLQWDSPNLHSAAASSLISWSLTLLAMGLACKEINIGWTEANLRTLEVLTIIVSATQLLCTGAIHAGVGETVASGERPHLGRV

SEQ ID NO: 2279 - DNA, 513 bp, Populus balsamifera subsp. trichocarpa
  misc_feature (1)..(513): Ceres ANNOT ID no. 1459927
  misc_feature 256180:<222: Transcription Factor
  misc_feature: Phenotype: ROSETTE LEAVES - Curled 2 Useful for making ornamental plants with altered leaf shape
  misc_feature: Phenotype: FLOWER - Reduced fertility Useful for sterility, genetic confinement systems
  misc_feature: Phenotype: ROSETTE LEAVES - Other Useful for making ornamental plants with modified leaves
atggcttctggagcaagcaaatctgctgccttcatgctcttaatcctcaatatggggctgtattttctcatgatagtaatcggttcatgggctataaatcatgggattgtaagatctcgtgaaacagcggctattttgacaatcccagcacgcatctttccgatatacttcccgatgggaaatttggcaacaggtttcttcatcattctctcccttcttgccggcgttgtgggcttcacctcctctattactggacttcataacgtttttctctggaatgctccaaacttacacgcagcatatgcgtcttctctagcatcattgtcactcacccttctatccatgggattcgcatgcaaagagatcgacataggctggacagattcagtcttgcgtactctagaagtggtgacaataattgtgagtggaacccaattattgtgcactggtgctatccatgttggagtagaagatatggtcgcacgacagaagaacctgggaggaagagtttga

SEQ ID NO: 2280 - protein, 170 aa, Populus balsamifera subsp. trichocarpa
  misc_feature (1)..(170): Ceres ANNOT ID no. 1459927
  misc_feature (15)..(156): Pfam Name: AWPM-19 Pfam Description: AWPM-19-like family
  misc_feature 256243:<222: Transcription Factor
  misc_feature: Phenotype: ROSETTE LEAVES - Curled 2 Useful for making ornamental plants with altered leaf shape
  misc_feature: Phenotype: FLOWER - Reduced fertility Useful for sterility, genetic confinement systems
  misc_feature: Phenotype: ROSETTE LEAVES - Other Useful for making ornamental plants with modified leaves
  misc_feature (1)..(170): Functional Homolog of  Ceres CLONE ID no. 107988 at SEQ ID NO. 2322 with e-value of 1.30E-58 and BLAST sequence identity of 69.5
MASGASKSAAFMLLILNMGLYFLMIVIGSWAINHGIVRSRETAAILTIPARIFPIYFPMGNLATGFFIILSLLAGVVGFTSSITGLHNVFLWNAPNLHAAYASSLASLSLTLLSMGFACKEIDIGWTDSVLRTLEVVTIIVSGTQLLCTGAIHVGVEDMVARQKNLGGRV

SEQ ID NO: 2281 - protein, 377 aa, Arabidopsis thaliana
  misc_feature (1)..(377): Ceres CLONE ID no. 108056
  misc_feature (17)..(150): Pfam Name: DUF6 Pfam Description: Integral membrane protein DUF6
  misc_feature: Phenotype: INFLORESCENCE - Late Flowering Useful for modulating flowering time
  misc_feature: Phenotype: WHOLE PLANT - Small Useful for modulating plant size
MKFERARPFIAIVFIQCLYALMSIVAKLALNKGMSPHVLVAYRMAVASALITPFALILERNTRPKLTFKILLQIAILSLFEPVVEQNLYYSGMKLTTATFTSALCNALPAMTFIMACVFKLEKVTIERRHSQAKLVGTMVAIGGAMLMTFVKGNVIELPWTSNSRGLNGHTHAMRIPKQADIARGSIMLVASCFSWSCYIILQAKILAQYKAELSLTALMCIMGMLEATVMGLIWERKNMSVWKINPDVTLLASIYGGLVSGLAYYVIGWASKERGPVFVSAFNPLSMVLVAILSTFVFLEKVYVGRVIGSVVIVIGIYLVLWGKSKDKGGMLQPNAGCAETVVKIDQQKVPTPDNNQVVSISYHLMIPKAAARSQE

SEQ ID NO: 2282 - DNA, 1146 bp, Populus balsamifera subsp. trichocarpa
  misc_feature (1)..(1146): Ceres ANNOT ID no. 1464935
  misc_feature 256430:<222: Transcription Factor
  misc_feature: Phenotype: INFLORESCENCE - Late Flowering Useful for modulating flowering time
  misc_feature: Phenotype: WHOLE PLANT - Small Useful for modulating plant size
atggcaacagagtcctcggattcgccttatgataaggcaaagccatttctggctgtggtacttatgcagtttggctatgcaggcatgtccataatttctaagcatgccctaaatgaagggatgagccagcatgtattggtagtctaccggcatgccgttgccaccattgtcatagctccatttgcctttatttttgataggaaagtcaggccaaagatgactctctccatcttcttcaagataatgttaatgggcttgttggagccaacgattgaccagaacttgtactacactggcatgaaatataccacagcaactttcgcttctgccatgtgcaatattcttccggcttttgcatttttgatggcttgggccttgaggcttgagaaggttaacataaggaaaatgcatagccaggcaaagataattgggaccatagtcacagtgggaggggctatgcttatgactcttgtcaaggggacccagttggatttgccgtggacaaaagggtatgatcaacatgcatctacaggtggattaaccaagcaggatcctattaagggtgctcttatgatcaccacaggttgtgcctgttgggctagcttcataattctccaggcaataacattaaaatcatacccagttgagctctcccttacggcttggatatgtttcatgggaactatagaaggtactgtgttagcagttgtaatggaaagaggaaatccctcagcttggtcgatagccttggattataaactattggctgctgtttatagcggcgtattctgttctgggcttgcttattatgtccaaggattgattatgaagcgtcgaggacctgtttttgtgactgccttcaatcctttaagcatggttatcgttgccattttaggctcttttttcttgaaagagatattatacttgggaagggtttttggagcagttgtcatcgttactgggctatatctagtgttgtggggcaaaagcaaggatgaacctccatccaattcaagcaatgatcataaggtggcagcaagtgctacacaaatggctaccaaaacgcaggagaggacggagaccttgaatcaagattttgttgctctagatcttaccaaagttagacctaacgatgaatctgattga

SEQ ID NO: 2283 - protein, 381 aa, Populus balsamifera subsp. trichocarpa
  misc_feature (1)..(381): Ceres ANNOT ID no. 1464935
  misc_feature (197)..(327): Pfam Name: DUF6 Pfam Description: Integral membrane protein DUF6
  misc_feature: SWISSPROT Homolog: Y510_ARCFU Hypothetical transport protein AF0510 with e-value of 5.2e-08 and BLAST sequence identity of 26.3
  misc_feature: SWISSPROT Homolog: YCXC_BACSU Hypothetical transport protein ycxC with e-value of 4.9e-06 and BLAST sequence identity of 26.1
  misc_feature 256522:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature (1)..(381): Functional Homolog of  Ceres CLONE ID no. 108056 at SEQ ID NO. 2325 with e-value of 1.09E-93 and BLAST sequence identity of 56.0
MATESSDSPYDKAKPFLAVVLMQFGYAGMSIISKHALNEGMSQHVLVVYRHAVATIVIAPFAFIFDRKVRPKMTLSIFFKIMLMGLLEPTIDQNLYYTGMKYTTATFASAMCNILPAFAFLMAWALRLEKVNIRKMHSQAKIIGTIVTVGGAMLMTLVKGTQLDLPWTKGYDQHASTGGLTKQDPIKGALMITTGCACWASFIILQAITLKSYPVELSLTAWICFMGTIEGTVLAVVMERGNPSAWSIALDYKLLAAVYSGVFCSGLAYYVQGLIMKRRGPVFVTAFNPLSMVIVAILGSFFLKEILYLGRVFGAVVIVTGLYLVLWGKSKDEPPSNSSNDHKVAASATQMATKTQERTETLNQDFVALDLTKVRPNDESD

SEQ ID NO: 2284 - DNA, 1044 bp, Populus balsamifera subsp. trichocarpa
  misc_feature (1)..(1044): Ceres ANNOT ID no. 1458064
  misc_feature 256634:<222: Transcription Factor
  misc_feature: Phenotype: INFLORESCENCE - Late Flowering Useful for modulating flowering time
  misc_feature: Phenotype: WHOLE PLANT - Small Useful for modulating plant size
atggagtcctttattagcctttacaatcaagcaagggcatatttgcttgtgattttcgtgcaatttggctactcagtaatgtctatacttgccaagctcgctttgaatcttgggatgaagccacacgtactagtagcctacagaatggctgttgcctctattctctttactccatttgctcttgtcttagaaaggccagtgctagaccagaacttgttctacgctgggatgaaaattactacaccaactttcgtgcttgcaatgtgcaatattcttccggccatgacatttgttatggcttgcatcttcaagcttgagaaggtggatatgaggaggctgcacttccaggcaaaggtggttgggacactggtaacaatcggaggagcgatgctacttccattagctcatggaccattaataaatttgccatggaccaagaggaatttctgtcgcggtcaatctgcacatagcgtacacatccaagatctcattaagggtgctgttatggttatatttgggtgtttaagctggtcaagtttcattattctgcaagcaatgattctagaatcatacccagctaagctttcccttgctgctttaatgtgcataatgggcaccgtggaaagcaccatactggccttcgcagtggaacgagccaacactgcagtctggtctgtatacttcgatatcagacttttagctgctgtttatggtggaatactctcaggactagcttactatattttcggattgttagtaaaggaaaggggtccggtgtttatgagtgcttcaaatcctctaagcctggtgatggttgcaattttggggtccttcatcttcaaagagaaattctatctaggcagggctataggcgccatcgtgatcgttctaggcctgtatcttgttctatggggtaagagcaaggatcaaactacaacatccaatggtggcggtggaacaccatatgagcaaacagctagcgcggtaggaaatttacaggcttctaatcatggcttggttgccagtaatgttaatgcagcatga

SEQ ID NO: 2285 - protein, 347 aa, Populus balsamifera subsp. trichocarpa
  misc_feature (1)..(347): Ceres ANNOT ID no. 1458064
  misc_feature (22)..(65): Pfam Name: DUF6 Pfam Description: Integral membrane protein DUF6
  misc_feature: SWISSPROT Homolog: Y510_ARCFU Hypothetical transport protein AF0510 with e-value of 5.2e-08 and BLAST sequence identity of 26.3
  misc_feature: SWISSPROT Homolog: YCXC_BACSU Hypothetical transport protein ycxC with e-value of 4.9e-06 and BLAST sequence identity of 26.1
  misc_feature 256722:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature (1)..(347): Functional Homolog of  Ceres CLONE ID no. 108056 at SEQ ID NO. 2325 with e-value of 1.50E-92 and BLAST sequence identity of 59.4
MESFISLYNQARAYLLVIFVQFGYSVMSILAKLALNLGMKPHVLVAYRMAVASILFTPFALVLERPVLDQNLFYAGMKITTPTFVLAMCNILPAMTFVMACIFKLEKVDMRRLHFQAKVVGTLVTIGGAMLLPLAHGPLINLPWTKRNFCRGQSAHSVHIQDLIKGAVMVIFGCLSWSSFIILQAMILESYPAKLSLAALMCIMGTVESTILAFAVERANTAVWSVYFDIRLLAAVYGGILSGLAYYIFGLLVKERGPVFMSASNPLSLVMVAILGSFIFKEKFYLGRAIGAIVIVLGLYLVLWGKSKDQTTTSNGGGGTPYEQTASAVGNLQASNHGLVASNVNAA

SEQ ID NO: 2286 - DNA, 1074 bp, Populus balsamifera subsp. trichocarpa
  misc_feature (1)..(1074): Ceres ANNOT ID no. 1511298
  misc_feature 256828:<222: Transcription Factor
  misc_feature: Phenotype: INFLORESCENCE - Late Flowering Useful for modulating flowering time
  misc_feature: Phenotype: WHOLE PLANT - Small Useful for modulating plant size
atggagtcctttattagcctttacaatcaagcaagggcatatttgcttgtgattttcgtgcaatttggctactcagtaatgtctatacttgccaagctcgctttgaatcttgggatgaagccacacgtactagtagcctacagaatggctgttgcctctattctctttactccatttgctcttgtcttagaaaggccagtgctagaccagaacttgttctacgctgggatgaaaattactacaccaactttcgtgcttgcaatgtgcaatattcttccggccatgacatttgttatggcttgcatcttcaagcttgagaaggtggatatgaggaggctgcacttccaggcaaaggtggttgggacactggtaacaatcggaggagcgatgctacttccattagctcatggaccattaataaatttgccatggaccaagaggaatttctgtcgcggtcaatctgcacatagcgtacacatccaagatctcattaagggtgctgttatggttatatttgggtgtttaagctggtcaagtttcattattctgcaagcaatgattctagaatcatacccagctaagctttcccttgctgctttaatgtgcataatgggcaccgtggaaagcaccatactggccttcgcagtggaacgagccaacactgcagtctggtctgtatacttcgatatcagacttttagctgctgtttatggtggattaaacaattccttacttgattggcagggaatactctcaggactagcttactatattttcggattgttagtaaaggaaaggggtccggtgtttatgagtgcttcaaatcctctaagcctggtgatggttgcaattttggggtccttcatcttcaaagagaaattctatctaggcagggctataggcgccatcgtgatcgttctaggcctgtatcttgttctatggggtaagagcaaggatcaaactacaacatccaatggtggcggtggaacaccatatgagcaaacagctagcgcggtaggaaatttacaggcttctaatcatggcttggttgccagtaatgttaatgcagcatga

SEQ ID NO: 2287 - protein, 357 aa, Populus balsamifera subsp. trichocarpa
  misc_feature (1)..(357): Ceres ANNOT ID no. 1511298
  misc_feature (22)..(65): Pfam Name: DUF6 Pfam Description: Integral membrane protein DUF6
  misc_feature: SWISSPROT Homolog: Y510_ARCFU Hypothetical transport protein AF0510 with e-value of 5.2e-08 and BLAST sequence identity of 26.3
  misc_feature: SWISSPROT Homolog: YCXC_BACSU Hypothetical transport protein ycxC with e-value of 4.9e-06 and BLAST sequence identity of 26.1
  misc_feature 256916:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature (1)..(357): Functional Homolog of  Ceres CLONE ID no. 108056 at SEQ ID NO. 2325 with e-value of 6.89E-90 and BLAST sequence identity of 59.7
MESFISLYNQARAYLLVIFVQFGYSVMSILAKLALNLGMKPHVLVAYRMAVASILFTPFALVLERPVLDQNLFYAGMKITTPTFVLAMCNILPAMTFVMACIFKLEKVDMRRLHFQAKVVGTLVTIGGAMLLPLAHGPLINLPWTKRNFCRGQSAHSVHIQDLIKGAVMVIFGCLSWSSFIILQAMILESYPAKLSLAALMCIMGTVESTILAFAVERANTAVWSVYFDIRLLAAVYGGLNNSLLDWQGILSGLAYYIFGLLVKERGPVFMSASNPLSLVMVAILGSFIFKEKFYLGRAIGAIVIVLGLYLVLWGKSKDQTTTSNGGGGTPYEQTASAVGNLQASNHGLVASNVNAA

SEQ ID NO: 2288 - DNA, 1182 bp, Populus balsamifera subsp. trichocarpa
  misc_feature (1)..(1182): Ceres ANNOT ID no. 1458065
  misc_feature 257025:<222: Transcription Factor
  misc_feature: Phenotype: INFLORESCENCE - Late Flowering Useful for modulating flowering time
  misc_feature: Phenotype: WHOLE PLANT - Small Useful for modulating plant size
atggcaacagcgtcgtcctcttatgacagggcaaagccatttttggctgtgatactcttgcaatttggctatgcaggcatgttcacaatgactaagcatgcactggatgaagggatgagccaacatgtattggtagtctaccggcatgccgttgccaccattgtcattgctccatttgccttagtttttgacaggcaagggccaacgattgaccagaacttgtactataccggcatgaaatataccacggcaacttttacttctgctatgtgcaacgttcttccggcttttgcatttttgatggcttgggccttgaggattgagcaggttaacatcaggaaaatgcatagccaggcaaagatatttgggaccatagtcacagtgggaggggctatgcttatgaccctagttaaaggaactcagttggatttgccgtggactagagggtatgatcaacaagcatctactagtgcactaaccaagcaggatcctattaagggtgctcttatgattgccactggttgcgtctgttgggctagcttcataattctccagtcaataacattaaaatcgtacccagttgagctctcccttacagcttggatatgtttcatgggaactattgaaggttccatggtagcagttgtaatggaaagaggaaatccctcggcttggtctgtaggcttgaattacaaactattagctgctgtttacagtggcgtaatctgttccgggattggttactatgtgcaaggattgatcatgaagcgtaaaggacctgtttttgtgactgcctttagtcccttaagcatggttatcgttgcaattttgggctcctttttcttgaaagagatattatgcgtaggaagggttattggagcagttgtcattgttaccggcctatatctagtgttgtggggtaaaagcaaggatcaacctccatccgactcaagcgatgacaaagcagaagcaattgttacacaaactgctaccgaaatgcaggagaggacggatccggagactgtggatcaagaatttgttgctattgatattaccaaaagattcaagaccctgctaaacactcgagtgcccaccaagaatatacgcatccagcttagtcaagatttactgatcgaggtgcttgctgctggcaaacgatgcctacgtacagttcgaggataa

SEQ ID NO: 2289 - protein, 393 aa, Populus balsamifera subsp. trichocarpa
  misc_feature (1)..(393): Ceres ANNOT ID no. 1458065
  misc_feature (72)..(136): Pfam Name: DUF6 Pfam Description: Integral membrane protein DUF6
  misc_feature: SWISSPROT Homolog: Y510_ARCFU Hypothetical transport protein AF0510 with e-value of 5.2e-08 and BLAST sequence identity of 26.3
  misc_feature: SWISSPROT Homolog: YCXC_BACSU Hypothetical transport protein ycxC with e-value of 4.9e-06 and BLAST sequence identity of 26.1
  misc_feature 257117:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature (1)..(393): Functional Homolog of  Ceres CLONE ID no. 108056 at SEQ ID NO. 2325 with e-value of 3.50E-79 and BLAST sequence identity of 52.9
MATASSSYDRAKPFLAVILLQFGYAGMFTMTKHALDEGMSQHVLVVYRHAVATIVIAPFALVFDRQGPTIDQNLYYTGMKYTTATFTSAMCNVLPAFAFLMAWALRIEQVNIRKMHSQAKIFGTIVTVGGAMLMTLVKGTQLDLPWTRGYDQQASTSALTKQDPIKGALMIATGCVCWASFIILQSITLKSYPVELSLTAWICFMGTIEGSMVAVVMERGNPSAWSVGLNYKLLAAVYSGVICSGIGYYVQGLIMKRKGPVFVTAFSPLSMVIVAILGSFFLKEILCVGRVIGAVVIVTGLYLVLWGKSKDQPPSDSSDDKAEAIVTQTATEMQERTDPETVDQEFVAIDITKRFKTLLNTRVPTKNIRIQLSQDLLIEVLAAGKRCLRTVRG

SEQ ID NO: 2290 - DNA, 1161 bp, Populus balsamifera subsp. trichocarpa
  misc_feature (1)..(1161): Ceres ANNOT ID no. 1511299
  misc_feature 257232:<222: Transcription Factor
  misc_feature: Phenotype: INFLORESCENCE - Late Flowering Useful for modulating flowering time
  misc_feature: Phenotype: WHOLE PLANT - Small Useful for modulating plant size
atggcaacagcgtcgtcctcttatgacagggcaaagccatttttggctgtgatactcttgcaatttggctatgcaggcatgttcacaatgactaagcatgcactggatgaagggatgagccaacatgtattggtagtctaccggcatgccgttgccaccattgtcattgctccatttgccttagtttttgacaggcaagggccaacgattgaccagaacttgtactataccggcatgaaatataccacggcaacttttacttctgctatgtgcaacgttcttccggcttttgcatttttgatggcttgggccttgaggaaaatgcatagccaggcaaagatatttgggaccatagtcacagtgggaggggctatgcttatgaccctagttaaaggaactcagttggatttgccgtggactagagggtatgatcaacaagcatctactagtgcactaaccaagcaggatcctattaagggtgctcttatgattgccactggttgcgtctgttgggctagcttcataattctccagtcaataacattaaaatcgtacccagttgagctctcccttacagcttggatatgtttcatgggaactattgaaggttccatggtagcagttgtaatggaaagaggaaatccctcggcttggtctgtaggcttgaattacaaactattagctgctgtttacagtggcgtaatctgttccgggattggttactatgtgcaaggattgatcatgaagcgtaaaggacctgtttttgtgactgcctttagtcccttaagcatggttatcgttgcaattttgggctcctttttcttgaaagagatattatgcgtaggaagggttattggagcagttgtcattgttaccggcctatatctagtgttgtggggtaaaagcaaggatcaacctccatccgactcaagcgatgacaaagcagaagcaattgttacacaaactgctaccgaaatgcaggagaggacggatccggagactgtggatcaagaatttgttgctattgatattaccaaaagattcaagaccctgctaaacactcgagtgcccaccaagaatatacgcatccagcttagtcaagatttactgatcgaggtgcttgctgctggcaaacgatgcctacgtacagttcgaggataa

SEQ ID NO: 2291 - protein, 386 aa, Populus balsamifera subsp. trichocarpa
  misc_feature (1)..(386): Ceres ANNOT ID no. 1511299
  misc_feature (72)..(129): Pfam Name: DUF6 Pfam Description: Integral membrane protein DUF6
  misc_feature: SWISSPROT Homolog: Y510_ARCFU Hypothetical transport protein AF0510 with e-value of 5.2e-08 and BLAST sequence identity of 26.3
  misc_feature: SWISSPROT Homolog: YCXC_BACSU Hypothetical transport protein ycxC with e-value of 4.9e-06 and BLAST sequence identity of 26.1
  misc_feature 257324:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature (1)..(386): Functional Homolog of  Ceres CLONE ID no. 108056 at SEQ ID NO. 2325 with e-value of 1.80E-75 and BLAST sequence identity of 53.8
MATASSSYDRAKPFLAVILLQFGYAGMFTMTKHALDEGMSQHVLVVYRHAVATIVIAPFALVFDRQGPTIDQNLYYTGMKYTTATFTSAMCNVLPAFAFLMAWALRKMHSQAKIFGTIVTVGGAMLMTLVKGTQLDLPWTRGYDQQASTSALTKQDPIKGALMIATGCVCWASFIILQSITLKSYPVELSLTAWICFMGTIEGSMVAVVMERGNPSAWSVGLNYKLLAAVYSGVICSGIGYYVQGLIMKRKGPVFVTAFSPLSMVIVAILGSFFLKEILCVGRVIGAVVIVTGLYLVLWGKSKDQPPSDSSDDKAEAIVTQTATEMQERTDPETVDQEFVAIDITKRFKTLLNTRVPTKNIRIQLSQDLLIEVLAAGKRCLRTVRG

SEQ ID NO: 2292 - protein, 310 aa, Arabidopsis thaliana
  misc_feature (1)..(310): Ceres CLONE ID no. 108109
  misc_feature (1)..(310): Also Known As Ceres CDNA ID no. 23385230
  misc_feature (1)..(310): Also Known As Ceres GEMINI ID 531E9
  misc_feature (267)..(305): Pfam Name: CCT Pfam Description: CCT motif
  misc_feature 257459:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MVFHDLVPEMSTEDQAESYEVEEQLIFEVPVMNSMVEEQCFNQSLEKQNEFPMMPLSFKSSDEEDDDNAESCLNGLFPTDMELAQFTADVETLLGGGDREFHSIEELGLGEMLKIEKEEVEEEEGVVTREVHDQDEGDETSPFEISFDYEYTHKTTFDEGEEDEKEDVMKNVMEMGVNEMSGGIKEEKKEKALMLRLDYESVISTWGGQGIPWTARVPSEIDLDMVCFPTHTMGESGAEAHHHNHFRGLGLHLGDAGDGGREARVSRYREKRRTRLFSKKIRYEVRKLNADKRPRMKGRFVKRSSIGVAH

SEQ ID NO: 2293 - protein, 301 aa, Arabidopsis thaliana
  misc_feature (1)..(301): Ceres CLONE ID no. 108509
  misc_feature (1)..(301): Also Known As Ceres CDNA ID no. 23365210
  misc_feature (1)..(301): Also Known As Ceres GEMINI ID 539G6
  misc_feature (66)..(109): Pfam Name: G-patch Pfam Description: G-patch domain
  misc_feature 257565:<222: Transcription Factor
  misc_feature: Phenotype: Activates expression of the gene endogenous to the AtDXPR (SEQ ID NO 4143) regalutory region Useful for modulating Terpenoid Biosynthesis
MDISRRESKTEASSREKRIYEKDQMNQESFIEGLAEEFRLPITHRVTENVDLEDVEQASLDVKISSSNVGFRLLQKMGWKGKGLGKQEQGITEPIKSGIRDRRLGLGKQEEDDYFTAEENIQRKKLDIEIEETEEIAKKREVLAEREQKIQSDVKEIRKVFYCELCSKQYRTVMKFEGHLSSYDHNHKKRFKEMKEMHGASGRDDRKKREQQRQEREMTKMADARKQHQMQQSQQEVPENVPVSAPAKTTVAPLAVQDQRKTLKFGFSSKSGIISKSQPTSSIKKPKVAIASVFGNDSDED

SEQ ID NO: 2294 - DNA, 888 bp, Populus balsamifera subsp. trichocarpa
  misc_feature (1)..(888): Ceres ANNOT ID no. 1469082
  misc_feature 257647:<222: Transcription Factor
  misc_feature: Phenotype: Activates expression of the gene endogenous to the AtDXPR (SEQ ID NO 4143) regalutory region Useful for modulating Terpenoid Biosynthesis
atggattgcagatggttcattgataaacaggaaacaagcacccgcaatgaacagcaacttgacagagagcaggactcgcttattgaggatttcacagaggattttcgattgccgaaaaatcacagacccactgaaaatgttgatcttgacaatgttgaacaagcatcactggacacaaagttgacagcatcaaacgttggttttaggcttctccagaaaatgggatggaaaggaaagggtctcggaaaggacgagcaaggaatcattgagcctataaagtctggaattagagatccaaagttaggaattggaaaacaagaagaagatgatttttttactgcagaagaaaatattcagcgaaggaaacttgacatcgaggttgaagaaactgaggaagacacaaaaaagcgggaggtattagctgaacgggagcagaaaattcaaactgaggtgaaagagataaggaaggtgttcttttgtgatctttgcaacaagcaatacaaattggcgatggaatttgaagctcatctgagttcatacgatcataatcatagaaagcgatttaaggaaatgagagagatgcatggtacaagcagtcgtgatgatcggcaaaagcgggaactacaacgacaggagagggagatggctaagtttgcacagatggcagatgctcgtaaacaggagcagcagctgcagcaacaggaagaatctggatctgctcagcagaaaagtgcaactgcacttgtggatcaggatcagcggaaggcattaaaatttgggttttcttctaaagggggcttttcaaagaactcctctgccaaagctgcaaagaagccgaaatcagctgtagcctctgttttcagcaatgatagcgatgaagaacagtga

SEQ ID NO: 2295 - protein, 295 aa, Populus balsamifera subsp. trichocarpa
  misc_feature (1)..(295): Ceres ANNOT ID no. 1469082
  misc_feature (63)..(106): Pfam Name: G-patch Pfam Description: G-patch domain
  misc_feature: SWISSPROT Homolog: CB010_HUMAN Protein C2orf10 with e-value of 3.5e-11 and BLAST sequence identity of 36.8
  misc_feature: SWISSPROT Homolog: PINX1_HUMAN Pin2-interacting protein X1 (TRF1-interacting protein 1) (Liver-related putative tumor suppressor) (67-11-3 protein) with e-value of 4.9e-07 and BLAST sequence identity of 38.3
  misc_feature: SWISSPROT Homolog: PINX1_MOUSE Pin2-interacting protein X1 (TRF1-interacting protein 1) with e-value of 6.7e-07 and BLAST sequence identity of 38.3
  misc_feature: SWISSPROT Homolog: PINX1_MOUSE Liver-related putative tumor suppressor (LPTS1) 67-11-3 protein
  misc_feature: SWISSPROT Homolog: RBM10_RAT RNA-binding protein 10 (RNA-binding motif protein 10) (S1-1 protein) with e-value of 6.5e-06 and BLAST sequence identity of 33.1
  misc_feature: SWISSPROT Homolog: RBM10_HUMAN RNA-binding protein 10 (RNA-binding motif protein 10) (DXS8237E) with e-value of 7.3e-06 and BLAST sequence identity of 33.1
  misc_feature 257754:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(295): Functional Homolog of  Ceres CLONE ID no. 108509 at SEQ ID NO. 2337 with e-value of 3.99E-101 and BLAST sequence identity of 71.3
MDCRWFIDKQETSTRNEQQLDREQDSLIEDFTEDFRLPKNHRPTENVDLDNVEQASLDTKLTASNVGFRLLQKMGWKGKGLGKDEQGIIEPIKSGIRDPKLGIGKQEEDDFFTAEENIQRRKLDIEVEETEEDTKKREVLAEREQKIQTEVKEIRKVFFCDLCNKQYKLAMEFEAHLSSYDHNHRKRFKEMREMHGTSSRDDRQKRELQRQEREMAKFAQMADARKQEQQLQQQEESGSAQQKSATALVDQDQRKALKFGFSSKGGFSKNSSAKAAKKPKSAVASVFSNDSDEEQ

SEQ ID NO: 2296 - DNA, 876 bp, Populus balsamifera subsp. trichocarpa
  misc_feature (1)..(876): Ceres ANNOT ID no. 1522474
  misc_feature 257844:<222: Transcription Factor
  misc_feature: Phenotype: Activates expression of the gene endogenous to the AtDXPR (SEQ ID NO 4143) regalutory region Useful for modulating Terpenoid Biosynthesis
atggattgcagatggttcattgataaacaggaaacaagcacccgcaatgaacagcaacttgacagagagcaggactcgcttattgaggatttcacagaggattttcgattgccgaaaaatcacagacccactgaaaatgttgatcttgacaatgttgaacaagcatcactggacacaaagttgacagcatcaaacgttggttttaggcttctccagaaaatgggatggaaaggaaagggtctcggaaaggacgagcaaggaatcattgagcctataaagtctggaattagagatccaaagttaggaattggaaaacaagaagaagatgatttttttactgcagaagaaaatattcagcgaaggaaacttgacatcgaggttgaagaaactgaggaagacacaaaaaagcgggaggtattagctgaacgggagcagaaaattcaaactgaggtgaaagagataaggaaggtgttcttttgtgatctttgcaacaagcaatacaaattggcgatggaatttgaagctcatctgagttcatacgatcataatcatagaaagcgatttaaggaaatgagagagatgcatggtacaagcagtcgtgatgatcggcaaaagcgggaactacaacgacaggagagggagatggctaaggcagatgctcgtaaacaggagcagcagctgcagcaacaggaagaatctggatctgctcagcagaaaagtgcaactgcacttgtggatcaggatcagcggaaggcattaaaatttgggttttcttctaaagggggcttttcaaagaactcctctgccaaagctgcaaagaagccgaaatcagctgtagcctctgttttcagcaatgatagcgatgaagaacagtga

SEQ ID NO: 2297 - protein, 291 aa, Populus balsamifera subsp. trichocarpa
  misc_feature (1)..(291): Ceres ANNOT ID no. 1522474
  misc_feature (63)..(106): Pfam Name: G-patch Pfam Description: G-patch domain
  misc_feature: SWISSPROT Homolog: CB010_HUMAN Protein C2orf10 with e-value of 3.5e-11 and BLAST sequence identity of 36.8
  misc_feature: SWISSPROT Homolog: PINX1_HUMAN Pin2-interacting protein X1 (TRF1-interacting protein 1) (Liver-related putative tumor suppressor) (67-11-3 protein) with e-value of 4.9e-07 and BLAST sequence identity of 38.3
  misc_feature: SWISSPROT Homolog: PINX1_MOUSE Pin2-interacting protein X1 (TRF1-interacting protein 1) with e-value of 6.7e-07 and BLAST sequence identity of 38.3
  misc_feature: SWISSPROT Homolog: PINX1_MOUSE Liver-related putative tumor suppressor (LPTS1) 67-11-3 protein
  misc_feature: SWISSPROT Homolog: RBM10_RAT RNA-binding protein 10 (RNA-binding motif protein 10) (S1-1 protein) with e-value of 6.5e-06 and BLAST sequence identity of 33.1
  misc_feature: SWISSPROT Homolog: RBM10_HUMAN RNA-binding protein 10 (RNA-binding motif protein 10) (DXS8237E) with e-value of 7.3e-06 and BLAST sequence identity of 33.1
  misc_feature 257951:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(291): Functional Homolog of  Ceres CLONE ID no. 108509 at SEQ ID NO. 2337 with e-value of 5.10E-101 and BLAST sequence identity of 71.2
MDCRWFIDKQETSTRNEQQLDREQDSLIEDFTEDFRLPKNHRPTENVDLDNVEQASLDTKLTASNVGFRLLQKMGWKGKGLGKDEQGIIEPIKSGIRDPKLGIGKQEEDDFFTAEENIQRRKLDIEVEETEEDTKKREVLAEREQKIQTEVKEIRKVFFCDLCNKQYKLAMEFEAHLSSYDHNHRKRFKEMREMHGTSSRDDRQKRELQRQEREMAKADARKQEQQLQQQEESGSAQQKSATALVDQDQRKALKFGFSSKGGFSKNSSAKAAKKPKSAVASVFSNDSDEEQ

SEQ ID NO: 2298 - protein, 593 aa, Arabidopsis thaliana
  misc_feature (1)..(593): Ceres CLONE ID no. 109490
  misc_feature (1)..(593): Also Known As Ceres CDNA ID no. 23365746
  misc_feature (1)..(593): Also Known As Ceres GEMINI ID 552G11
  misc_feature (196)..(502): Pfam Name: GRAS Pfam Description: GRAS family transcription factor
  misc_feature 258061:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
MVEQTVVREHIKARVMSLVRSAEPSSYRNPKLYTLNENGNNNGVSSAQIFDPDRSKNPCLTDDSYPSQSYEKYFLDSPTDEFVQHPIGSGASVSSFGSLDSFPYQSRPVLGCSMEFQLPLDSTSTSSTRLLGDYQAVSYSPSMDVVEEFDDEQMRSKIQELERALLGDEDDKMVGIDNLMEIDSEWSYQNESEQHQDSPKESSSADSNSHVSSKEVVSQATPKQILISCARALSEGKLEEALSMVNELRQIVSIQGDPSQRIAAYMVEGLAARMAASGKFIYRALKCKEPPSDERLAAMQVLFEVCPCFKFGFLAANGAILEAIKGEEEVHIIDFDINQGNQYMTLIRSIAELPGKRPRLRLTGIDDPESVQRSIGGLRIIGLRLEQLAEDNGVSFKFKAMPSKTSIVSPSTLGCKPGETLIVNFAFQLHHMPDESVTTVNQRDELLHMVKSLNPKLVTVVEQDVNTNTSPFFPRFIEAYEYYSAVFESLDMTLPRESQERMNVERQCLARDIVNIVACEGEERIERYEAAGKWRARMMMAGFNPKPMSAKVTNNIQNLIKQQYCNKYKLKEEMGELHFCWEEKSLIVASAWR

SEQ ID NO: 2299 - DNA, 1758 bp, Populus balsamifera subsp. trichocarpa
  misc_feature (1)..(1758): Ceres ANNOT ID no. 1443194
  misc_feature 258208:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
atgtctttagttggacctgcagaactttctgcaacaccatacggaaatcataagctgtactcactgaaggggagcaatgacaactctggcttgtctgcccaaatattctgccctgataaacgtcagaacatgtatatgaccgattcttactccagtgagagttatgagaagtacttccttgattccccaacagaagagctaatacaaccatcaagttctggcatttcagggaattcagctccacctcaaggcacatcttcctaccagctaagaaagaatttaggtccatccatgtcccctcaagatgatccatacgacgcttgtttcacattgacgacaccctgtgatggctatcaattcaattccgagtcagattacttggacatcgagagcccagatccactaaactatgatgaatataagatgaaattaaagtttcaggaacttgagagagcgcttctaaatgataatgatgaggatggcatgtttggaaatagtcagagcatggaaatggatggagagtggtctgatccaatccagaatgggatgctccatgattctcccaaggagtcatcatcttctgattctagcctaagtagcatcagcagtaataaagaagtatcacagttatctcctcgaactcccaggcgattgctttttgaatgtgctaatgcaatctcagagggaaacattgagaaagcatcaactttaataaacgagctccgtcaattggtgtcaattcaaggagatcctccgcagaggattgcagcctacatggtggaaggtcttgcagctcgtatggctgaatctggaaaatatctctataaagctctgaaatgcaaggaacctccttcttctgataggcttgcagctatgcagatcctttttgagatttgcccttgttttaaatttggatttatggcagcaaatggtgcaatgatcgaggcatttaaaggtgaaaggagagttcatataatagattttgacataaaccaagggagtcaatacataacactgatacaaacactcgccaaccatcaaggtaagctaccacacttgaggttaacaggggtcgatgaccctgagtcagttcaacgacctgttggtggcctgaggatcattgggcaaaggcttgaaaagctagcagaagcatataaggtctcgttcgagtttcatgcagtggcctccaagacttcacttgtcaatccatcaatgctgaactgcaagcctggggaagcacttatagttaattttgctttccaactccaccacatgcctgatgagagtgtttcaacggtaaacgagagagaccagcttcttcggatggctaagagcttgaatccaaaactagtaactgttgttgagcaagatgtgaatactaacactgccccttttttcccgagattcaccgaagcttacaactattactctgctgtgtttgactctcttgatgcaactctcccacgggagagccaggatagactgaatgttgagaaacagtgcctggcaagggacatagtgaacatagtcgcatgtgagggagaggaaaggattgagcggtatgaagttgcagggaaatggagagcaaggatgatgatggctggcttcacttcatgttcaatcactcctaatgtggttgatatgatccggaaactcatcaaggagtactgcgatagatacatgttgaagcaggaagtaggtgcgcttcattttgggtgggaggacaaaagtttgattgttgcttcagcatggaagtaa

SEQ ID NO: 2300 - protein, 585 aa, Populus balsamifera subsp. trichocarpa
  misc_feature (1)..(585): Ceres ANNOT ID no. 1443194
  misc_feature (189)..(495): Pfam Name: GRAS Pfam Description: GRAS family transcription factor
  misc_feature: SWISSPROT Homolog: CIGR2_ORYSA Chitin-inducible gibberellin-responsive protein 2 with e-value of 6.8e-109 and BLAST sequence identity of 51.9
  misc_feature: SWISSPROT Homolog: CIGR1_ORYSA Chitin-inducible gibberellin-responsive protein 1 with e-value of 1.1e-99 and BLAST sequence identity of 51.3
  misc_feature: SWISSPROT Homolog: RGL2_ARATH DELLA protein RGL2 (RGA-like protein 2) (Scarecrow-like protein 19) with e-value of 2.8e-55 and BLAST sequence identity of 32.6
  misc_feature: SWISSPROT Homolog: RGL3_ARATH DELLA protein RGL3 (RGA-like protein 3) with e-value of 3.6e-54 and BLAST sequence identity of 35.7
  misc_feature: SWISSPROT Homolog: GAI1_VITVI DELLA protein GAI1 (Gibberellic acid-insensitive mutant protein 1) (VvGAI1) with e-value of 8.3e-53 and BLAST sequence identity of 33.5
  misc_feature 258345:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(585): Functional Homolog of  Ceres CLONE ID no. 109490 at SEQ ID NO. 2342 with e-value of 7.10E-191 and BLAST sequence identity of 66.3
MSLVGPAELSATPYGNHKLYSLKGSNDNSGLSAQIFCPDKRQNMYMTDSYSSESYEKYFLDSPTEELIQPSSSGISGNSAPPQGTSSYQLRKNLGPSMSPQDDPYDACFTLTTPCDGYQFNSESDYLDIESPDPLNYDEYKMKLKFQELERALLNDNDEDGMFGNSQSMEMDGEWSDPIQNGMLHDSPKESSSSDSSLSSISSNKEVSQLSPRTPRRLLFECANAISEGNIEKASTLINELRQLVSIQGDPPQRIAAYMVEGLAARMAESGKYLYKALKCKEPPSSDRLAAMQILFEICPCFKFGFMAANGAMIEAFKGERRVHIIDFDINQGSQYITLIQTLANHQGKLPHLRLTGVDDPESVQRPVGGLRIIGQRLEKLAEAYKVSFEFHAVASKTSLVNPSMLNCKPGEALIVNFAFQLHHMPDESVSTVNERDQLLRMAKSLNPKLVTVVEQDVNTNTAPFFPRFTEAYNYYSAVFDSLDATLPRESQDRLNVEKQCLARDIVNIVACEGEERIERYEVAGKWRARMMMAGFTSCSITPNVVDMIRKLIKEYCDRYMLKQEVGALHFGWEDKSLIVASAWK

SEQ ID NO: 2301 - DNA, 1755 bp, Populus balsamifera subsp. trichocarpa
  misc_feature (1)..(1755): Ceres ANNOT ID no. 1505312
  misc_feature 258497:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
atgtctttagttggatccgcagaactctctgccagagcatacggaaataataagctgtactcactgaaggggagcaatgacaactctggtttgtctgccaaaatattcgggcctgataaacggcagaacatgtatatgaccgattcttactcttgtgagagttatgagaagttcttccttgattccccaacagaagaaataatacaaccatcaagttctgacatttcagggaactcagctcatccacaaggggcatcttcctaccagccaagaaagagttcaggttcaaccatgttccctcaagatccctataatgcttctttcaatttgaccacaccctgcgatggctatccattcatttccgagtcagattacttggacattgagagcccatatcaactagattatgatgaatataagatgaagttaaagcttcaggaactagagagagcacttctagaggacaatgaagaggatggcatgtttggaaatagtcaaagcatggaaatggatgtagagtggtctgatccaatccagaatgggatgctccatgattctcccaaggagtcatcatcttcagattctaacctaagtagcttcagcagtaataaagaagtatcacagttatcacctcggactcccaggcgactgctttttgaatgtgctaatgcaatctcggagggaaacattgagaaagcatcggcattaataaatgagctccgtcaattggtctcgattcaaggagatcctccccagaggattgcagcctacatggtggaaggacttgcagctcatatggctgaatctggaatatatctctataaagctctgaaatgcaaggagcctccttctgatgataggcttgcagctatgcagatcctttttgagatttgcccttgttttaaatttggatttatggcagcaaatggtgcaatgatcgaagcatttaaaggtgaaaggagagttcatataatagattttgacataaaccaagggagtcaatacataacactgatacaaacactcgccaaccagccaggtaagctgccaaacttgaggttaaccggggttgatgaccccgagtcagttcaacgacctgttggtggcctgaggaacattgggcgaaggcttgaaaagctagcagaagcacttaaggtcccatttgagtttcatgcggtggcctccaagacttcagttgtcagtccatccatgctgaactgcaagcctggggaagcacttgtagtgaattttgctttccaactccatcacatgcctgatgagagtgtttcaacagtaaatgagcgagaccagcttcttcggatggctaagagcttgaatccaaaactggtaactgttgtcgagcaagatgtgaatactaatactgccccctttttcccgagatttactgaagcttacaactattactctgccgtgttcgattctcttgatgcaactctccctcgagaaagccaggacaggctgaatgttgagaaacagtgtctggcacgggacatagtaaacattgtagcatgtgagggagaggaaaggattgagaggtatgaggttgctgggaaatggagggcaagaatgaagatggcaggcttcactccgtgttcaatcagtcatagcgtggttgatttgattcgtaaactcataaagcagtatagcgatagatacatgttgaaggaggaagtgggtgcacttcattttgggtgggaagacaaaagtttggtttttgcttcagcatggaagtaa

SEQ ID NO: 2302 - protein, 584 aa, Populus balsamifera subsp. trichocarpa
  misc_feature (1)..(584): Ceres ANNOT ID no. 1505312
  misc_feature (189)..(494): Pfam Name: GRAS Pfam Description: GRAS family transcription factor
  misc_feature: SWISSPROT Homolog: CIGR2_ORYSA Chitin-inducible gibberellin-responsive protein 2 with e-value of 6.8e-109 and BLAST sequence identity of 51.9
  misc_feature: SWISSPROT Homolog: CIGR1_ORYSA Chitin-inducible gibberellin-responsive protein 1 with e-value of 1.1e-99 and BLAST sequence identity of 51.3
  misc_feature: SWISSPROT Homolog: RGL2_ARATH DELLA protein RGL2 (RGA-like protein 2) (Scarecrow-like protein 19) with e-value of 2.8e-55 and BLAST sequence identity of 32.6
  misc_feature: SWISSPROT Homolog: RGL3_ARATH DELLA protein RGL3 (RGA-like protein 3) with e-value of 3.6e-54 and BLAST sequence identity of 35.7
  misc_feature: SWISSPROT Homolog: GAI1_VITVI DELLA protein GAI1 (Gibberellic acid-insensitive mutant protein 1) (VvGAI1) with e-value of 8.3e-53 and BLAST sequence identity of 33.5
  misc_feature 258634:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(584): Functional Homolog of  Ceres CLONE ID no. 109490 at SEQ ID NO. 2342 with e-value of 1.40E-187 and BLAST sequence identity of 64.7
MSLVGSAELSARAYGNNKLYSLKGSNDNSGLSAKIFGPDKRQNMYMTDSYSCESYEKFFLDSPTEEIIQPSSSDISGNSAHPQGASSYQPRKSSGSTMFPQDPYNASFNLTTPCDGYPFISESDYLDIESPYQLDYDEYKMKLKLQELERALLEDNEEDGMFGNSQSMEMDVEWSDPIQNGMLHDSPKESSSSDSNLSSFSSNKEVSQLSPRTPRRLLFECANAISEGNIEKASALINELRQLVSIQGDPPQRIAAYMVEGLAAHMAESGIYLYKALKCKEPPSDDRLAAMQILFEICPCFKFGFMAANGAMIEAFKGERRVHIIDFDINQGSQYITLIQTLANQPGKLPNLRLTGVDDPESVQRPVGGLRNIGRRLEKLAEALKVPFEFHAVASKTSVVSPSMLNCKPGEALVVNFAFQLHHMPDESVSTVNERDQLLRMAKSLNPKLVTVVEQDVNTNTAPFFPRFTEAYNYYSAVFDSLDATLPRESQDRLNVEKQCLARDIVNIVACEGEERIERYEVAGKWRARMKMAGFTPCSISHSVVDLIRKLIKQYSDRYMLKEEVGALHFGWEDKSLVFASAWK

SEQ ID NO: 2303 - protein, 259 aa, Arabidopsis thaliana
  misc_feature (1)..(259): Ceres CLONE ID no. 109912
  misc_feature: Phenotype: ROSETTE LEAVES - Curled 3 Useful for making ornamental plants with altered leaf shape
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
MAADVSSLVRILSRFKDDRTVVKDSTGPRSTVALMTRDLLGIGGCVGGGGGGDEQSLELDLDVQVPNGWEKRLDLKSGKVYLQQQCNSTSSSSSSHHHHHHHEDQTNQTVPRFQDLNVPPISDKFPAKPLLSLFDDDDDTSLELKLVPSSISRPLPPPLSSFSPNQSLSYLSSVCTLDKVKLALERAEKDTKKRQSPEDDGVYDGTASATVAASQVAAGCPGCLSYVFVAKNNPKCPRCHSFVPLPAMKKPKIDLNISM

SEQ ID NO: 2304 - DNA, 738 bp, Populus balsamifera subsp. trichocarpa
  misc_feature (1)..(738): Ceres ANNOT ID no. 1451138
  misc_feature 258873:<222: Transcription Factor
  misc_feature: Phenotype: ROSETTE LEAVES - Curled 3 Useful for making ornamental plants with altered leaf shape
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggcagctgaggtgagttctctggtaaggcttttgagtggatacacggatgataggaacgttgtgagtgaacctggaggggcaaaatcaacaactttgatcactagggacttgcttggcggcggcggcggcggcggtgattctgtagagagcgaatctcaagaattggacctcgatttgcaagtgccaagtgggtgggaaaagcgcctagacttgaagtcaggaaaggtttacttgcaaagatgcaactcttcaagctcaccctcatcatcctcagattacaggaaccaaacaaatcaaacagtggcaaagcttcaagatttgaattttccaccttcgccttccaagattacactgaaccttttcgatgaaggtaacttggaactgaacttcgtctcatcaccaatgtcaagcaattaccaaagtgtttgcactctggatagagtaaaatccgcgcttgaaagagcagagaaagaaccgggcaggaagcaatcctcttcgctatggaaatcatcatcgtcgccgccttattcatcatcatcgtcttcagtgagagacattcaagaggaagaaaatgaagagaagctactagaggcatccccggttgcggcaggatgccccggttgcttatcctacgttttaataacgaagattaatccaagatgtcctagatgcaattcagttgttctaatgccaacggtgaagaagcctatgattgatcttaacatatcaatttga

SEQ ID NO: 2305 - protein, 245 aa, Populus balsamifera subsp. trichocarpa
  misc_feature (1)..(245): Ceres ANNOT ID no. 1451138
  misc_feature 258938:<222: Transcription Factor
  misc_feature: Phenotype: ROSETTE LEAVES - Curled 3 Useful for making ornamental plants with altered leaf shape
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(245): Functional Homolog of  Ceres CLONE ID no. 109912 at SEQ ID NO. 2347 with e-value of 1.90E-55 and BLAST sequence identity of 62.7
MAAEVSSLVRLLSGYTDDRNVVSEPGGAKSTTLITRDLLGGGGGGGDSVESESQELDLDLQVPSGWEKRLDLKSGKVYLQRCNSSSSPSSSSDYRNQTNQTVAKLQDLNFPPSPSKITLNLFDEGNLELNFVSSPMSSNYQSVCTLDRVKSALERAEKEPGRKQSSSLWKSSSSPPYSSSSSSVRDIQEEENEEKLLEASPVAAGCPGCLSYVLITKINPRCPRCNSVVLMPTVKKPMIDLNISI

SEQ ID NO: 2306 - DNA, 723 bp, Populus balsamifera subsp. trichocarpa
  misc_feature (1)..(723): Ceres ANNOT ID no. 1456780
  misc_feature 259033:<222: Transcription Factor
  misc_feature: Phenotype: ROSETTE LEAVES - Curled 3 Useful for making ornamental plants with altered leaf shape
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggcagctgaggtgagttctctggtaaggctttttagtggatacaaggatgacaggaatgccgggagtgaacccggtggagcaaaatcaacagctttgatcaccagggacttgcttggtggtgctactttagagactgaatctctagaattggaccttgatttgcaagtgccaagtggctgggaaaaacggttggacttgaagtcaggaaaggtttacttgcaaagatgcaacccctcaaattcaccctcatcatcctcagattacaggcaccaaaccaatcaaacagtggcgaagcttcaagatttaaatttcccgccttcgccctccaagacgacattaaacctttttgatgaaggtaacttggaactgaagttagtcgcatcaccatcgtcaagcagttaccgtagtgtttgcactctagatagtgtaaaatcggcactcgaaagagctgagagagaactaggaaggaagcgatccgcatcgctatggaaatcatcaatgtcacctccgtattcatcatcatcatcctgtataagagaaattcaagaggggggaaatgatgagaagctaggagcaccatccccagctgcggcaggatgtcccggttgcttatcgtacgtgttgataatgaaaaacaatccaaaatgtcctagatgcaattcagctgttcccatgccaatggtgaagaagcctaggatcgatctcaacatatcaatttga

SEQ ID NO: 2307 - protein, 240 aa, Populus balsamifera subsp. trichocarpa
  misc_feature (1)..(240): Ceres ANNOT ID no. 1456780
  misc_feature 259098:<222: Transcription Factor
  misc_feature: Phenotype: ROSETTE LEAVES - Curled 3 Useful for making ornamental plants with altered leaf shape
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(240): Functional Homolog of  Ceres CLONE ID no. 109912 at SEQ ID NO. 2347 with e-value of 3.19E-53 and BLAST sequence identity of 63.2
MAAEVSSLVRLFSGYKDDRNAGSEPGGAKSTALITRDLLGGATLETESLELDLDLQVPSGWEKRLDLKSGKVYLQRCNPSNSPSSSSDYRHQTNQTVAKLQDLNFPPSPSKTTLNLFDEGNLELKLVASPSSSSYRSVCTLDSVKSALERAERELGRKRSASLWKSSMSPPYSSSSSCIREIQEGGNDEKLGAPSPAAAGCPGCLSYVLIMKNNPKCPRCNSAVPMPMVKKPRIDLNISI

SEQ ID NO: 2308 - protein, 299 aa, Arabidopsis thaliana
  misc_feature (1)..(299): Ceres CLONE ID no. 110247
  misc_feature (243)..(281): Pfam Name: zf-C3HC4 Pfam Description: Zinc finger, C3HC4 type (RING finger)
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
  misc_feature: Phenotype: SILIQUES - Short Useful for increasing seed/fruit yield or modifying fruit content
MGNVISGGSRPENHRDRTSPPYPNPNAQYQGNYPSPYQDCARYPYGEMASPVQYVEHQEAVTIRNDINLKKETLRLEPDEQNPGKFLLSFTFDASVPGSITVMFFAKEGKDCNLIATKEDLFPSTQVSFAKGLEQRFKQACGTGIDFSDMSEADLVEANETDVYHVAVKAEVVSEDDHPESGTPNRQITHVVLEKDHKGEYKARVVKQILWVNGNRYVLQEIYGIGNTVDDNGEDANERGKECVICLSEPRDTTVLPCRHMCMCSGCAKLLRFQTNLCPICRQPVDRLLEITVNNNDRN

SEQ ID NO: 2309 - DNA, 1098 bp, Populus balsamifera subsp. trichocarpa; identical to SEQ ID NO: 1792
  misc_feature (1)..(1098): Ceres ANNOT ID no. 1528846
  misc_feature 259292:<222: Transcription Factor
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
  misc_feature: Phenotype: SILIQUES - Short Useful for increasing seed/fruit yield or modifying fruit content

SEQ ID NO: 2310 - protein, 365 aa, Populus balsamifera subsp. trichocarpa; identical to SEQ ID NO: 1793
  misc_feature (1)..(365): Ceres ANNOT ID no. 1528846
  misc_feature (309)..(347): Pfam Name: zf-C3HC4 Pfam Description: Zinc finger, C3HC4 type (RING finger)
  misc_feature: SWISSPROT Homolog: CGRF1_HUMAN Cell growth regulator with RING finger domain 1 (Cell growth regulatory gene 19 protein) with e-value of 1.4e-06 and BLAST sequence identity of 38.0
  misc_feature: SWISSPROT Homolog: IAP1_NPVAC Apoptosis inhibitor 1 (IAP-1) with e-value of 2.9e-06 and BLAST sequence identity of 37.3
  misc_feature 259391:<222: Transcription Factor
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
  misc_feature: Phenotype: SILIQUES - Short Useful for increasing seed/fruit yield or modifying fruit content
  misc_feature (1)..(365): Functional Homolog of  Ceres CLONE ID no. 110247 at SEQ ID NO. 2352 with e-value of 1.60E-85 and BLAST sequence identity of 63.9

SEQ ID NO: 2311 - DNA, 1296 bp, Populus balsamifera subsp. trichocarpa; identical to SEQ ID NO: 1794
  misc_feature (1)..(1296): Ceres ANNOT ID no. 1538329
  misc_feature 259507:<222: Transcription Factor
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
  misc_feature: Phenotype: SILIQUES - Short Useful for increasing seed/fruit yield or modifying fruit content

SEQ ID NO: 2312 - protein, 431 aa, Populus balsamifera subsp. trichocarpa; identical to SEQ ID NO: 1795
  misc_feature (1)..(431): Ceres ANNOT ID no. 1538329
  misc_feature (375)..(413): Pfam Name: zf-C3HC4 Pfam Description: Zinc finger, C3HC4 type (RING finger)
  misc_feature: SWISSPROT Homolog: CGRF1_HUMAN Cell growth regulator with RING finger domain 1 (Cell growth regulatory gene 19 protein) with e-value of 1.4e-06 and BLAST sequence identity of 38.0
  misc_feature: SWISSPROT Homolog: IAP1_NPVAC Apoptosis inhibitor 1 (IAP-1) with e-value of 2.9e-06 and BLAST sequence identity of 37.3
  misc_feature 259612:<222: Transcription Factor
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
  misc_feature: Phenotype: SILIQUES - Short Useful for increasing seed/fruit yield or modifying fruit content
  misc_feature (1)..(431): Functional Homolog of  Ceres CLONE ID no. 110247 at SEQ ID NO. 2352 with e-value of 7.10E-72 and BLAST sequence identity of 64.2

SEQ ID NO: 2313 - protein, 349 aa, Arabidopsis thaliana
  misc_feature (1)..(349): Ceres CLONE ID no. 110454
  misc_feature (232)..(267): Pfam Name: GATA Pfam Description: GATA zinc finger
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: ROSETTE LEAVES - Oval Shaped Useful for making plants with increased biomass and foliage
MDSNFHYSIDLNEDQNHHEQPFFYPLGSSSSLHHHHHHHHHQVPSNSSSSSSSISSLSSYLPFLINSQEDQHVAYNNTYHADHLHLSQPLKAKMFVANGGSSSCDHMVPKKETRLKLTIRKKDHEDQPHPLHQNPTKPDSDSDKWLMSPKMRLIKKTITNNKQLTDQTNNNNHKESDHYPLNHKTNFDEDHHEDLNFKNVLTRKTTAATTENRYNTINENGYSNNNGVIRVCSDCNTTKTPLWRSGPRGPKSLCNACGIRQRKARRAAMAAAAAAGDQEVAVAPRVQQLPLKKKLQNKKKEIKRRGKIQSLSSNGGQGQKVQDQRGRGEGNGSGNGCRRFRDQQIYNFF

SEQ ID NO: 2314 - protein, 443 aa, Arabidopsis thaliana
  misc_feature (1)..(443): Ceres CLONE ID no. 111209
  misc_feature (70)..(441): Pfam Name: Suc_Fer-like Pfam Description: Sucrase/ferredoxin-like
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
MGSGRDRDDPLSFTSNPSTASSPVTVSDYLDNFLGEPTSRSGSFQSESLLGGGGGESINDADFGFARPDFRSEQLAGTVQFYERHVFLCYKKPSVWPARIEAAEFDRLPRLLSAAVSARKGSMKKETRLTICEGHDGTETSNGDVLIFPDMIRYRRLTHFDVETFVEEVLVKDGEWLPGNPELLKGSYVFVCSHGSRDRRCGVCGPSLVSRFREELEFHGLQGKVSISPCSHIGGHKYAGNVIIYRSNINREVTGHWYGYVTPEDVPILLEQHINKGEIVDRLWRGEMGLSEEDQKKTQEGRFQLNGTVHSVKINGKVSQESSVHNADVSCCQSRAAEPNGCCQQNGNSSSCCQDDTTLMLSLGTSEDNQLESENNTEKLTPGRKIAEKTFFRINSDKGSSTRKVCGIPTWLESWEREDTYAALAVVCAAASVAVAYTCYKQL

SEQ ID NO: 2315 - DNA, 1317 bp, Populus balsamifera subsp. trichocarpa
  misc_feature (1)..(1317): Ceres ANNOT ID no. 1494507
  misc_feature 259995:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
atggcaagcaacagagacgactcgctttcatacaccaacaacctctcattaccttgctctccaatcacagcttctgaccttctagagccctattacctccccgacccttcaagctctctctttggcagtgcttccaatagctaccaaaacgactctgttttgctcattgatcctactacgtgcagcggcagtgatgcggagtttgggttctctagacctgatttcagacaaagcccacttgctgggactgtacagttgtatcaccgccacgtcttcttgtgttacaagaacccttctgtttggccagctaggattgaggctgctgagtttgatcgtttgcctaggctgctctccgctgctgtcatggctaggaaaggagatatgaagaacgagacccgcttaacaatatgtgaggggcatgatggaactgagacatcaaatggagatgtgttaatcttcccagatatgatcagatacaggagattgacacattttgatgtcgacacatttgttgaggaagtgcttgtgaaggatggtgaatggttgcctggaactcctgaaaaattaaagggttcttatgtttttgtatgttctcatgggtcccgagatcgtcgctgtggtgtttgtggacctgctttggttagtagattcgaagaggagatagaattacatggtctccaaggtaaagtatccgtcagcccgtgctcacacattggagggcataaatatgcaggaaatgtcattatattgggatcaagtttcaaaggagctgtcactggacactggtacgggtatgtcaccccagatgacatacaaatattactcgagcagcatattgggaagggtgagattgtagaccggctgtggaggggccagatgggtttatcagaagaagaacagattaaatcccacgagcttaggctccaacagaatggcgggactacagaaaacagtaaagagattacacaaagaccggtagacaaatcaaacactagctcgagtaggtctgaagttgtttctacaggctgttgtcagcaaaatggaagttcatcctgttgccaaaaccctgtcttaccagagaaggatgttgtagatgccaatgagaggacagccaaggtgacacctgaaaagaagaagagcaacaacaagaaaccactatcccggatcaacagcagtaagggatcatctgcacggaaggtttgtgctatgccaacatggtttgagagctgggagcgtgatgatacatatgcagctcttgctgttgtttgtgctgtagtgtcagttgccgttgcttacaagtgctacagacagctgtga

SEQ ID NO: 2316 - protein, 438 aa, Populus balsamifera subsp. trichocarpa
  misc_feature (1)..(438): Ceres ANNOT ID no. 1494507
  misc_feature (75)..(436): Pfam Name: Suc_Fer-like Pfam Description: Sucrase/ferredoxin-like
  misc_feature: SWISSPROT Homolog: YMF0_YEAST Hypothetical 36.0 kDa protein in GAL80-PRP39 intergenic region with e-value of 2.5e-12 and BLAST sequence identity of 34.3
  misc_feature: SWISSPROT Homolog: YB01_YEAST Protein YBR151W with e-value of 6.8e-12 and BLAST sequence identity of 36.4
  misc_feature: SWISSPROT Homolog: FER2_CLOPA Ferredoxin, 2Fe-2S (2FeCpFd) with e-value of 6.6e-06 and BLAST sequence identity of 30.7
  misc_feature 260113:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature (1)..(438): Functional Homolog of  Ceres CLONE ID no. 111209 at SEQ ID NO. 2358 with e-value of 2.59E-154 and BLAST sequence identity of 70.4
MASNRDDSLSYTNNLSLPCSPITASDLLEPYYLPDPSSSLFGSASNSYQNDSVLLIDPTTCSGSDAEFGFSRPDFRQSPLAGTVQLYHRHVFLCYKNPSVWPARIEAAEFDRLPRLLSAAVMARKGDMKNETRLTICEGHDGTETSNGDVLIFPDMIRYRRLTHFDVDTFVEEVLVKDGEWLPGTPEKLKGSYVFVCSHGSRDRRCGVCGPALVSRFEEEIELHGLQGKVSVSPCSHIGGHKYAGNVIILGSSFKGAVTGHWYGYVTPDDIQILLEQHIGKGEIVDRLWRGQMGLSEEEQIKSHELRLQQNGGTTENSKEITQRPVDKSNTSSSRSEVVSTGCCQQNGSSSCCQNPVLPEKDVVDANERTAKVTPEKKKSNNKKPLSRINSSKGSSARKVCAMPTWFESWERDDTYAALAVVCAVVSVAVAYKCYRQL

SEQ ID NO: 2317 - protein, 259 aa, Arabidopsis thaliana
  misc_feature (1)..(259): Ceres CLONE ID no. 111598
  misc_feature (2)..(89): Pfam Name: Mov34 Pfam Description: Mov34/MPN/PAD-1 family
MEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRSINPQTIMLGQEPRQTTSNLGHLNKPSIQALIHGLNRHYYSIAINYRKNELEEKMLLNLHKKKWTDGLTLRRFDTHSKTNEQTVQEMLSLAAKYNKAVQEEDELSPEKLAIVNVGRQDAKKHLEEHVSNLMSSNIVQTLGTMLDTVVF

SEQ ID NO: 2318 - DNA, 978 bp, Populus balsamifera subsp. trichocarpa
  misc_feature (1)..(978): Ceres ANNOT ID no. 1539856
  misc_feature 260323:<222: Transcription Factor
atggagagactgcaaagaatgtttgcaggtgcaggaggtgcgttgggccatccaccaccagattctccaacacttgattcctctgagcaggtctacatctcctctcttgccctcctcaaaatgcttaaacacggcagagctggggtaccgatggaagttatgggtttgatgcttggagagtttgtggatgaatatacagttcgcgttgttgatgtattcgccatgccacaaagtggtactggtgtgagtgttgaagctgttgatcatgtgtttcagactaatatgattgacatgcttaaacagactggaaggccggagatggttgtggggtggtaccattcacatcctggatttggctgttggctttccggtgttgatataaatacccagcagagttttgaagctctgaatcaacgtgctgtggcagtggtcgtggatccaatccagagtgttaaaggaaaggtggtaattgatgccttccgtttgattaacccacaaacaatgatgcttggccaagaaccacggcagacaacttccaatcttgggcatctgaataagccatccattcaagcattgatccatggattgaatagacattattactcaatagccattaattacagaaagaatgaacttgaggaaaagatgcttcttaatcttcacaagaagaaatggacagacggtttgacacttaagcggtttgatactcattcaaaaaccaatgagcagactgttcagggcaatgccattagaatgtttgattgccctttgaatgtttgtagtctggaaatgctgaacttagctattaaatacaacaaggctgtgcaagaggaagatgagctgccacctgaaaagctggcaattgcgaacgtgggaaggcaagatgcgaagaaacaccttgaagaacatgtctcaaacttaatgtcttccaacatagttcagacattgggtactatgctcgacacggttgtgttctag

SEQ ID NO: 2319 - protein, 285 aa, Populus balsamifera subsp. trichocarpa
  misc_feature (1)..(285): Ceres ANNOT ID no. 1539856
  misc_feature (1)..(99): Pfam Name: Mov34 Pfam Description: Mov34/MPN/PAD-1 family
  misc_feature: SWISSPROT Homolog: PSDE_ARATH 26S proteasome non-ATPase regulatory subunit 14 (26S proteasome regulatory subunit rpn11) with e-value of 2.4e-136 and BLAST sequence identity of 100.0
  misc_feature: SWISSPROT Homolog: PSDE_HUMAN 26S proteasome non-ATPase regulatory subunit 14 with e-value of 1.3e-112 and BLAST sequence identity of 81.9
  misc_feature: SWISSPROT Homolog: PSDE_HUMAN A 26S proteasome regulatory subunit rpn11) ( A 26S proteasome-associated PAD1 homolog 1)
  misc_feature: SWISSPROT Homolog: PSDE_MOUSE 26S proteasome non-ATPase regulatory subunit 14 (26S proteasome regulatory subunit rpn11) (MAD1) with e-value of 1.3e-112 and BLAST sequence identity of 81.9
  misc_feature: SWISSPROT Homolog: PSDE_DROME 26S proteasome non-ATPase regulatory subunit 14 with e-value of 1.1e-110 and BLAST sequence identity of 78.8
  misc_feature: SWISSPROT Homolog: PSDE_DROME A 26S proteasome regulatory subunit rpn11 ( A 26S proteasome regulatory complex subunit p37B) ( Yippee-interacting protein 5)
  misc_feature: SWISSPROT Homolog: RPN11_SCHPO 26S proteasome regulatory subunit rpn11 (Protein pad1) with e-value of 7.8e-99 and BLAST sequence identity of 72.6
  misc_feature 260436:<222: Transcription Factor
  misc_feature (1)..(285): Functional Homolog of  Ceres CLONE ID no. 111598 at SEQ ID NO. 2361 with e-value of 5.39E-129 and BLAST sequence identity of 96.9
MLKHGRAGVPMEVMGLMLGEFVDEYTVRVVDVFAMPQSGTGVSVEAVDHVFQTNMIDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLKRFDTHSKTNEQTVQGNAIRMFDCPLNVCSLEMLNLAIKYNKAVQEEDELPPEKLAIANVGRQDAKKHLEEHVSNLMSSNIVQTLGTMLDTVVF

SEQ ID NO: 2320 - DNA, 990 bp, Populus balsamifera subsp. trichocarpa
  misc_feature (1)..(990): Ceres ANNOT ID no. 1443875
  misc_feature 260516:<222: Transcription Factor
atggagagactgcaaagaatgtttgcaggtgcaggaggcgcgctgggtcatccaccaccagattctcccactctcgattcctccgagcaggtctacatctcctctcttgccctcctcaaaatgcttaagcacgggagagctggggtaccgatggaggtgatgggtttgatgcttggagagtttgtggatgaatatacagttcgtgttgtcgatgtattcgcaatgccacaaagtggtactggtgtgagtgttgaagctgttgatcatgtgttccagactaacatgcttgacatgcttaaacagactggaagaccggagatggttgtggggtggtaccattcacatcctggatttggctgttggctctctggtgttgatataaatacccagcagagttttgaagctttgaatcaacgtgctgtggcagtggtggtggatccaattcagagtgttaaaggaaaggtggtaattgatgcctttcgtttgattaacccacaaacaatgatgcttggccaagaaccacggcagacaacttccaatcttgggcatctgaataagccatccattcaagctttgatccatggattgaacagacattactactccatagccattaattacagaaagaatgaacttgaggaaaagatgcttcttaacctgcacaagaagaaatggacagatggtttgacacttaggcgcatagtgttccattactcatcctccaacattagaacaattgcatcccgagaaacaggctggggatggggctctaattctgacaggttagctgaatctctggaaatgctgagcttagctattaaatacaacaaggcagtgcaagaggaagatgagctgccacctgaaaagctggcaattgcaaatgtaggaaggcaagatgcgaagaaacaccttgaagaacatgtctcaaatttgatgtcctccaacatagttcagacattgggcactatgcttgacactgttgtgttttag

SEQ ID NO: 2321 - protein, 289 aa, Populus balsamifera subsp. trichocarpa
  misc_feature (1)..(289): Ceres ANNOT ID no. 1443875
  misc_feature (1)..(99): Pfam Name: Mov34 Pfam Description: Mov34/MPN/PAD-1 family
  misc_feature: SWISSPROT Homolog: PSDE_ARATH 26S proteasome non-ATPase regulatory subunit 14 (26S proteasome regulatory subunit rpn11) with e-value of 2.4e-136 and BLAST sequence identity of 100.0
  misc_feature: SWISSPROT Homolog: PSDE_HUMAN 26S proteasome non-ATPase regulatory subunit 14 with e-value of 1.3e-112 and BLAST sequence identity of 81.9
  misc_feature: SWISSPROT Homolog: PSDE_HUMAN A 26S proteasome regulatory subunit rpn11) ( A 26S proteasome-associated PAD1 homolog 1)
  misc_feature: SWISSPROT Homolog: PSDE_MOUSE 26S proteasome non-ATPase regulatory subunit 14 (26S proteasome regulatory subunit rpn11) (MAD1) with e-value of 1.3e-112 and BLAST sequence identity of 81.9
  misc_feature: SWISSPROT Homolog: PSDE_DROME 26S proteasome non-ATPase regulatory subunit 14 with e-value of 1.1e-110 and BLAST sequence identity of 78.8
  misc_feature: SWISSPROT Homolog: PSDE_DROME A 26S proteasome regulatory subunit rpn11 ( A 26S proteasome regulatory complex subunit p37B) ( Yippee-interacting protein 5)
  misc_feature: SWISSPROT Homolog: RPN11_SCHPO 26S proteasome regulatory subunit rpn11 (Protein pad1) with e-value of 7.8e-99 and BLAST sequence identity of 72.6
  misc_feature 260629:<222: Transcription Factor
  misc_feature (1)..(289): Functional Homolog of  Ceres CLONE ID no. 111598 at SEQ ID NO. 2361 with e-value of 5.99E-123 and BLAST sequence identity of 94.5
MLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRIVFHYSSSNIRTIASRETGWGWGSNSDRLAESLEMLSLAIKYNKAVQEEDELPPEKLAIANVGRQDAKKHLEEHVSNLMSSNIVQTLGTMLDTVVF

SEQ ID NO: 2322 - protein, 253 aa, Arabidopsis thaliana
  misc_feature (1)..(253): Ceres CLONE ID no. 111694
  misc_feature (20)..(122): Pfam Name: BTB Pfam Description: BTB/POZ domain
  misc_feature: Utility: ABA Useful for making plants with enhanced tolerance to drought
  misc_feature: Phenotype: WHOLE PLANT - ABA Useful for making plants with enhanced tolerance to drought
MAITATQNDGVSLNANKISYDLVETDVEIITSGRRSIPAHSGILASVSPVLTNIIEKPRKIHGGSSKKVIKILGVPCDAVSVFVRFLYSPSVTENEMEKYGIHLLALSHVYMVTQLKQRCTKGVGERVTAENVVDILQLARLCDAPDLCLKCMRFIHYKFKTVEQTEGWKFLQEHDPFLELDILQFIDDAESRKKRRRRHRREQNLYLQLSEAMECIEHICTEGCTLVGPSSNLDNKSTCQAKPGPCSAFSTC

SEQ ID NO: 2323 - DNA, 1095 bp, Populus balsamifera subsp. trichocarpa
  misc_feature (1)..(1095): Ceres ANNOT ID no. 1468539
  misc_feature: Utility: ABA Useful for making plants with enhanced tolerance to drought
  misc_feature 260800:<222: Transcription Factor
  misc_feature: Phenotype: WHOLE PLANT - ABA Useful for making plants with enhanced tolerance to drought
atggaggaaactcataacaccgcaaccgctgccacccctaccatctccggcgagctcatgagcagtgattttcaattctcctatcagaattcattgcctaaaccagacgtccaaatcctcacttccaatggcctccgcatcccggctcacactggcattctcgcatcggtgtcaccggtactggaaaatatcatagacaggccacataaacaccatagctccgagaagatcatccctatcctcggtgttccatgcgacgccgtttccctattcattcaattcctctactcctcaaggtgcagcgaggaggagttggagaagtatggaatccatctactggcgttgtcacacgtgtacttggtcccacagttgaagcacatgtgttcaaaggctgttggtcaacgtttgaccgtcgagaatgtggtggatgtactccaattggctaggctctgcgattcgccggatctttatgtcaagtgcatgaagatgttgtctgataatttcaaggccgtagaaaaaacagaagggtggaagttcatgcaggagaacgacccttttcttgagctcgagattctcagattcattgacgaagctgaatcgaggaagaagagaacaaggaggcacagagaggagcagagattgttcatggagctaagtgaagcaatggagtgcttagagcacatttgcacagaagggtgcacaaccgtcggtccatgtgacctgggacctagcaataaacgtcggggtccgtgcaacaagttctccacatgcgaaggtcttcagctcttgatcaagcacttcaccatgtgcaagaatcgggttaatggaaaatgctcaaggtgtaagcggatggggcagctcttaagactacactcatcaatctgtgaccaaactgattcttgcagggttccactttgcaggcaattcaaactgaaaatgcaacgagagagaagaggagatgaaaccctgtggagcttattggtgaagaaggttgcgtctgcgagggtcatgtcttctctatctctccccaagaggaaaagagaagaaccgagggagacaatacatgatcatggtattagaaacttcagaaagtag

SEQ ID NO: 2324 - protein, 364 aa, Populus balsamifera subsp. trichocarpa
  misc_feature (1)..(364): Ceres ANNOT ID no. 1468539
  misc_feature (139)..(168): Pfam Name: BTB Pfam Description: BTB/POZ domain
  misc_feature (203)..(306): Pfam Name: zf-TAZ Pfam Description: TAZ zinc finger
  misc_feature: SWISSPROT Homolog: SPOP_HUMAN Speckle-type POZ protein with e-value of 1.4e-08 and BLAST sequence identity of 27.5
  misc_feature: SWISSPROT Homolog: SPOP_MOUSE Speckle-type POZ protein (PDX-1 C-terminal-interacting factor 1) (PCIF1) with e-value of 1.4e-08 and BLAST sequence identity of 27.5
  misc_feature: SWISSPROT Homolog: YLJ8_CAEEL Hypothetical protein C50C3.8 in chromosome III with e-value of 3.8e-08 and BLAST sequence identity of 27.4
  misc_feature: SWISSPROT Homolog: KLHL7_MOUSE Kelch-like protein 7 with e-value of 2.4e-06 and BLAST sequence identity of 29.1
  misc_feature: SWISSPROT Homolog: KLHL7_CHICK Kelch-like protein 7 with e-value of 3.1e-06 and BLAST sequence identity of 29.1
  misc_feature: Utility: ABA Useful for making plants with enhanced tolerance to drought
  misc_feature 260917:<222: Transcription Factor
  misc_feature: Phenotype: WHOLE PLANT - ABA Useful for making plants with enhanced tolerance to drought
  misc_feature (1)..(364): Functional Homolog of  Ceres CLONE ID no. 111694 at SEQ ID NO. 2366 with e-value of 2.60E-81 and BLAST sequence identity of 65.3
MEETHNTATAATPTISGELMSSDFQFSYQNSLPKPDVQILTSNGLRIPAHTGILASVSPVLENIIDRPHKHHSSEKIIPILGVPCDAVSLFIQFLYSSRCSEEELEKYGIHLLALSHVYLVPQLKHMCSKAVGQRLTVENVVDVLQLARLCDSPDLYVKCMKMLSDNFKAVEKTEGWKFMQENDPFLELEILRFIDEAESRKKRTRRHREEQRLFMELSEAMECLEHICTEGCTTVGPCDLGPSNKRRGPCNKFSTCEGLQLLIKHFTMCKNRVNGKCSRCKRMGQLLRLHSSICDQTDSCRVPLCRQFKLKMQRERRGDETLWSLLVKKVASARVMSSLSLPKRKREEPRETIHDHGIRNFRK

SEQ ID NO: 2325 - DNA, 1083 bp, Populus balsamifera subsp. trichocarpa
  misc_feature (1)..(1083): Ceres ANNOT ID no. 1527153
  misc_feature: Utility: ABA Useful for making plants with enhanced tolerance to drought
  misc_feature 261025:<222: Transcription Factor
  misc_feature: Phenotype: WHOLE PLANT - ABA Useful for making plants with enhanced tolerance to drought
atggaggaatttaacagcaccgccttccccaccatctccggcgacctcatgagcgatcatttccagttctccgatcaagattcattgccaaaacccgacgtcgaaatcctcacttccaatggcctccgcatcccggctcacactggcattctggccttggtgtcaccggtgctggagaatgtcatagaaaggcctcctaaacaccgtagctccgagaaaaccattcctatccatggcgttccatgcgaagctgtttctgctttcattcaattcctttactcctcaaggtgtagcgaggaggagttggagaagtacgggatccatcttctggcattgtcacacgtttacttggtcccacaattgaagcacagatgttcaaaagctgttgggcaacggttgaccattgagaatgtggtggatgtgcttcaattggctaggctctgtgattcaccggatctttatctcaagtgcatgaggatgttgtctagtaatttcaaggctgtagagaaaacagaagggtggaagttcatgcacgagaatgacccttttctcgagcttgagattctccaattcattgatgaagctgaatctaggaagatgagagcaaggaggcatagagaggagcagagattgtacatggagctaagtgaagcaatggagtgcttagagcacatatgcacagaagggtgcacaactgtcggtccatgtgacttggaacctagcaagaaacgggatccgtgtgacaagttctccatatgtgaaggtctccagcttttgatcaagcactttgccatttgtaagaatcgggttaatggaaaatgctcaaggtgtaaacggatgtggcagctcttaagacttcactcatcaatctgtgaccaaactgattcttgcagggttccactttgcaggcaatttaaattgaaaatgcaactagagaaaaaaggagttgaaacgctgtggagattactggtgaagaaggttgcgtctgccagggccatgtcttctctttctctccccaagaggaaaagagaagaaccaagggagaccatgcatgatcatggtattaggaacttcagactataa

SEQ ID NO: 2326 - protein, 344 aa, Populus balsamifera subsp. trichocarpa
  misc_feature (1)..(344): Ceres ANNOT ID no. 1527153
  misc_feature (10)..(117): Pfam Name: BTB Pfam Description: BTB/POZ domain
  misc_feature (224)..(286): Pfam Name: zf-TAZ Pfam Description: TAZ zinc finger
  misc_feature: SWISSPROT Homolog: SPOP_HUMAN Speckle-type POZ protein with e-value of 1.4e-08 and BLAST sequence identity of 27.5
  misc_feature: SWISSPROT Homolog: SPOP_MOUSE Speckle-type POZ protein (PDX-1 C-terminal-interacting factor 1) (PCIF1) with e-value of 1.4e-08 and BLAST sequence identity of 27.5
  misc_feature: SWISSPROT Homolog: YLJ8_CAEEL Hypothetical protein C50C3.8 in chromosome III with e-value of 3.8e-08 and BLAST sequence identity of 27.4
  misc_feature: SWISSPROT Homolog: KLHL7_MOUSE Kelch-like protein 7 with e-value of 2.4e-06 and BLAST sequence identity of 29.1
  misc_feature: SWISSPROT Homolog: KLHL7_CHICK Kelch-like protein 7 with e-value of 3.1e-06 and BLAST sequence identity of 29.1
  misc_feature: Utility: ABA Useful for making plants with enhanced tolerance to drought
  misc_feature 261142:<222: Transcription Factor
  misc_feature: Phenotype: WHOLE PLANT - ABA Useful for making plants with enhanced tolerance to drought
  misc_feature (1)..(344): Functional Homolog of  Ceres CLONE ID no. 111694 at SEQ ID NO. 2366 with e-value of 2.39E-78 and BLAST sequence identity of 68.4
MSDHFQFSDQDSLPKPDVEILTSNGLRIPAHTGILALVSPVLENVIERPPKHRSSEKTIPIHGVPCEAVSAFIQFLYSSRCSEEELEKYGIHLLALSHVYLVPQLKHRCSKAVGQRLTIENVVDVLQLARLCDSPDLYLKCMRMLSSNFKAVEKTEGWKFMHENDPFLELEILQFIDEAESRKMRARRHREEQRLYMELSEAMECLEHICTEGCTTVGPCDLEPSKKRDPCDKFSICEGLQLLIKHFAICKNRVNGKCSRCKRMWQLLRLHSSICDQTDSCRVPLCRQFKLKMQLEKKGVETLWRLLVKKVASARAMSSLSLPKRKREEPRETMHDHGIRNFRL

SEQ ID NO: 2327 - protein, 308 aa, Arabidopsis thaliana
  misc_feature (1)..(308): Ceres CLONE ID no. 112288
  misc_feature (99)..(249): Pfam Name: PAP2 Pfam Description: PAP2 superfamily
  misc_feature: Phenotype: INFLORESCENCE - Late Flowering Useful for modulating flowering time
MAKIMLGSHSVKSHGWKVAREHLCDWLILVVLGLIDIVLNVIEPFHRYIGPDMLTDLTFPFYEDTIPMWAVPIICILVPICIFIVYYYYRRDVYDLHHAILGIGFSCLVTGVTTDSIKDAVGRPRPNFFYRCFPNGKPKFHPDTKDVVCHGVKKIIKEGYKSFPSGHTSWSFAGLTFLAWYLSGKIKVFDRRGHVAKLCLVFLPILISILIGISRVDDYWHHWTDVFAGAIIGIFVASFSYLHFFPYPYDENGWAPHAYFRMLAERSTGRATTMTRTGSRGMLDNDVEPGNSASSPHDRHRESTDSDF

SEQ ID NO: 2328 - DNA, 933 bp, Populus balsamifera subsp. trichocarpa
  misc_feature (1)..(933): Ceres ANNOT ID no. 1517215
  misc_feature 261329:<222: Transcription Factor
  misc_feature: Phenotype: INFLORESCENCE - Late Flowering Useful for modulating flowering time
atgccggatatccagttgggtgctcacactgtaaaatcccatggaatccaaattgcgaggacacatatgcatgactggttaattctattgcttctcgtggttattgaggtcgttttgaacgttatagaaccatttcaccgctttgttggaaaggatatgctgacagacctgtcatacccactgcaggacaatactgttcctatttgggctgttccaattgttgcaatattgctgcccatggctatcattctcgtgtattatttcataagaaggaatgtctacgatatgcaccatgccattctgggccttctgttttctgtgcttatcactggagttataactgatgcaattaaagatgctgttggtcgacctcgtccagacttcttttggcgatgtttccctgatggaaaaggggtgtttcaccctgtcacaagcgatgttatgtgtactggagtgaagagtgtcatcaaggaaggtcataaaagcttcccaagtggacatacttcttgtcttgggttcctggccttgtacttgtctgggaaagtcagagtgtttgaccgcaggggccatgttgcaaagctttgtattgttttccttccattgcttgttgctgctttggtagcagtttctcgggttgatgactactggcatcattggcaagatgtatttgctggggcccttatagggctaacagttgcttcattttgctacttgcaattcttcccacccccatatgatgtcgatggctggggacctcacgcatatttccagatgttggcagagtctcgaaatggagctgagtcatccaataacatcaactgtttcaacgtgcagcaatcagaacttgagagtgtatatattgattctcaacatggaactgaaacttcaagagtcaatactcgggacactaggccaatgctggagggagcatag

SEQ ID NO: 2329 - protein, 310 aa, Populus balsamifera subsp. trichocarpa
  misc_feature (1)..(310): Ceres ANNOT ID no. 1517215
  misc_feature (99)..(245): Pfam Name: PAP2 Pfam Description: PAP2 superfamily
  misc_feature: SWISSPROT Homolog: LPP2_ARATH Lipid phosphate phosphatase 2 (EC 3.1.3.-) (AtLPP2) with e-value of 3.5e-103 and BLAST sequence identity of 66.8
  misc_feature: SWISSPROT Homolog: LPP2_ARATH Phosphatidic acid phosphatase 2 (AtPAP2) Prenyl diphosphate phosphatase
  misc_feature: SWISSPROT Homolog: LPP3_ARATH Putative lipid phosphate phosphatase 3, with e-value of 1.4e-92 and BLAST sequence identity of 58.1
  misc_feature: SWISSPROT Homolog: LPP3_ARATH EC 3.1.3.- (AtLPP3) (Phosphatidic acid phosphatase 3) ( Phosphatidate phosphohydrolase 3)
  misc_feature: SWISSPROT Homolog: LPP1_ARATH Lipid phosphate phosphatase 1 (EC 3.1.3.-) (AtLPP1) with e-value of 1.8e-92 and BLAST sequence identity of 59.0
  misc_feature: SWISSPROT Homolog: LPP1_ARATH Phosphatidic acid phosphatase 1 (AtPAP1) Prenyl diphosphate phosphatase
  misc_feature: SWISSPROT Homolog: DPP1_YEAST Diacylglycerol pyrophosphate phosphatase 1 (EC 3.1.3.-) (DGPP phosphatase) (Phosphatidate phosphatase) (EC 3.1.3.4) with e-value of 2.8e-23 and BLAST sequence identity of 31.2
  misc_feature: SWISSPROT Homolog: LPP1_RAT Lipid phosphate phosphohydrolase 1 with e-value of 6.9e-20 and BLAST sequence identity of 32.9
  misc_feature: SWISSPROT Homolog: LPP1_RAT EC 3.1.3.4 (Phosphatidic acid phosphatase 2a) Phosphatidate phosphohydrolase type 2a (PAP2a) PAP-2a (PAP2-alpha)
  misc_feature 261461:<222: Transcription Factor
  misc_feature: Phenotype: INFLORESCENCE - Late Flowering Useful for modulating flowering time
  misc_feature (1)..(310): Functional Homolog of  Ceres CLONE ID no. 112288 at SEQ ID NO. 2371 with e-value of 2.70E-104 and BLAST sequence identity of 68.3
MPDIQLGAHTVKSHGIQIARTHMHDWLILLLLVVIEVVLNVIEPFHRFVGKDMLTDLSYPLQDNTVPIWAVPIVAILLPMAIILVYYFIRRNVYDMHHAILGLLFSVLITGVITDAIKDAVGRPRPDFFWRCFPDGKGVFHPVTSDVMCTGVKSVIKEGHKSFPSGHTSCLGFLALYLSGKVRVFDRRGHVAKLCIVFLPLLVAALVAVSRVDDYWHHWQDVFAGALIGLTVASFCYLQFFPPPYDVDGWGPHAYFQMLAESRNGAESSNNINCFNVQQSELESVYIDSQHGTETSRVNTRDTRPMLEGA

SEQ ID NO: 2330 - protein, 221 aa, Arabidopsis thaliana
  misc_feature (1)..(221): Ceres CLONE ID no. 112955
  misc_feature (92)..(180): Pfam Name: Cellulose_synt Pfam Description: Cellulose synthase
  misc_feature: Phenotype: FLOWER - Large Useful for making ornamental plants with modified flowers
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
  misc_feature: Phenotype: SILIQUES - Short Useful for increasing seed/fruit yield or modifying fruit content
  misc_feature: Phenotype: FLOWER - Other Useful for making ornamental plants with modified flowers
  misc_feature: Phenotype: INFLORESCENCE - Other Useful for making ornamental plants with modified flowers
  misc_feature (213)..(213): Xaa is any aa, unknown, or other
MEPQRKHSTALHTCHPCRRTIPYRIYAVFHLCGIIALMYHHVHSLVNANNTLITCLLLLSDIVLAFMWATTTSLRLNPVHRTEYPEKYAAKPEDFPKLDVFICTADPYKEPPMMVVNTALSVMAYEYPSHKISVYVSDDGGSSLTLFALMEAAKFSKHWLPFCKNNNVQDRSPEVYFSSKSHSWSDEAENLKMMYEDMKSRVEHVVESGKVEXCVYCMRSI

SEQ ID NO: 2331 - DNA, 663 bp, Populus balsamifera subsp. trichocarpa
  misc_feature (1)..(663): Ceres ANNOT ID no. 1447634
  misc_feature 261664:<222: Transcription Factor
  misc_feature: Phenotype: FLOWER - Large Useful for making ornamental plants with modified flowers
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
  misc_feature: Phenotype: SILIQUES - Short Useful for increasing seed/fruit yield or modifying fruit content
  misc_feature: Phenotype: FLOWER - Other Useful for making ornamental plants with modified flowers
  misc_feature: Phenotype: INFLORESCENCE - Other Useful for making ornamental plants with modified flowers
atggagggtcgaccaaaagaatccggcactaaaaaagcctctaccggtggaggtcctcctcctcttcacacggttaagcccatgggaataacaattttcaaccgcctgtttgccacagtttatgctcttgccattttagctctattctatcaccatacaaaaaaactgctgtgctccccaaccttagtctccttctctataaacctcgccttgtcactctccgactttgtccttactttcatgtggatcagcacgcagacttttcgcatgtgtccagtctatcgtaagcaattccctgaaaatgttgaaaaagtcgtgaaaagaagtgattttccagctttagacgtgttcatatgcactgctgatccatacaaggagccaccaataggtgtagtgaatacggctttatcagtgatggcttatgactatccaacagagaagatttcagtctatgtatctgatgatggaggctcagccttgactcttttttctttcatggaggctgctaagttttctacccactggctaccattttgcaagaagaataatatactagtgaggagccctgaggcatattttgaatccagtcatccttgcacctctgagactgagaagattgaggctaagatatggaaattaaaattgagtacttttaaaagatga

SEQ ID NO: 2332 - protein, 220 aa, Populus balsamifera subsp. trichocarpa
  misc_feature (1)..(220): Ceres ANNOT ID no. 1447634
  misc_feature (108)..(194): Pfam Name: Cellulose_synt Pfam Description: Cellulose synthase
  misc_feature: SWISSPROT Homolog: CESAA_ARATH Probable cellulose synthase A catalytic subunit 10 [UDP-forming] (EC 2.4.1.12) (AtCesA-10) (AtCesA-13) with e-value of 8.6e-29 and BLAST sequence identity of 36.4
  misc_feature: SWISSPROT Homolog: CESA1_ARATH Cellulose synthase A catalytic subunit 1[UDP-forming](EC 2.4.1.12) (AtCesA-1) (Radially swollen protein 1) (AtRSW1) with e-value of 3.9e-28 and BLAST sequence identity of 34.5
  misc_feature: SWISSPROT Homolog: CESA2_ARATH Cellulose synthase A catalytic subunit 2 [UDP-forming] EC 2.4.1.12 (AtCesA-2) (Ath-A) with e-value of 4.2e-26 and BLAST sequence identity of 33.2
  misc_feature: SWISSPROT Homolog: CESA9_ARATH Probable cellulose synthase A catalytic subunit 9 [UDP-forming] (EC 2.4.1.12) (AtCesA-9) with e-value of 1.1e-25 and BLAST sequence identity of 33.8
  misc_feature: SWISSPROT Homolog: CESA4_ARATH Cellulose synthase A catalytic subunit 4[UDP-forming](EC 2.4.1.12) (AtCesA-4) (Irregular xylem protein 5) (AtIRX5) with e-value of 1.4e-25 and BLAST sequence identity of 35.0
  misc_feature 261794:<222: Transcription Factor
  misc_feature: Phenotype: FLOWER - Large Useful for making ornamental plants with modified flowers
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
  misc_feature: Phenotype: SILIQUES - Short Useful for increasing seed/fruit yield or modifying fruit content
  misc_feature: Phenotype: FLOWER - Other Useful for making ornamental plants with modified flowers
  misc_feature: Phenotype: INFLORESCENCE - Other Useful for making ornamental plants with modified flowers
  misc_feature (1)..(220): Functional Homolog of  Ceres CLONE ID no. 112955 at SEQ ID NO. 2374 with e-value of 9.70E-52 and BLAST sequence identity of 60.0
MEGRPKESGTKKASTGGGPPPLHTVKPMGITIFNRLFATVYALAILALFYHHTKKLLCSPTLVSFSINLALSLSDFVLTFMWISTQTFRMCPVYRKQFPENVEKVVKRSDFPALDVFICTADPYKEPPIGVVNTALSVMAYDYPTEKISVYVSDDGGSALTLFSFMEAAKFSTHWLPFCKKNNILVRSPEAYFESSHPCTSETEKIEAKIWKLKLSTFKR

SEQ ID NO: 2333 - protein, 359 aa, Arabidopsis thaliana
  misc_feature (1)..(359): Ceres CLONE ID no. 113719
  misc_feature (145)..(264): Pfam Name: BTB Pfam Description: BTB/POZ domain
  misc_feature (4)..(121): Pfam Name: MATH Pfam Description: MATH domain
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: WHOLE PLANT - Other Useful for making bigger plants
  misc_feature: Phenotype: ROSETTE LEAVES - Oval Shaped Useful for making plants with increased biomass and foliage
MGIGKYVTSDTFMVGGYSWAIYFYPDGKSPEDNSVYVSLFIALASEGADVRALFELTLVDQSGNERHKVHSHFGRTLESGPYTLKYRGSMWGYKRFFKRSLLESSDYLKDNGLLVRCCVGVVKSRTEGPRCYNIPVPVSGLGQQFGKLLESGKGADVTFEVDGETFPAHKLVLAARSAVFRAQLFGPLRSENTNCIIIEDVQAPIFKMLLHFIYWDEMPDMQDLIGTDLKWASTLVAQHLLAAADRYALERLRTICESKLCEGISINTVATTLALAEQHHCFQLKATCLKFIALPENLKAVMETDGFDYLKESCPSLLSELLEYVARLSEHSLTSSGHRKELFADGCDLNGRRVKQRLH

SEQ ID NO: 2334 - DNA, 1230 bp, Populus balsamifera subsp. trichocarpa
  misc_feature (1)..(1230): Ceres ANNOT ID no. 1513206
  misc_feature 262028:<222: Transcription Factor
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: WHOLE PLANT - Other Useful for making bigger plants
  misc_feature: Phenotype: ROSETTE LEAVES - Oval Shaped Useful for making plants with increased biomass and foliage
atgggcacaatcaggttttctagcagagacctctcagcaggaccggcctcattaaatccttcatcatcaattccaacaacaacatcgacttctataacggaaaccgtaaatgggtcacatgaattcaaggtcgatggctattcgctatcaaaaggcatggggataggcaaatacgtagcatcggatactttttacatcggtggctatgcatgggctatatatttttacccagatggtaaaagttctgaagataatgcctcttatgtctcgttattcatcgctcttgctagcgaggggactgatgttagggctttgtttgaattgacgttgatggatcaaagcgggaaagaaaggcataaggttcatagccattttggaagagcccttgagagtgggccttatacgcttaagtatcgcggcagtatgtggggttataaacgattttacaaaaggactcaattagagacttcagactttcttaaagatgataccctattaattcgctgttgtgttggtgttgttaagtcccacactgagggaccaaagacctacaccattgccgtgcccccttccaatattggtcagcattttggaaagcttttagacagtggaaagcgaacagatgtaaattttgaagttgatggagaaatctgtgcttcacacaagatagttctggcagcacgctcgccagtgtttagagcacaactttttggtccaatgaaggatcaaaacactcaatgcatcaaagttgaagacatggaagctcctgtttttaaggcattaatccattttatatactgggatgccttaccagacatggaggagcttgttggtttgaactcaaaatgggcttccacactgatggctcagcatctgcttgcagcagcagatcgctatgcacttgagaggctcagattgctttgtgaggctagactttgtgaagatgttgccataaacactgttgcaacaacactagctctagcagagcagcatcaatgcatccaactaaagtctgtttgtctcaaattcattgctttgcctgaaaatttgaaagctgtgatgcagacagatggatttgaatacttgaaggaaagttgcccttctgtcatcacggaactactgcaatatgttgccaaaaatggtgagcattctgtcatcgcttgtacacatggaaatgacaacttagatagcgatatgaatggaagacgagtgaagcaaaggattcattga

SEQ ID NO: 2335 - protein, 357 aa, Populus balsamifera subsp. trichocarpa
  misc_feature (1)..(357): Ceres ANNOT ID no. 1513206
  misc_feature (145)..(264): Pfam Name: BTB Pfam Description: BTB/POZ domain
  misc_feature (4)..(121): Pfam Name: MATH Pfam Description: MATH domain
  misc_feature: SWISSPROT Homolog: SPOP_HUMAN Speckle-type POZ protein with e-value of 2.3e-35 and BLAST sequence identity of 32.4
  misc_feature: SWISSPROT Homolog: SPOP_MOUSE Speckle-type POZ protein (PDX-1 C-terminal-interacting factor 1) (PCIF1) with e-value of 2.3e-35 and BLAST sequence identity of 32.4
  misc_feature: SWISSPROT Homolog: TDPZ2_MOUSE TD and POZ domain-containing protein 2 with e-value of 2.2e-32 and BLAST sequence identity of 31.1
  misc_feature: SWISSPROT Homolog: TDPZ4_MOUSE TD and POZ domain-containing protein 4 with e-value of 9.7e-30 and BLAST sequence identity of 31.7
  misc_feature: SWISSPROT Homolog: YNV5_CAEEL Hypothetical protein T16H12.5 in chromosome III with e-value of 1.3e-27 and BLAST sequence identity of 28.5
  misc_feature 262164:<222: Transcription Factor
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: WHOLE PLANT - Other Useful for making bigger plants
  misc_feature: Phenotype: ROSETTE LEAVES - Oval Shaped Useful for making plants with increased biomass and foliage
  misc_feature (1)..(357): Functional Homolog of  Ceres CLONE ID no. 113719 at SEQ ID NO. 2377 with e-value of 3.59E-148 and BLAST sequence identity of 74.2
MGIGKYVASDTFYIGGYAWAIYFYPDGKSSEDNASYVSLFIALASEGTDVRALFELTLMDQSGKERHKVHSHFGRALESGPYTLKYRGSMWGYKRFYKRTQLETSDFLKDDTLLIRCCVGVVKSHTEGPKTYTIAVPPSNIGQHFGKLLDSGKRTDVNFEVDGEICASHKIVLAARSPVFRAQLFGPMKDQNTQCIKVEDMEAPVFKALIHFIYWDALPDMEELVGLNSKWASTLMAQHLLAAADRYALERLRLLCEARLCEDVAINTVATTLALAEQHQCIQLKSVCLKFIALPENLKAVMQTDGFEYLKESCPSVITELLQYVAKNGEHSVIACTHGNDNLDSDMNGRRVKQRIH

SEQ ID NO: 2336 - DNA, 1233 bp, Populus balsamifera subsp. trichocarpa
  misc_feature (1)..(1233): Ceres ANNOT ID no. 1516003
  misc_feature 262287:<222: Transcription Factor
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: WHOLE PLANT - Other Useful for making bigger plants
  misc_feature: Phenotype: ROSETTE LEAVES - Oval Shaped Useful for making plants with increased biomass and foliage
atgggcacaatcaggttttctagcagagacctcccagcagcacctcccacatcaaacccatcatcatcaattccaacaaaaacaacatcatcttctataacggaaaccgtaaatgggtctcatgaattcaagatcggtggctattctctctcgaaaggcatgggggtaggcaaatacatcgcatcggatactttttatattggtggatatgcatgggctatatatttctacccagatggtaagagccctgaagataatgccacttatgtctccttattcattgcccttgctagcgaggggacggatgttagggctttgtttgaattgtcgttgatggatcaaagtgggaaagaaagacataaggttcatagccattttgggagagcccttgagagcgggccctatacgcttaagtatcgtggcagtatgtggggttataaacgattttatagaaggaatcaattagagacatcagactatcttaaggatgataccctactagttcgctgctgtgttggtgttgttaagtctcacaccgaggggcctaagacctacaccatttccgtgccaccttccaatattggtcagcattttggaaagcttttagacagtggaacgggaactgatgtaaattttgaagttgatggagaaacctttgcttctcacaaaatagttctggctgcacgctcaccagtgtttagagcacagctttttggtccaatgaaagatcaaaacactcaatgcatcaaagttgaagacatggaagctccggtttttaaggcgttaatccattttatgtactgggatgccttaccagacattgaggaacttgttggtttgaactcaaaatgggtttctacactgatggctcagcatctgcttgcagcagcagatcgctatgcacttgagaggctcagattgctctgtgaggctagactttgtgaagatgttgcaataaacaccgttgcaacaacactagctctagcggagcagcatcagtgcatccaactaaagtccgtatgtctcaaattcattgctttgcctgaaaatttgaaagctgtgatgcaaacagatgggtttgaatacttaaaagaaagctgcccttctgtcatcacggagctactgcaatatgttgccaaaaatggtgagcgttctgtcatcacttgtacacttggaaatgacaccttagatagcgatatgaatggaaggcgggtgaagcaaaggatacattga

SEQ ID NO: 2337 - protein, 357 aa, Populus balsamifera subsp. trichocarpa
  misc_feature (1)..(357): Ceres ANNOT ID no. 1516003
  misc_feature (145)..(264): Pfam Name: BTB Pfam Description: BTB/POZ domain
  misc_feature (9)..(121): Pfam Name: MATH Pfam Description: MATH domain
  misc_feature: SWISSPROT Homolog: SPOP_HUMAN Speckle-type POZ protein with e-value of 2.3e-35 and BLAST sequence identity of 32.4
  misc_feature: SWISSPROT Homolog: SPOP_MOUSE Speckle-type POZ protein (PDX-1 C-terminal-interacting factor 1) (PCIF1) with e-value of 2.3e-35 and BLAST sequence identity of 32.4
  misc_feature: SWISSPROT Homolog: TDPZ2_MOUSE TD and POZ domain-containing protein 2 with e-value of 2.2e-32 and BLAST sequence identity of 31.1
  misc_feature: SWISSPROT Homolog: TDPZ4_MOUSE TD and POZ domain-containing protein 4 with e-value of 9.7e-30 and BLAST sequence identity of 31.7
  misc_feature: SWISSPROT Homolog: YNV5_CAEEL Hypothetical protein T16H12.5 in chromosome III with e-value of 1.3e-27 and BLAST sequence identity of 28.5
  misc_feature 262423:<222: Transcription Factor
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: WHOLE PLANT - Other Useful for making bigger plants
  misc_feature: Phenotype: ROSETTE LEAVES - Oval Shaped Useful for making plants with increased biomass and foliage
  misc_feature (1)..(357): Functional Homolog of  Ceres CLONE ID no. 113719 at SEQ ID NO. 2377 with e-value of 1.60E-147 and BLAST sequence identity of 73.1
MGVGKYIASDTFYIGGYAWAIYFYPDGKSPEDNATYVSLFIALASEGTDVRALFELSLMDQSGKERHKVHSHFGRALESGPYTLKYRGSMWGYKRFYRRNQLETSDYLKDDTLLVRCCVGVVKSHTEGPKTYTISVPPSNIGQHFGKLLDSGTGTDVNFEVDGETFASHKIVLAARSPVFRAQLFGPMKDQNTQCIKVEDMEAPVFKALIHFMYWDALPDIEELVGLNSKWVSTLMAQHLLAAADRYALERLRLLCEARLCEDVAINTVATTLALAEQHQCIQLKSVCLKFIALPENLKAVMQTDGFEYLKESCPSVITELLQYVAKNGERSVITCTLGNDTLDSDMNGRRVKQRIH

SEQ ID NO: 2338 - DNA, 1359 bp, Populus balsamifera subsp. trichocarpa
  misc_feature (1)..(1359): Ceres ANNOT ID no. 1462703
  misc_feature 262546:<222: Transcription Factor
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: WHOLE PLANT - Other Useful for making bigger plants
  misc_feature: Phenotype: ROSETTE LEAVES - Oval Shaped Useful for making plants with increased biomass and foliage
atgggcacaatcaggttttctagcagagacctcccagcagcacctcccacatcaaacccatcatcatcaattccaacaaaaacaacatcatcttctataacggaaaccgtaaatgggtctcatgaattcaagatcggtggctattctctctcgaaaggcatgggggtaggcaaatacatcgcatcggatactttttatattggtggatatgcatgggctatatatttctacccagatggtaagagccctgaagataatgccacttatgtctccttattcattgcccttgctagcgaggggacggatgttagggctttgtttgaattgtcgttgatggatcaaagtgggaaagaaagacataaggttcatagccattttgggagagcccttgagagcgggccctatacgcttaagtatcgtggcagtatgtggggttataaacgattttatagaaggaatcaattagagacatcagactatcttaaggatgataccctactagttcgctgctgtgttggtgttgttaagtctcacaccgaggggcctaagacctacaccatttccgtgccaccttccaatattggtcagcattttggaaagcttttagacagtggaacgggaactgatgtaaattttgaagttgatggagaaacctttgcttctcacaaaatagttctggctgcacgctcaccagtgtttagagcacagctttttggtccaatgaaagatcaaaacactcaatgcatcaaagttgaagacatggaagctccggtttttaaggtccctcctcttgttcttgctctctcttttacatgcatgatatttgtggtgccatacacaaatgtacatgtggattcatctcccaaggcactgctcctatccttattcttattcactccggttaaggcgttaatccattttatgtactgggatgccttaccagacattgaggaacttgttggtttgaactcaaaatgggtttctacactgatggctcagcatctgcttgcagcagcagatcgctatgcacttgagaggctcagattgctctgtgaggctagactttgtgaagatgttgcaataaacaccgttgcaacaacactagctctagcggagcagcatcagtgcatccaactaaagtccgtatgtctcaaattcattgctttgcctgaaaatttgaaagctgtgatgcaaacagatgggtttgaatacttaaaagaaagctgcccttctgtcatcacggagctactgcaatatgttgccaaaaatggtgagcgttctgtcatcacttgtacacttggaaatgacaccttagatagcgatatgaatggaaggcgggtgaagcaaaggatacattga

SEQ ID NO: 2339 - protein, 399 aa, Populus balsamifera subsp. trichocarpa
  misc_feature (1)..(399): Ceres ANNOT ID no. 1462703
  misc_feature (248)..(306): Pfam Name: BTB Pfam Description: BTB/POZ domain
  misc_feature (9)..(121): Pfam Name: MATH Pfam Description: MATH domain
  misc_feature: SWISSPROT Homolog: SPOP_HUMAN Speckle-type POZ protein with e-value of 2.3e-35 and BLAST sequence identity of 32.4
  misc_feature: SWISSPROT Homolog: SPOP_MOUSE Speckle-type POZ protein (PDX-1 C-terminal-interacting factor 1) (PCIF1) with e-value of 2.3e-35 and BLAST sequence identity of 32.4
  misc_feature: SWISSPROT Homolog: TDPZ2_MOUSE TD and POZ domain-containing protein 2 with e-value of 2.2e-32 and BLAST sequence identity of 31.1
  misc_feature: SWISSPROT Homolog: TDPZ4_MOUSE TD and POZ domain-containing protein 4 with e-value of 9.7e-30 and BLAST sequence identity of 31.7
  misc_feature: SWISSPROT Homolog: YNV5_CAEEL Hypothetical protein T16H12.5 in chromosome III with e-value of 1.3e-27 and BLAST sequence identity of 28.5
  misc_feature 262686:<222: Transcription Factor
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: WHOLE PLANT - Other Useful for making bigger plants
  misc_feature: Phenotype: ROSETTE LEAVES - Oval Shaped Useful for making plants with increased biomass and foliage
  misc_feature (1)..(399): Functional Homolog of  Ceres CLONE ID no. 113719 at SEQ ID NO. 2377 with e-value of 4.20E-138 and BLAST sequence identity of 73.1
MGVGKYIASDTFYIGGYAWAIYFYPDGKSPEDNATYVSLFIALASEGTDVRALFELSLMDQSGKERHKVHSHFGRALESGPYTLKYRGSMWGYKRFYRRNQLETSDYLKDDTLLVRCCVGVVKSHTEGPKTYTISVPPSNIGQHFGKLLDSGTGTDVNFEVDGETFASHKIVLAARSPVFRAQLFGPMKDQNTQCIKVEDMEAPVFKVPPLVLALSFTCMIFVVPYTNVHVDSSPKALLLSLFLFTPVKALIHFMYWDALPDIEELVGLNSKWVSTLMAQHLLAAADRYALERLRLLCEARLCEDVAINTVATTLALAEQHQCIQLKSVCLKFIALPENLKAVMQTDGFEYLKESCPSVITELLQYVAKNGERSVITCTLGNDTLDSDMNGRRVKQRIH

SEQ ID NO: 2340 - protein, 382 aa, Arabidopsis thaliana
  misc_feature (1)..(382): Ceres CLONE ID no. 113990
  misc_feature (188)..(336): Pfam Name: DUF250 Pfam Description: Domain of unknown function, DUF250
  misc_feature (44)..(170): Pfam Name: DUF6 Pfam Description: Integral membrane protein DUF6
  misc_feature: Phenotype: WHOLE PLANT - Dark Green Useful for increasing chlorophyll and photosynthetic capacity
  misc_feature: Phenotype: WHOLE PLANT - Small Useful for modulating plant size
MSDGRVNADPQQEENMVKPPVKRSLTLLIVTYFFLFFGSIASSLLAKYYFVYGGSSRWVSTWVQSAGFPLLLILIYFPHYVLKTTTRRPFTRFTLRHLIFSVLIGLVLGFNNFLFSWGTSYLPVSTSSLLLSTQLVFTLILSRIIVKQKITFSNLNCVVLLTLSSVLLALDSSKDKPSGLTKTKYFIGYVSTIGAGLLFALYLPVTEKLYRTVYCYAMVMEVQLVMEFAATVFATIGMACEGGFKEMVKEANHVFTKGPTFYWTFAILANVVTWQLSFAATSGMVYLTSGITGGICMTALLAMNVIGGVVAYGDVFGGVKIVSTVLCIWGFSSYTYGMYMKMKKEEKEKGEYSGVKTTEDSGEMEVEMGNVKDDVAAADDRA

SEQ ID NO: 2341 - DNA, 1287 bp, Populus balsamifera subsp. trichocarpa
  misc_feature (1)..(1287): Ceres ANNOT ID no. 1438327
  misc_feature 262928:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
atgcatattcagattaattatattagaaggatatatatctcggcacaagcttcacctccaaattctcccaaatcccatctccactctcaaagtgctctaaacaacaccaccaccaagaacaacgagaacaataccgaaacaattcaagaacagcaaaagctacacaaagatttctcatcttcacaatcactagtgatcatgagcaataattcagttagagtgcaagaagaccagaaggccaagacgaacaagagatacatgtttcttttggtgatcaactacctgttcctctttgcgggctcactctcttcgagcttactctcaaagttttatttcaaccatcacggttcaagcagatgggtatctacatgggtacaatctgctggtttccctctccttatcttccccatttacctccctttttatgtcctcaaatgcactgatagacgtccctttagtcacttcactccaaggatattaatcttatcaatcttaataggtcttatgttaggcctgaataaccttctcttttcatggggcaattcttatctcccagtatcaacctcatctctacttctgtcttctcaacttgtattcaaccttattctctcggttatcatagtaaaacaaaagatcacctttcaaaatctcaactgtgtagtccttttgaccctaagttcagtccttttggctttaggttcaacccatgataaacctcaaggactaacccgtgcaaaatacttcgttggtttcttttcaaccataggagctggcttgttatttgctttatatttaccagtcatggaaaagatatacaaatggatctactgttatgagatggtgatggaaatgcagttagtgatggagattgcagccacagctctggccaccgcggggatggcatcagacggtggtttttcagagatgaagagagagagccaagtcaaatttgataaaggaccagagatttactgggtgacggtgttcgctaacgtggttacatggcagctatgcttcatgggcacagcaggaatggttttcttaacatcatcactaacaggagggatttgcatgactgcccttttggccatgaacgtgttaggaggggtgctggtctatggagatgagtttggtggtgtcaaggtagtatccactgtgctttgtgggtggggtttttgttcttatgtttatggtatgtatcttaaaatgagagaagaaaaggagaaggagaataaaaatcatgggatggagatggctcagaacgttgtatcagccaacaatgtttag

SEQ ID NO: 2342 - protein, 362 aa, Populus balsamifera subsp. trichocarpa
  misc_feature (1)..(362): Ceres ANNOT ID no. 1438327
  misc_feature (184)..(331): Pfam Name: DUF250 Pfam Description: Domain of unknown function, DUF250
  misc_feature (62)..(166): Pfam Name: DUF6 Pfam Description: Integral membrane protein DUF6
  misc_feature 263016:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature (1)..(362): Functional Homolog of  Ceres CLONE ID no. 113990 at SEQ ID NO. 2384 with e-value of 1.69E-125 and BLAST sequence identity of 68.2
MSNNSVRVQEDQKAKTNKRYMFLLVINYLFLFAGSLSSSLLSKFYFNHHGSSRWVSTWVQSAGFPLLIFPIYLPFYVLKCTDRRPFSHFTPRILILSILIGLMLGLNNLLFSWGNSYLPVSTSSLLLSSQLVFNLILSVIIVKQKITFQNLNCVVLLTLSSVLLALGSTHDKPQGLTRAKYFVGFFSTIGAGLLFALYLPVMEKIYKWIYCYEMVMEMQLVMEIAATALATAGMASDGGFSEMKRESQVKFDKGPEIYWVTVFANVVTWQLCFMGTAGMVFLTSSLTGGICMTALLAMNVLGGVLVYGDEFGGVKVVSTVLCGWGFCSYVYGMYLKMREEKEKENKNHGMEMAQNVVSANNV

SEQ ID NO: 2343 - DNA, 1242 bp, Populus balsamifera subsp. trichocarpa
  misc_feature (1)..(1242): Ceres ANNOT ID no. 1447769
  misc_feature 263125:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
atggatgtcttggtacacgcatcacctccaaattctcccaaaccccatctctactctccaagtgctctcaaaaccaaaaacaatatcgaaacaattcaggaacaacaaaagccacaccaagattcctcatcatcacaatctccagtgatcaccatgagcaatgattcaattagtgtgcaagaagaccaaaaggccaggacaaacaagagatatatctttcttttggtgatcaactactcgttcctgtttgtgggctcgctctcttctagtttactctcgaagttttatttcaaccatcaaggttctagcagatgggtctctacatgggttcaatccgcgggtttccctctccttctcttccctatttacctccctttttatgtcttcaaatgcactgatagacgtccatttagtctcttcactccaaaactgttaatcttatcaatcttcataggtctcatgttaggcttgaacaaccttctcttttcttggggtaattcttatctcccagtatcaacctcatctctccttttgtcttcacagctagtgttcaatctcatcctctcagcgatcatagtaaaacaaaagatcacttttcaaaatttcaactgtgtaatcctcttgaccctaagttcagttcttttggctttaggttcaagccatgacaagtcccaaggtctaacccgtgcaaaatatttcattggcttcttatcgacaataggagcgggcttgttatttgccttatatttaccagtcatggagaagatatacagaaggatctactgttatgagatggtggtggaaatgcagctggtgatggagattgcagccacagctctggccaccatggggatggcatcagccggtggtttttcagagatgaaacgggaaagccaggtcaggtttgataaaggagcaagggtttattgggttacagtgtttgctaacgtggttacttggcagttatgcttcatgggcacagcaggaatggttttcttaacatcatcactaacaggagggatttgcatgactgccctcttggccatgaacgtgttaggaggggtggtggtctacggagatgagtttggtggtgtcaaggtagtgtccactgttctttgtgggtggggtttttgttcttatgtctatggtctatatcttaagatgaaagaagaaaaggagatggagaataaaaatcatgggatggagatggctcataatgctgtagcacccaacaatgtttaa

SEQ ID NO: 2344 - protein, 362 aa, Populus balsamifera subsp. trichocarpa
  misc_feature (1)..(362): Ceres ANNOT ID no. 1447769
  misc_feature (184)..(331): Pfam Name: DUF250 Pfam Description: Domain of unknown function, DUF250
  misc_feature (62)..(166): Pfam Name: DUF6 Pfam Description: Integral membrane protein DUF6
  misc_feature 263211:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature (1)..(362): Functional Homolog of  Ceres CLONE ID no. 113990 at SEQ ID NO. 2384 with e-value of 4.20E-122 and BLAST sequence identity of 66.9
MSNDSISVQEDQKARTNKRYIFLLVINYSFLFVGSLSSSLLSKFYFNHQGSSRWVSTWVQSAGFPLLLFPIYLPFYVFKCTDRRPFSLFTPKLLILSIFIGLMLGLNNLLFSWGNSYLPVSTSSLLLSSQLVFNLILSAIIVKQKITFQNFNCVILLTLSSVLLALGSSHDKSQGLTRAKYFIGFLSTIGAGLLFALYLPVMEKIYRRIYCYEMVVEMQLVMEIAATALATMGMASAGGFSEMKRESQVRFDKGARVYWVTVFANVVTWQLCFMGTAGMVFLTSSLTGGICMTALLAMNVLGGVVVYGDEFGGVKVVSTVLCGWGFCSYVYGLYLKMKEEKEMENKNHGMEMAHNAVAPNNV

SEQ ID NO: 2345 - protein, 297 aa, Arabidopsis thaliana
  misc_feature (1)..(297): Ceres CLONE ID no. 114466
  misc_feature (51)..(289): Pfam Name: DUF579 Pfam Description: Protein of unknown function (DUF579)
  misc_feature: Phenotype: INFLORESCENCE - Late Flowering Useful for modulating flowering time
MRTKSPSSLNLKVIFIGSSILILIIIYLARSNISSSSSKPISKTNLSQEEEETQHKQEGCPTTQQCTKMPLSLSDALVHYVTSNVTPQQTFDEVSVSKRVLDKKSPCNFLVFGLGHDSLMWASLNHGGRTLFIEEDQAWIAIVTKKFPNLESYHVVYDTKVKDSDKLMELGRSEECRSVSDPRNSKCDLALKDFPADFYETKWDLIMVDAPTGYHEEAPGRMSAIYTAGLLARNREDGETDVFVHDVNRPVEDEFSATFLCKGYMREQNGRLRHFTIPSHRARAGRPFCPVEVDRRR

SEQ ID NO: 2346 - DNA, 906 bp, Populus balsamifera subsp. trichocarpa
  misc_feature (1)..(906): Ceres ANNOT ID no. 1479643
  misc_feature 263405:<222: Transcription Factor
  misc_feature: Phenotype: INFLORESCENCE - Late Flowering Useful for modulating flowering time
atgaggtccaaaaaccaatctcccattaacatcaagatcatcatcctcggtttattctttctcctcttccttttggtgattgcttggtcaagttactcgtctcccagaccaaattcatcccccaaagcagaaaatgatgatctatcagattcatcaaatctgtccactgatgaagaagaaccaaaaccatcaacagcagcctgtccttctcttccattgacgccgacatgcaccaagatcccaccttctttagccaacgctcttgtccattatgtgacaacaaacatcaccccacaacaaaccctcaaggaaatctcagtctcattaagggtcctcgaaaaaaagtcaccttgcaacttcctagtctttggccttggccatgacagtctaatgtggacatctctaaatcacggcggccgcactgttttcctggaagaggacaaggcctggattgagcagatcagagagaaactgcccaccttggagtcctatcatgtgacatacgacaccagagttcatcaggcagatgggctcatggagacaggaatgggagatgaatgcaaagtagtcggtgatccaagattctccaagtgtcagcttgcccttaaagggttccctggtgatatctatgatgtggaatgggacttgatcatggtggatgcacctactgggtaccatgatgaggctccagggagaatgaatgcaatctacacagctggattgatggctagaaacagagaaaatggagtgactgatgtgtttgtgcatgatgttgatagagttgtggaggataaattctccaaggcttttctttgtgaaggatacatgactgagcaagaagggaggttaaggcacttcattattcctactcatagaactagttcgggaaaacctttttgtccatag

SEQ ID NO: 2347 - protein, 301 aa, Populus balsamifera subsp. trichocarpa
  misc_feature (1)..(301): Ceres ANNOT ID no. 1479643
  misc_feature (63)..(300): Pfam Name: DUF579 Pfam Description: Protein of unknown function (DUF579)
  misc_feature 263468:<222: Transcription Factor
  misc_feature: Phenotype: INFLORESCENCE - Late Flowering Useful for modulating flowering time
  misc_feature (1)..(301): Functional Homolog of  Ceres CLONE ID no. 114466 at SEQ ID NO. 2389 with e-value of 2.20E-100 and BLAST sequence identity of 64.7
MRSKNQSPINIKIIILGLFFLLFLLVIAWSSYSSPRPNSSPKAENDDLSDSSNLSTDEEEPKPSTAACPSLPLTPTCTKIPPSLANALVHYVTTNITPQQTLKEISVSLRVLEKKSPCNFLVFGLGHDSLMWTSLNHGGRTVFLEEDKAWIEQIREKLPTLESYHVTYDTRVHQADGLMETGMGDECKVVGDPRFSKCQLALKGFPGDIYDVEWDLIMVDAPTGYHDEAPGRMNAIYTAGLMARNRENGVTDVFVHDVDRVVEDKFSKAFLCEGYMTEQEGRLRHFIIPTHRTSSGKPFCP

SEQ ID NO: 2348 - DNA, 915 bp, Populus balsamifera subsp. trichocarpa
  misc_feature (1)..(915): Ceres ANNOT ID no. 1486882
  misc_feature 263558:<222: Transcription Factor
  misc_feature: Phenotype: INFLORESCENCE - Late Flowering Useful for modulating flowering time
atgagacccaacaaaaaccaatctcccattaacatcaagatcatcaccctcagtttattctttcttctcttccttgtgctggtagcttggtcaagcttctcatctccgagatcaaatccatcccccaaagcagaaaatgatgacctaacaaacccatcatcaagtctgtccactgatgaagaagatcagcccaaaccatcaacaccagcctgcccttctcttcccctgacaccaacatgcaccaaaaccccaccttctttagccaatgctcttgtccattacgttacaacgaacatcaccccacaacaaaccctcaaagaaatctcggtcacattaagggtcctggagaaaaagtcaccttgcaatttcctagtctttggtcttggtcatgacagtctaatgtggacatctctaaatcatggtggccgaactgttttcctggaagaagacaaggcttggattgagcaaatcacagagaaactgccctctttagaggcctaccatgtgacgtacgacaccagagtgcatcaggcagatgggctcatggagacaggaatgggagatgaatgcaaagttgtaagcgaccccagattctccaagtgccagctttctcttaaagggttccctagtgatatttatgacatggaatgggacttgatcatggtggatgcacccactgggtatcatgacgaggcaccagggaggatgactgcaatctacacggctggattgatggctaggaacagagagaatggagagactgatgtgtttgtgcatgatgttgatagagttgtggaggataaattctccaaggcttttctttgtgaaggatacttgactgagcaggaagggaggttaaggcatttcatcattcctagtcatagaactcgttcgggcagacctttttgtccttag

SEQ ID NO: 2349 - protein, 304 aa, Populus balsamifera subsp. trichocarpa
  misc_feature (1)..(304): Ceres ANNOT ID no. 1486882
  misc_feature (66)..(303): Pfam Name: DUF579 Pfam Description: Protein of unknown function (DUF579)
  misc_feature 263621:<222: Transcription Factor
  misc_feature: Phenotype: INFLORESCENCE - Late Flowering Useful for modulating flowering time
  misc_feature (1)..(304): Functional Homolog of  Ceres CLONE ID no. 114466 at SEQ ID NO. 2389 with e-value of 9.59E-100 and BLAST sequence identity of 66.0
MRPNKNQSPINIKIITLSLFFLLFLVLVAWSSFSSPRSNPSPKAENDDLTNPSSSLSTDEEDQPKPSTPACPSLPLTPTCTKTPPSLANALVHYVTTNITPQQTLKEISVTLRVLEKKSPCNFLVFGLGHDSLMWTSLNHGGRTVFLEEDKAWIEQITEKLPSLEAYHVTYDTRVHQADGLMETGMGDECKVVSDPRFSKCQLSLKGFPSDIYDMEWDLIMVDAPTGYHDEAPGRMTAIYTAGLMARNRENGETDVFVHDVDRVVEDKFSKAFLCEGYLTEQEGRLRHFIIPSHRTRSGRPFCP

SEQ ID NO: 2350 - protein, 493 aa, Arabidopsis thaliana
  misc_feature (1)..(493): Ceres CLONE ID no. 114602
  misc_feature (46)..(481): Pfam Name: Aa_trans Pfam Description: Transmembrane amino acid transporter protein
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
MGETAAANNHRHHHHHGHQVFDVASHDFVPPQPAFKCFDDDGRLKRTGTVWTASAHIITAVIGSGVLSLAWAIAQLGWIAGPAVMLLFSLVTLYSSTLLSDCYRTGDAVSGKRNYTYMDAVRSILGGFKFKICGLIQYLNLFVIAIGYTIAASISMMAIKRSNCFHKSGGKDPCHMSSNPYMIVFGVAEILLSQVPDFDQIWWISIVAAVMSFTYSAIGLALGIVQVAANGVFKGSLTGISIGTVTQTQKIWRTFQALGDIAFAYSYSVVLIEIQDTVRSPPAESKTMKKATKISIAVTTIFYMLCGSMGYAAFGDAAPGNLLTGFGFYNPFWLLDIANAAIVVHLVGAYQVFAQPIFAFIEKSVAERYPDNDFLSKEFEIRIPGFKSPYKVNVFRMVYRSGFVVTTTVISMLMPFFNDVVGILGALGFWPLTVYFPVEMYIKQRKVEKWSTRWVCLQMLTVACLVISVVAGVGSIAGVMLDLKVYKPFKSTY

SEQ ID NO: 2351 - DNA, 1479 bp, Populus balsamifera subsp. trichocarpa
  misc_feature (1)..(1479): Ceres ANNOT ID no. 1450785
  misc_feature 263856:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
atgggtgagaatgctgcctcaaagaactaccacaacaaccaccacctccacaaccatcaccaagtctttgacgtctccgttgatgtactccctcaaaatggttccaagtgctttgatgatgatggccgccttaaaagaactggtactctatggaccgctagctcccacataataacagcagtgataggatcaggagttctttccttggcatgggctatagctcaactaggatggattgctggtcctgctgtgatgttcttgttctcattggttacatactatacctcatctctactcactgactgttaccggactggcgatcctgatacaggaaaaagaaactatacatacatggacgctgttcaatccattctgggaggagtaaaagtcaatttgtgtggccttgttcagtacataggcctatttggtattgccattggttacaccattgcatcatccataagcatgatggcaattaaaaggtcaaactgtttccatcaaagcggtggacagaacccatgtcacatttcgagcaacccatacatgatcatatttggtataacagaaattctactttctcagattccagactttgatcagctatggtggctctctatcgttgccgcggtcatgtcttttacttactctaccattggtcttggccttggcattggcaaagttgcagctaatggaacttttaagggtagtctaactgggataagcattggaaccgtaaccgaaactgaaaagatatggaggagtttccaagcacttggggccatagcctttgcatattcatattctgtcattcttatagaaattcaagacacaattaaatctccaccagcagaatcaaagacaatgaagaaagctgccaagataagcatcgtagtgacaacaactttctatatgctttgtggttgcatgggatatgcagcttttggagaccaagctcctggaaatctcctcactggctttggtttctataacccatattggcttattgatattgccaacgttgccatagtaatccacctgattggagcatatcaagtgttttgccaacctctctttgctttcatcgagaaatgggcaaaccaaaaatggcctgaaaattacttcatcaccaaggaattcaaaatcccagtcccaggttttaggccatacaagctgaatctatttagaatggtttggagaacaatatttgtgttgttaaccactgttatatcaatgttgctcccattctttaatgatgttgtgggaattctcggtgcacttggtttttggcccttgacagtctattttccagtggagatgtacatcgtacaaaagaagataccaaaatggagcacaagatggatttgtctccagatgctgagcatggcttgccttgtgatttcactcgtggctgttgcaggctcaattgctggtgttgtgcttgaccttaaggtttacaagccgttcaagacaagctattaa

SEQ ID NO: 2352 - protein, 492 aa, Populus balsamifera subsp. trichocarpa
  misc_feature (1)..(492): Ceres ANNOT ID no. 1450785
  misc_feature (46)..(480): Pfam Name: Aa_trans Pfam Description: Transmembrane amino acid transporter protein
  misc_feature: SWISSPROT Homolog: MTR_NEUCR N amino acid transport system protein (Methyltryptophan resistance protein) with e-value of 4.8e-06 and BLAST sequence identity of 32.3
  misc_feature: SWISSPROT Homolog: AVT3_YEAST Vacuolar amino acid transporter 3 with e-value of 5.6e-06 and BLAST sequence identity of 20.9
  misc_feature 263973:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature (1)..(492): Functional Homolog of  Ceres CLONE ID no. 114602 at SEQ ID NO. 2394 with e-value of 2.39E-215 and BLAST sequence identity of 79.3
MGENAASKNYHNNHHLHNHHQVFDVSVDVLPQNGSKCFDDDGRLKRTGTLWTASSHIITAVIGSGVLSLAWAIAQLGWIAGPAVMFLFSLVTYYTSSLLTDCYRTGDPDTGKRNYTYMDAVQSILGGVKVNLCGLVQYIGLFGIAIGYTIASSISMMAIKRSNCFHQSGGQNPCHISSNPYMIIFGITEILLSQIPDFDQLWWLSIVAAVMSFTYSTIGLGLGIGKVAANGTFKGSLTGISIGTVTETEKIWRSFQALGAIAFAYSYSVILIEIQDTIKSPPAESKTMKKAAKISIVVTTTFYMLCGCMGYAAFGDQAPGNLLTGFGFYNPYWLIDIANVAIVIHLIGAYQVFCQPLFAFIEKWANQKWPENYFITKEFKIPVPGFRPYKLNLFRMVWRTIFVLLTTVISMLLPFFNDVVGILGALGFWPLTVYFPVEMYIVQKKIPKWSTRWICLQMLSMACLVISLVAVAGSIAGVVLDLKVYKPFKTSY

SEQ ID NO: 2353 - DNA, 1461 bp, Populus balsamifera subsp. trichocarpa
  misc_feature (1)..(1461): Ceres ANNOT ID no. 1456283
  misc_feature 264120:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
atgggtgagaatgctgcctcaaagaactgccacaacaaccaccacctccacaaccatcaccaggtctttgacatctccattgatgtgcttcctcaaaatggttccaaatgctttgacgatgatggccgccttaagagaactggtactctatggactgctagtgcccacataataacagcggtgataggatcaggagttctttccttggcatgggcagtagctcaactaggatgggttgctggtcctgctgtcatgttcttgttctcacttgttacttactatacctcatctctactcactgactgttaccggaccggcgatcccgatacaggaaaaagaaactatacatacatggacgctgttgaatccattctaggtggagtaaaggtcaagttgtgtggctttattcagtacctgggcctatttggtattgccattggctacaccattgcatcatccataagcatgatggcaattaaaaggtcaaattgtttccatcaaagtggtggacagaacccatgtcacctttcgagcaacccatatatgatcatgtttggtataacagaaattctgctctctcagatcccagactttgatcagctatggtggctctctatcgtgccgcggtcatgtcttttacttactctagcattggtcttggcctgggcattggcaaagttgcagggtagtctaactgggataagcattggaaccgtaaccgaaacagagaagatatggaggagtttccaagcacttggtgccatagccttcgcgtattcatattctgtcattcttatagaaattcaagacacagttaaatctccaccagcagaatcgaagacaatgaagaaagctgccaggataagcattgtagtgacaacaactttctatatgctttgtggctgcatgggatatgcagcatttggagacctagcacctggaaatctcctcactggctttggtttctataacccatattggcttattgatattgctaacgccgccatagtaatccacctagtaggagcatatcaagtgttttgccagcctctctttgctttcattgagaaatgggcaaaccaaaaatggcctaaaagttacttcatcaccaaggaattcaacatcgcagtcccaggccttgggctatataagctgaatctctttagattggtttggagaacaatatttgtgatcttaaccactgttatatcaatgctgctcccattctttaatgatgttgtgggaattcttggggcacttggtttctggcctttgacagtctattttccagtggagatgtacatcgtacaaaggaagataccaaaatggagcacaagatggatttgtctccaaatgctgagcatggcttgcctagtgatttcacttgtggctgttgcaggctcacttgctggtgttgtgcttgaccttaaggcttacaagccattcaagacaagctattga

SEQ ID NO: 2354 - protein, 486 aa, Populus balsamifera subsp. trichocarpa
  misc_feature (1)..(486): Ceres ANNOT ID no. 1456283
  misc_feature (46)..(474): Pfam Name: Aa_trans Pfam Description: Transmembrane amino acid transporter protein
  misc_feature: SWISSPROT Homolog: MTR_NEUCR N amino acid transport system protein (Methyltryptophan resistance protein) with e-value of 4.8e-06 and BLAST sequence identity of 32.3
  misc_feature: SWISSPROT Homolog: AVT3_YEAST Vacuolar amino acid transporter 3 with e-value of 5.6e-06 and BLAST sequence identity of 20.9
  misc_feature 264237:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature (1)..(486): Functional Homolog of  Ceres CLONE ID no. 114602 at SEQ ID NO. 2394 with e-value of 1.29E-200 and BLAST sequence identity of 76.2
MGENAASKNCHNNHHLHNHHQVFDISIDVLPQNGSKCFDDDGRLKRTGTLWTASAHIITAVIGSGVLSLAWAVAQLGWVAGPAVMFLFSLVTYYTSSLLTDCYRTGDPDTGKRNYTYMDAVESILGGVKVKLCGFIQYLGLFGIAIGYTIASSISMMAIKRSNCFHQSGGQNPCHLSSNPYMIMFGITEILLSQIPDFDQLWWLSIVPRSCLLLTLALVLAWALAKLQGSLTGISIGTVTETEKIWRSFQALGAIAFAYSYSVILIEIQDTVKSPPAESKTMKKAARISIVVTTTFYMLCGCMGYAAFGDLAPGNLLTGFGFYNPYWLIDIANAAIVIHLVGAYQVFCQPLFAFIEKWANQKWPKSYFITKEFNIAVPGLGLYKLNLFRLVWRTIFVILTTVISMLLPFFNDVVGILGALGFWPLTVYFPVEMYIVQRKIPKWSTRWICLQMLSMACLVISLVAVAGSLAGVVLDLKAYKPFKTSY

SEQ ID NO: 2355 - DNA, 1626 bp, Populus balsamifera subsp. trichocarpa
  misc_feature (1)..(1626): Ceres ANNOT ID no. 1460638
  misc_feature 264384:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
atgttgcctaggagtcgaactatgcctagcagaatccaccatggagtggcagatgaaaggcatgatatcaggcactacttagaggtggaagtccagcctaaagttagtgagagtgaagctatcaaccctcaatccaattactcaaagtgctttgatgatgatggtcgcttgaaaagaacaggaaatttctggacttcatcttcccatataatcactgctgttatagggtcaggagtcctatcattggcttgggccatagcgcagctcggttgggttgcaggaccagctgttatggtcctatttgcatttgtaaatctctacacttcgaatctactagcacagtgctacaggtctggcgaccctgtcacgggacagagaaattacacctacatggatgctgtcaaatcttacttgggtaagaatatactccccatcattttcagctggctaaattgtcattataatcatgagcatgatggtgaaaatatctctgtgtcggctgcaggaggacggaaggtgatgttatgtggattgattcaatacttgaatttgtttggtgttgctattggttatacgattgcagcatcagtcagcatgatggcaataaagagatcaaactgtttccatagcagtggaggaaaagatccatgtcatatgtcaagcaatgggtttatgataacatttggaatcatagagatcttattttctcagataccagactttgatcaagtatggtggctttctatagtggctgctataatgtctttcacatattctacagttggtttgggtcttggtataggcaaagttgcaggaaatggaaccttcaaaggaagcctgactggtatcagtatagggacggaaacacatgctggaccagttacttctacacagaaactatggagaagtttgcaagctcttggagccattgcctttgcttactcgttctccattatcctcatcgaaattcaggatacaataagatctccacctgcagaatacaaaaccatgaagaaagcaactttatttagcatcattataactacaattttctacttactctgtggatgcatgggctatgcagcttttggtgatttggcccctggaaatcttttgactggctttggattctacaacccctactggctattagacatcgctaatgttgcaatcgttgttcatcttgttggtgcctatcaggtctattgccagccattgtttgcatttgtagaaaaatggagtgctcggaagtggcctaagagcgattttgtgacagcagaatatgaggtacccatccccttttatggtgtgtaccagctgaacttcttccggctagtatggagaacaatatttgttatgctgacaactttaatagccatgctcatgcccttcttcaatgatgttgttggactcctcggttccatgggattctggccattgacagttttctttcccattgagatgtacatttctcagaagaagattgggcgatggacaagccagtggatagggctccagattctcagtatgacttgcctcatgatcaccatagccgcagctgttgggtctgttgccggggttgtcttggatctcaaaacttacaagccatttaaaactagttactga

SEQ ID NO: 2356 - protein, 534 aa, Populus balsamifera subsp. trichocarpa
  misc_feature (1)..(534): Ceres ANNOT ID no. 1460638
  misc_feature (52)..(133): Pfam Name: Aa_trans Pfam Description: Transmembrane amino acid transporter protein
  misc_feature: SWISSPROT Homolog: MTR_NEUCR N amino acid transport system protein (Methyltryptophan resistance protein) with e-value of 4.8e-06 and BLAST sequence identity of 32.3
  misc_feature: SWISSPROT Homolog: AVT3_YEAST Vacuolar amino acid transporter 3 with e-value of 5.6e-06 and BLAST sequence identity of 20.9
  misc_feature 264507:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature (1)..(534): Functional Homolog of  Ceres CLONE ID no. 114602 at SEQ ID NO. 2394 with e-value of 4.29E-184 and BLAST sequence identity of 70.4
MPSRIHHGVADERHDIRHYLEVEVQPKVSESEAINPQSNYSKCFDDDGRLKRTGNFWTSSSHIITAVIGSGVLSLAWAIAQLGWVAGPAVMVLFAFVNLYTSNLLAQCYRSGDPVTGQRNYTYMDAVKSYLGKNILPIIFSWLNCHYNHEHDGENISVSAAGGRKVMLCGLIQYLNLFGVAIGYTIAASVSMMAIKRSNCFHSSGGKDPCHMSSNGFMITFGIIEILFSQIPDFDQVWWLSIVAAIMSFTYSTVGLGLGIGKVAGNGTFKGSLTGISIGTETHAGPVTSTQKLWRSLQALGAIAFAYSFSIILIEIQDTIRSPPAEYKTMKKATLFSIIITTIFYLLCGCMGYAAFGDLAPGNLLTGFGFYNPYWLLDIANVAIVVHLVGAYQVYCQPLFAFVEKWSARKWPKSDFVTAEYEVPIPFYGVYQLNFFRLVWRTIFVMLTTLIAMLMPFFNDVVGLLGSMGFWPLTVFFPIEMYISQKKIGRWTSQWIGLQILSMTCLMITIAAAVGSVAGVVLDLKTYKPFKTSY

SEQ ID NO: 2357 - DNA, 1359 bp, Populus balsamifera subsp. trichocarpa
  misc_feature (1)..(1359): Ceres ANNOT ID no. 1513900
  misc_feature 264663:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
atgttgcctaggagtcgaactatgcctagcagaatccaccatggagtggcagatgaaaggcatgatatcaggcactacttagaggtggaagtccagcctaaagttagtgagagtgaagctatcaaccctcaatccaattactcaaagtgctttgatgatgatggtcgcttgaaaagaacaggaaatttctggacttcatcttcccatataatcactgctgttatagggtcaggagtcctatcattggcttgggccatagcgcagctcggttgggttgcaggaccagctgttatggtcctatttgcatttgtaaatctctacacttcgaatctactagcacagtgctacaggaggacggaaggtgatgttatgtggattgattcaatacttgaatttgtttggtgttgctattggttatacgattgcagcatcagtcagcatgatataccagactttgatcaagtatggtggctttctatagtggctgctataatgtctttcacatattctacagttggtttgggtcttggtataggcaaagttgcaggaaatggaaccttcaaaggaagcctgactggtatcagtatagggacggaaacacatgctggaccagttacttctacacagaaactatggagaagtttgcaagctcttggagccattgcctttgcttactcgttctccattatcctcatcgaaattcaggatacaataagatctccacctgcagaatacaaaaccatgaagaaagcaactttatttagcatcattataactacaattttctacttactctgtggatgcatgggctatgcagcttttggtgatttggcccctggaaatcttttgactggctttggattctacaacccctactggctattagacatcgctaatgttgcaatcgttgttcatcttgttggtgcctatcaggtctattgccagccattgtttgcatttgtagaaaaatggagtgctcggaagtggcctaagagcgattttgtgacagcagaatatgaggtacccatccccttttatggtgtgtaccagctgaacttcttccggctagtatggagaacaatatttgttatgctgacaactttaatagccatgctcatgcccttcttcaatgatgttgttggactcctcggttccatgggattctggccattgacagttttctttcccattgagatgtacatttctcagaagaagattgggcgatggacaagccagtggatagggctccagattctcagtatgacttgcctcatgatcaccatagccgcagctgttgggtctgttgccggggttgtcttggatctcaaaacttacaagccatttaaaactagttactga

SEQ ID NO: 2358 - protein, 445 aa, Populus balsamifera subsp. trichocarpa
  misc_feature (1)..(445): Ceres ANNOT ID no. 1513900
  misc_feature (52)..(433): Pfam Name: Aa_trans Pfam Description: Transmembrane amino acid transporter protein
  misc_feature: SWISSPROT Homolog: MTR_NEUCR N amino acid transport system protein (Methyltryptophan resistance protein) with e-value of 4.8e-06 and BLAST sequence identity of 32.3
  misc_feature: SWISSPROT Homolog: AVT3_YEAST Vacuolar amino acid transporter 3 with e-value of 5.6e-06 and BLAST sequence identity of 20.9
  misc_feature 264776:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature (1)..(445): Functional Homolog of  Ceres CLONE ID no. 114602 at SEQ ID NO. 2394 with e-value of 1.80E-139 and BLAST sequence identity of 65.8
MPSRIHHGVADERHDIRHYLEVEVQPKVSESEAINPQSNYSKCFDDDGRLKRTGNFWTSSSHIITAVIGSGVLSLAWAIAQLGWVAGPAVMVLFAFVNLYTSNLLAQCYRRTEGDVMWIDSILEFVWCCYWLYDCSISQHDIPDFDQVWWLSIVAAIMSFTYSTVGLGLGIGKVAGNGTFKGSLTGISIGTETHAGPVTSTQKLWRSLQALGAIAFAYSFSIILIEIQDTIRSPPAEYKTMKKATLFSIIITTIFYLLCGCMGYAAFGDLAPGNLLTGFGFYNPYWLLDIANVAIVVHLVGAYQVYCQPLFAFVEKWSARKWPKSDFVTAEYEVPIPFYGVYQLNFFRLVWRTIFVMLTTLIAMLMPFFNDVVGLLGSMGFWPLTVFFPIEMYISQKKIGRWTSQWIGLQILSMTCLMITIAAAVGSVAGVVLDLKTYKPFKTSY

SEQ ID NO: 2359 - DNA, 1368 bp, Populus balsamifera subsp. trichocarpa
  misc_feature (1)..(1368): Ceres ANNOT ID no. 1540271
  misc_feature 264914:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
atggagatggatgcgagtagtgctgatgatgggcgcatcagaacagggactgtgtggactgcaactgcccatgccttcacagctattgtcggttctggaatattggcactgccatggagtgttgctcaactgggttggatcctcggaccattttttctggttttctttgctgctgttacatattatatagctatccttttatgtgactgctatagaactcctgaccctgttaaaggaaggaggaactacacgtatatggatgctgtcagagcactattaggtccaaaacatgtactgatcagtggtataatgcaatattctatgctatggggaataatgattggcttcacaataacaactgccattagtacagcgacaatcaagaggtcagcctgtttccatgagaaaggcgctaacgcaaaatgtaaggtgtccggaaattcatacatgcttgcttttggggcgttggaaattcttctatctcaatttccaaacttggaaaaagtaacatttctctcagtaatttcaacactgacctcacttgcatatgcactcattgctctgtgtctatccattgcaaaattctccatccaacatgaggctaaagggactataaaggttgccatggccggcgaggacttggctacatccaccaaaatctggcaggtctttcaagctcttggtaatattgcattttcctacacctattccatgctgctactcgaaattcaggcagaaaacaaggcaatgaagagggttacattatatgccattggtggaactgcactgttctacacttccttgggatgcatggggtatgctgcttttggagctgatgttcctggaaattatctcactgggttttacaaaccactttggcttgttgatattgcaaatcttgctgtgatcatacatctgattgttggatatcaggtgtttgcccaaacaatttttgcaatgaatgagaagtcgcttgcaacaagatggcaagctcacggttctttcttcaataagatttataccgtaaggttgcaatgcaaacaagattattcatttcagtttacaccaagcaggcttcttctaaggacaggttttgttatttttacaactttggtagcaatgatgttcccattcttcaatgccattttgggtcttctgggctccatttctttctggccattaactgtctacttccccttgaacatgtacatggttcaagcaaacatcaagagaggagattctacatggataatgtttcaagttctgagcttattgtgcttggttgtctcactggtttctgttattggttctgtggctggcatgctagagcatcttaagcatgcccagctatttcatattaacctttag

SEQ ID NO: 2360 - protein, 453 aa, Populus balsamifera subsp. trichocarpa
  misc_feature (1)..(453): Ceres ANNOT ID no. 1540271
  misc_feature (12)..(441): Pfam Name: Aa_trans Pfam Description: Transmembrane amino acid transporter protein
  misc_feature: SWISSPROT Homolog: MTR_NEUCR N amino acid transport system protein (Methyltryptophan resistance protein) with e-value of 4.8e-06 and BLAST sequence identity of 32.3
  misc_feature: SWISSPROT Homolog: AVT3_YEAST Vacuolar amino acid transporter 3 with e-value of 5.6e-06 and BLAST sequence identity of 20.9
  misc_feature 265027:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature (1)..(453): Functional Homolog of  Ceres CLONE ID no. 114602 at SEQ ID NO. 2394 with e-value of 6.09E-114 and BLAST sequence identity of 50.5
MDASSADDGRIRTGTVWTATAHAFTAIVGSGILALPWSVAQLGWILGPFFLVFFAAVTYYIAILLCDCYRTPDPVKGRRNYTYMDAVRALLGPKHVLISGIMQYSMLWGIMIGFTITTAISTATIKRSACFHEKGANAKCKVSGNSYMLAFGALEILLSQFPNLEKVTFLSVISTLTSLAYALIALCLSIAKFSIQHEAKGTIKVAMAGEDLATSTKIWQVFQALGNIAFSYTYSMLLLEIQAENKAMKRVTLYAIGGTALFYTSLGCMGYAAFGADVPGNYLTGFYKPLWLVDIANLAVIIHLIVGYQVFAQTIFAMNEKSLATRWQAHGSFFNKIYTVRLQCKQDYSFQFTPSRLLLRTGFVIFTTLVAMMFPFFNAILGLLGSISFWPLTVYFPLNMYMVQANIKRGDSTWIMFQVLSLLCLVVSLVSVIGSVAGMLEHLKHAQLFHINL

SEQ ID NO: 2361 - protein, 286 aa, Arabidopsis thaliana
  misc_feature (1)..(286): Ceres CLONE ID no. 115924
  misc_feature (1)..(286): Also Known As Ceres CDNA ID no. 23370629
  misc_feature (1)..(286): Also Known As Ceres GEMINI ID 539B6
  misc_feature (17)..(68): Pfam Name: Myb_DNA-binding Pfam Description: Myb-like DNA-binding domain
  misc_feature 265188:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: INFLORESCENCE - Short Useful for modulating plant height
MEADNGGPNSSHASKQRLRWTHELHERFVDAVAQLGGPDRATPKGVLRVMGVQGLTIYHVKSHLQKYRLAKYLPDSSSEGKKTDKKESGDMLSGLDGSSGMQITEALKLQMEVQKRLHEQLEVQRQLQLRIEAQGKYLKKIIEEQQRLSGVLGEPSAPVTGDSDPATPAPTSESPLQDKSGKDCGPDKSLSVDESLSSYREPLTPDSGCNIGSPDESTGEERLSKKPRLVRGAAGYTPDIVVGHPILESGLNTSYHQSDHVLAFDQPSTSLLGAEEQLDKVSGDNL

SEQ ID NO: 2362 - DNA, 1251 bp, Populus balsamifera subsp. trichocarpa
  misc_feature (1)..(1251): Ceres ANNOT ID no. 1453127
  misc_feature 265274:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: INFLORESCENCE - Short Useful for modulating plant height
atgggaaagcagcagcagcagcagctccgaaattccagcaagatcagcaaaggtacaggggatgggattaacaagagtccgacgatagatctggggagaaatcttggtggaaataaccttgaattcattgcagcagccagagatagtgttgaggatcaattggggtcccaatcacttcccttttctattcagcttagttttcaacaaccccttttgcggaaccaaagatcaactctttctttgcgttattcaacatctttaaggtcagggtgtggaatattgctggagagcgttcctagttcaagttcggtccataaaaacttattagttaatgatcagtatttagattgtgatgatatgacaatggatcccatcaatggagggaacaatctcaacaacaatcctaatcttgcctcaaagcaaagattgcgttggactcatgagcttcacgaacgctttgttgatgctgtggctcagcttggtgggccagatcgggctacgcctaaaggtgttcttagagtcatgggtgtgcaaggcttaacaatataccatgttaaaagccatttacagaaatatcgacttgcaaaataccttcctgactcctcatctgatgggaaaaaagcggacaagaaggaaacaggggatatgatttccaatttggatggttcatctggcatgcaaattacagaagcactcaagctgcagatggaggtacagagacagctacaattacgcatagaagcccaagggaagtatttgaagaagataattgaagagcaacaacgattgagtggagttcttgaagatgtgcctggctcgggggtcactgccccagtatcaggtgataactgcccagaatctgacaagacagacccagcaacccctgccccaacttctgaatcacccctccaagacaaggctgccaaggaacgtgccccagcaaagagcctttcaattgatgaatcattctcttctcagcctgagccactgacaccagattcacgttgcaatgctggctccccagcagagagccctagaggtgagagatctatgaagaagcaacgggtaagcatgggtgtaacatatggtaaacaagagatggttcttacacaccagatactcgagtcaagcttaaattcctatccacgaccacactctgccttcctgggtagagagcagtttgatccttcatctgggttatcaatgggaatcgaagatcaaatggagaaagtttcaggcagtgatgtttag

SEQ ID NO: 2363 - protein, 295 aa, Populus balsamifera subsp. trichocarpa
  misc_feature (1)..(295): Ceres ANNOT ID no. 1453127
  misc_feature (21)..(72): Pfam Name: Myb_DNA-binding Pfam Description: Myb-like DNA-binding domain
  misc_feature: SWISSPROT Homolog: MYBF_ARATH Putative Myb family transcription factor At1g14600 with e-value of 2.2e-12 and BLAST sequence identity of 69.2
  misc_feature: SWISSPROT Homolog: ARR18_ARATH Two-component response regulator ARR18 with e-value of 1.1e-09 and BLAST sequence identity of 32.4
  misc_feature: SWISSPROT Homolog: ARR11_ARATH Two-component response regulator ARR11 (Receiver-like protein 3) with e-value of 3.0e-09 and BLAST sequence identity of 46.8
  misc_feature: SWISSPROT Homolog: ARR14_ARATH Two-component response regulator ARR14 with e-value of 4.8e-09 and BLAST sequence identity of 45.5
  misc_feature: SWISSPROT Homolog: ARR1_ARATH Two-component response regulator ARR1 with e-value of 1.4e-08 and BLAST sequence identity of 36.2
  misc_feature 265390:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: INFLORESCENCE - Short Useful for modulating plant height
  misc_feature (1)..(295): Functional Homolog of  Ceres CLONE ID no. 115924 at SEQ ID NO. 2405 with e-value of 1.39E-91 and BLAST sequence identity of 73.5
MDPINGGNNLNNNPNLASKQRLRWTHELHERFVDAVAQLGGPDRATPKGVLRVMGVQGLTIYHVKSHLQKYRLAKYLPDSSSDGKKADKKETGDMISNLDGSSGMQITEALKLQMEVQRQLQLRIEAQGKYLKKIIEEQQRLSGVLEDVPGSGVTAPVSGDNCPESDKTDPATPAPTSESPLQDKAAKERAPAKSLSIDESFSSQPEPLTPDSRCNAGSPAESPRGERSMKKQRVSMGVTYGKQEMVLTHQILESSLNSYPRPHSAFLGREQFDPSSGLSMGIEDQMEKVSGSDV

SEQ ID NO: 2364 - DNA, 888 bp, Populus balsamifera subsp. trichocarpa
  misc_feature (1)..(888): Ceres ANNOT ID no. 1506261
  misc_feature 265487:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: INFLORESCENCE - Short Useful for modulating plant height
atggatcccatcaatggagggaacaatctcaacaacaatcctaatcttgcctcaaagcaaagattgcgttggactcatgagcttcacgaacgctttgttgatgctgtggctcagcttggtgggccagatcgggctacgcctaaaggtgttcttagagtcatgggtgtgcaaggcttaacaatataccatgttaaaagccatttacagaaatatcgacttgcaaaataccttcctgactcctcatctgatgggaaaaaagcggacaagaaggaaacaggggatatgatttccaatttggatggttcatctggcatgcaaattacagaagcactcaagctgcagatggaggtacagagacagctacaattacgcatagaagcccaagggaagtatttgaagaagataattgaagagcaacaacgattgagtggagttcttgaagatgtgcctggctcgggggtcactgccccagtatcaggtgataactgcccagaatctgacaagacagacccagcaacccctgccccaacttctgaatcacccctccaagacaaggctgccaaggaacgtgccccagcaaagagcctttcaattgatgaatcattctcttctcagcctgagccactgacaccagattcacgttgcaatgctggctccccagcagagagccctagaggtgagagatctatgaagaagcaacgggtaagcatgggtgtaacatatggtaaacaagagatggttcttacacaccagatactcgagtcaagcttaaattcctatccacgaccacactctgccttcctgggtagagagcagtttgatccttcatctgggttatcaatgggaatcgaagatcaaatggagaaagtttcaggcagtgatgtttag

SEQ ID NO: 2365 - protein, 295 aa, Populus balsamifera subsp. trichocarpa; identical to SEQ ID NO: 2363
  misc_feature (1)..(295): Ceres ANNOT ID no. 1506261
  misc_feature (21)..(72): Pfam Name: Myb_DNA-binding Pfam Description: Myb-like DNA-binding domain
  misc_feature: SWISSPROT Homolog: MYBF_ARATH Putative Myb family transcription factor At1g14600 with e-value of 2.2e-12 and BLAST sequence identity of 69.2
  misc_feature: SWISSPROT Homolog: ARR18_ARATH Two-component response regulator ARR18 with e-value of 1.1e-09 and BLAST sequence identity of 32.4
  misc_feature: SWISSPROT Homolog: ARR11_ARATH Two-component response regulator ARR11 (Receiver-like protein 3) with e-value of 3.0e-09 and BLAST sequence identity of 46.8
  misc_feature: SWISSPROT Homolog: ARR14_ARATH Two-component response regulator ARR14 with e-value of 4.8e-09 and BLAST sequence identity of 45.5
  misc_feature: SWISSPROT Homolog: ARR1_ARATH Two-component response regulator ARR1 with e-value of 1.4e-08 and BLAST sequence identity of 36.2
  misc_feature 265591:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: INFLORESCENCE - Short Useful for modulating plant height
  misc_feature (1)..(295): Functional Homolog of  Ceres CLONE ID no. 115924 at SEQ ID NO. 2405 with e-value of 1.39E-91 and BLAST sequence identity of 73.5

SEQ ID NO: 2366 - DNA, 870 bp, Populus balsamifera subsp. trichocarpa
  misc_feature (1)..(870): Ceres ANNOT ID no. 1480332
  misc_feature 265688:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: INFLORESCENCE - Short Useful for modulating plant height
atggatcccatcaatggagggaacagtctcaacaacaatcctaatcttgcctcaaagcaacgattgcgttggactcatgagcttcacgaacgctttgttgatgctgtggctcagcttggtgggccagatcgggctacacctaaaggtgttctcagagtcatgggtgtgcaaggcttaacaatttaccataaatatcgacttgcaaaataccttcccgactcctcatccgatgggaaaaaagtggacaagaaggaaacaggggatgtgctttccaattcggatggttcttctggaatgcaaattacagaagcactcaagctgcagatggaggtgcagagacagctacaattacgcatagaagcccaagggaagtatttgaagaagataattgaagagcaacaacgattgagcggagttcttgaagatgtgcctggttcaggggtctctgccccagtatcaggtgacaactgcccagtatctgacaacaaaacagacccagcaacccctgccccaacttctgaatcacccctccaagacaaggttgccaaggaatgtgccccaacaaagagcctttcaattgatgaatcattctcctctcagcacgagccattaacaccagattcacgttgcaatactggttccccagcagagagccctagaggtgagaggtcactgaagaagcaaatggtaagcatgggtgtagcatttggtaaaccagagatggttcttacacaccagatattggagtcgagcttaaattcctatccacaaccgcactctgccttcttgaccagagagcaattcgatccttcatctgggttatcaatgggaaacgaagatcaatcggaggtcttaggcagtgacctttag

SEQ ID NO: 2367 - protein, 289 aa, Populus balsamifera subsp. trichocarpa
  misc_feature (1)..(289): Ceres ANNOT ID no. 1480332
  misc_feature (21)..(69): Pfam Name: Myb_DNA-binding Pfam Description: Myb-like DNA-binding domain
  misc_feature: SWISSPROT Homolog: MYBF_ARATH Putative Myb family transcription factor At1g14600 with e-value of 2.2e-12 and BLAST sequence identity of 69.2
  misc_feature: SWISSPROT Homolog: ARR18_ARATH Two-component response regulator ARR18 with e-value of 1.1e-09 and BLAST sequence identity of 32.4
  misc_feature: SWISSPROT Homolog: ARR11_ARATH Two-component response regulator ARR11 (Receiver-like protein 3) with e-value of 3.0e-09 and BLAST sequence identity of 46.8
  misc_feature: SWISSPROT Homolog: ARR14_ARATH Two-component response regulator ARR14 with e-value of 4.8e-09 and BLAST sequence identity of 45.5
  misc_feature: SWISSPROT Homolog: ARR1_ARATH Two-component response regulator ARR1 with e-value of 1.4e-08 and BLAST sequence identity of 36.2
  misc_feature 265792:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: INFLORESCENCE - Short Useful for modulating plant height
  misc_feature (1)..(289): Functional Homolog of  Ceres CLONE ID no. 115924 at SEQ ID NO. 2405 with e-value of 3.99E-85 and BLAST sequence identity of 74.5
MDPINGGNSLNNNPNLASKQRLRWTHELHERFVDAVAQLGGPDRATPKGVLRVMGVQGLTIYHKYRLAKYLPDSSSDGKKVDKKETGDVLSNSDGSSGMQITEALKLQMEVQRQLQLRIEAQGKYLKKIIEEQQRLSGVLEDVPGSGVSAPVSGDNCPVSDNKTDPATPAPTSESPLQDKVAKECAPTKSLSIDESFSSQHEPLTPDSRCNTGSPAESPRGERSLKKQMVSMGVAFGKPEMVLTHQILESSLNSYPQPHSAFLTREQFDPSSGLSMGNEDQSEVLGSDL

SEQ ID NO: 2368 - DNA, 774 bp, Populus balsamifera subsp. trichocarpa
  misc_feature (1)..(774): Ceres ANNOT ID no. 1454197
  misc_feature 265889:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: INFLORESCENCE - Short Useful for modulating plant height
atgggttcaagtcgctccgatgtatccaacaaagaaagattgcgctggacgcaagaactgcacgatcggttcgaggaggctgttaatcaacttggtggtcctgatagagcaacaccaaagggtatcttgagggctatgggcatctctgggttgactatctaccatgtcaagagccatttgcagaaatacagaatatcgaagtttatcccagaaaccaacagagggaagtatgaaaggagaaatatttcagaaatgttgccaaatttcagtgcgacatctggagctcagctcaatgaagcattactgatgcaaatggaggttcaaaagcgactgagcgatcaacttgaggttcaaaagagcttgaagattaagattgaagcccaagggagattccttgagagaatcgtggaggaaaacagaaaccgaagtgcgtccattaatccaatcccaaaacatagcaagtctttctctccagtatcacagccgtctttctgtgatgaatcagaatcaaatgctagagaatttgaaactgattcggagggtgagaaagctgaaatacagcctgaagaataccttcaagctcttaagagattgaggacagaaaaccatgctttaccttcgcggtatcaactccaacctctaaatcctgatccttacaatcaaaacatggttcttcaaagagatgcaaaattttcatatccatctcacgatgccaacttcccatggaacattttggccacctgtccatcacctctagtgcccagttttttctaa

SEQ ID NO: 2369 - protein, 257 aa, Populus balsamifera subsp. trichocarpa
  misc_feature (1)..(257): Ceres ANNOT ID no. 1454197
  misc_feature (13)..(64): Pfam Name: Myb_DNA-binding Pfam Description: Myb-like DNA-binding domain
  misc_feature: SWISSPROT Homolog: MYBF_ARATH Putative Myb family transcription factor At1g14600 with e-value of 2.2e-12 and BLAST sequence identity of 69.2
  misc_feature: SWISSPROT Homolog: ARR18_ARATH Two-component response regulator ARR18 with e-value of 1.1e-09 and BLAST sequence identity of 32.4
  misc_feature: SWISSPROT Homolog: ARR11_ARATH Two-component response regulator ARR11 (Receiver-like protein 3) with e-value of 3.0e-09 and BLAST sequence identity of 46.8
  misc_feature: SWISSPROT Homolog: ARR14_ARATH Two-component response regulator ARR14 with e-value of 4.8e-09 and BLAST sequence identity of 45.5
  misc_feature: SWISSPROT Homolog: ARR1_ARATH Two-component response regulator ARR1 with e-value of 1.4e-08 and BLAST sequence identity of 36.2
  misc_feature 265989:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: INFLORESCENCE - Short Useful for modulating plant height
  misc_feature (1)..(257): Functional Homolog of  Ceres CLONE ID no. 115924 at SEQ ID NO. 2405 with e-value of 5.39E-42 and BLAST sequence identity of 57.7
MGSSRSDVSNKERLRWTQELHDRFEEAVNQLGGPDRATPKGILRAMGISGLTIYHVKSHLQKYRISKFIPETNRGKYERRNISEMLPNFSATSGAQLNEALLMQMEVQKRLSDQLEVQKSLKIKIEAQGRFLERIVEENRNRSASINPIPKHSKSFSPVSQPSFCDESESNAREFETDSEGEKAEIQPEEYLQALKRLRTENHALPSRYQLQPLNPDPYNQNMVLQRDAKFSYPSHDANFPWNILATCPSPLVPSFF

SEQ ID NO: 2370 - protein, 612 aa, Arabidopsis thaliana
  misc_feature (1)..(612): Ceres CLONE ID no. 115946
  misc_feature (1)..(612): Also Known As Ceres CDNA ID no. 23363175
  misc_feature (1)..(612): Also Known As Ceres GEMINI ID 552A12
  misc_feature (316)..(392): Pfam Name: Helicase_C Pfam Description: Helicase conserved C-terminal domain
  misc_feature (58)..(234): Pfam Name: DEAD Pfam Description: DEAD/DEAH box helicase
  misc_feature 266106:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: INFLORESCENCE - Reduced Apical Dominance Useful for modifying plant structure, ie increased branching
  misc_feature: Phenotype: ROSETTE LEAVES - Oval Shaped Useful for making plants with increased biomass and foliage
QGYCKVKAGSEQREAAAAVMDSSANINKALTETRFSDLEPPLSGDIIEALNQSDFEFCTPVQAATIPLLCSYKDVAVDAATGSGKTLAFVVPLVEILRRSTSFPPKPHQVMGVIISPTRELSTQIYNVAQPFVSTLANVNSVLLVGGREVKADMKIIEEEGCNVLIGTPGRLSDIMERMEILDFRNLEILILDEADRLLEMGFQRQVNYIISRLPKQRRTGLFSATQTEGVEELAKAGLRNPVRVEVRAKSKSESSQQLTNSKTPSGLHLEYMECEADKKSSQLVDLLIKNSDKKLIVFFMTCASVDYWGLVLSKIPALKSISLIPIHGDMKQNARDKALASFTKASSGALLCTDVAARGLDIPGIDYVVQYDPPQDPNMFNHRAGRTARLGRQGRAIVFLLPKEEAYVEFMRIRRVPLEERKCSEDASDVIPIIRSAAMKDRAVMEKGLKAFVSFVRAYKEHHCSFIFRWKDLEIGKLAMGYGLLYLPSMSEVKQHRLSSEGFTPVEGVKFEEIKFKDKYREKQRQQNLQVRKEKRQEEKKEKGKRKRVDASASNDPKKASRKLTGKQRQTIQTAEDEEVMDRDYKLMIKVKKGLIKEDEYERLTGDDDLF

SEQ ID NO: 2371 - DNA, 1779 bp, Populus balsamifera subsp. trichocarpa
  misc_feature (1)..(1779): Ceres ANNOT ID no. 1458342
  misc_feature 266277:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: INFLORESCENCE - Reduced Apical Dominance Useful for modifying plant structure, ie increased branching
  misc_feature: Phenotype: ROSETTE LEAVES - Oval Shaped Useful for making plants with increased biomass and foliage
atggacaccaccgaatcaccgaacccaaacagagcattaacgaacacccgcttctccgatttaaagccttcaatatccgagcccgttctcgaagccttaaccaattccgggttcgactactgcacaccggttcaagccgctactatccctttactatgcagctacaaagacgtagcagtcgacgccgccactggatccggaaaaactctagcttttgttgtacctctcgtcgaaattcttcgccgatcctcttctcccaaacctcaccaggtgatgggaataattatttctcctacaagggagttatcgtcgcaaatatataatgttgcacaaccttttattgcaaccttatcaaattttaagtccatgctacttgttggaggcatggatgtaaaagctgatgtgaagatgatagaggaggaaggggctaatttgttgataggaacacctgggaggctgtttgatataatggatcgtgtggatgtcttggactttagaaacctcgaggttttgattttagatgaggctgataggctattggatatgggattccagaagcagctaaactccattatatctcgcttacccaagcttcgtagaactggccttttctcagctactcaaaccgaggctgttgaagagctatccaaagctggactgaggaatcctgtgaaagttgaagttcgagctgaaacaaaatcattaaataactcagtgtctggtcaacaattagcaccttccaaaacaccatcaggccttctacttgagtatctggaatgtgaagcagataagaaaccgtctcagcttgttgatctccttgttaagaacaaatctaaaaaaattatcatatacttcatgacatgtgcttgtgtcgattactggggggttgttcttccacgtctcactgtattgaatggcttctctctgatatctcttcatgggaagatgaagcagacagcaagagagaaagcattgacttcatttacatctctcacaagtggcattcttctgtgcactgatgttgctgcacgtggacttgacattcccggtgtggactgtatagtgcagtacgatccccctcaagacccaaatgtctttgttcatagagttggtcgaactgctcggttgggtaggcaaggaagttccattgtttttctgttgccaaaggaggaagcttatgtggaattcctgcgcataagaagggttcctcttctggaaaggaaatgtgcagatgatgcaccagatgttgttccgcagatacgatctgctgctaaaaaggaccgtgatgtcatggagaaaggactgagagcatttgtttcgtacattcgtgcatataaagaacaccactgctcttacattttcaggtggaaagaacttgaagttgggaagttgggcatgggatatggcttattacagctcccatcaatgccagaggtaaagcaccactcactttcaaccaaggatttcactccagttgacgacctcaatttagaggagatcaagtacaaggataaatctcgtcagaaacaaagacggaaaaatttgcaagccaagaaagaagcacggcagcaagaatcaaaaccccaaaaggtaagcaagacccccagtgctgcagctactgccatgagaaagaaaactgctaaacagagacgagctgcccagacagttgaggatgaagaagagttggctcgggaatatcgtttattgaaaaaactgaagaaggggacaattgatgaaagcgaatttgaaaagttgacaggaaccgatgaactactttga

SEQ ID NO: 2372 - protein, 592 aa, Populus balsamifera subsp. trichocarpa
  misc_feature (1)..(592): Ceres ANNOT ID no. 1458342
  misc_feature (301)..(377): Pfam Name: Helicase_C Pfam Description: Helicase conserved C-terminal domain
  misc_feature (41)..(215): Pfam Name: DEAD Pfam Description: DEAD/DEAH box helicase
  misc_feature: SWISSPROT Homolog: SPB4_NEUCR ATP-dependent rRNA helicase spb-4 (EC 3.6.1.-) with e-value of 1.5e-96 and BLAST sequence identity of 38.9
  misc_feature: SWISSPROT Homolog: SPB4_GIBZE ATP-dependent rRNA helicase SPB4 (EC 3.6.1.-) with e-value of 6.6e-96 and BLAST sequence identity of 38.6
  misc_feature: SWISSPROT Homolog: SPB4_ASPOR ATP-dependent rRNA helicase spb4 (EC 3.6.1.-) with e-value of 2.2e-95 and BLAST sequence identity of 37.5
  misc_feature: SWISSPROT Homolog: SPB4_EMENI ATP-dependent rRNA helicase spb4 (EC 3.6.1.-) with e-value of 3.2e-94 and BLAST sequence identity of 35.7
  misc_feature: SWISSPROT Homolog: SPB4_ASPFU ATP-dependent rRNA helicase spb4 (EC 3.6.1.-) with e-value of 5.2e-94 and BLAST sequence identity of 36.6
  misc_feature 266443:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: INFLORESCENCE - Reduced Apical Dominance Useful for modifying plant structure, ie increased branching
  misc_feature: Phenotype: ROSETTE LEAVES - Oval Shaped Useful for making plants with increased biomass and foliage
  misc_feature (1)..(592): Functional Homolog of  Ceres CLONE ID no. 115946 at SEQ ID NO. 2414 with e-value of 4.70E-226 and BLAST sequence identity of 72.8
MDTTESPNPNRALTNTRFSDLKPSISEPVLEALTNSGFDYCTPVQAATIPLLCSYKDVAVDAATGSGKTLAFVVPLVEILRRSSSPKPHQVMGIIISPTRELSSQIYNVAQPFIATLSNFKSMLLVGGMDVKADVKMIEEEGANLLIGTPGRLFDIMDRVDVLDFRNLEVLILDEADRLLDMGFQKQLNSIISRLPKLRRTGLFSATQTEAVEELSKAGLRNPVKVEVRAETKSLNNSVSGQQLAPSKTPSGLLLEYLECEADKKPSQLVDLLVKNKSKKIIIYFMTCACVDYWGVVLPRLTVLNGFSLISLHGKMKQTAREKALTSFTSLTSGILLCTDVAARGLDIPGVDCIVQYDPPQDPNVFVHRVGRTARLGRQGSSIVFLLPKEEAYVEFLRIRRVPLLERKCADDAPDVVPQIRSAAKKDRDVMEKGLRAFVSYIRAYKEHHCSYIFRWKELEVGKLGMGYGLLQLPSMPEVKHHSLSTKDFTPVDDLNLEEIKYKDKSRQKQRRKNLQAKKEARQQESKPQKVSKTPSAAATAMRKKTAKQRRAAQTVEDEEELAREYRLLKKLKKGTIDESEFEKLTGTDELL

SEQ ID NO: 2373 - protein, 331 aa, Arabidopsis thaliana
  misc_feature (1)..(331): Ceres CLONE ID no. 115975
  misc_feature (36)..(108): Pfam Name: Saccharop_dh Pfam Description: Saccharopine dehydrogenase
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
MGLYSLITGRKGPSGFGSASTAEEVTQGIDATNLTAIITGGTGGIGMETARVLSKRGAHVVIGARNMGAAENAKTEILRQNANARVTLLQLDLSSIKSIKAFVREFHALHLPLNLLINNAGVMFCPYQLSEDGIELQFATNHIGHFLLTNLLLDTMKNTAKTSGVEGRILNVSSVAHIYTYQEGIQFDSINDICSYSDKRAYGQSKLANILHANELSRQLQEEGVNITANSVHPGLILTNLFQHTALLMRFLKFFSFYLWKNIPQGAATTCYVALHPSVKGVTGRYFADCNEVTPSKLARDETLAQKLWDFSVKLINSVSKKNYLGFDDTT

SEQ ID NO: 2374 - DNA, 930 bp, Populus balsamifera subsp. trichocarpa
  misc_feature (1)..(930): Ceres ANNOT ID no. 1507138
  misc_feature 266738:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
atgagtttcttttcgttagtgacaggaaggcctggtactagtgggtttggatcagcttctactgctgagcaggttacacaggggatcgatgcttccaatcttactgtccttatcactggtggagcaagtggaattggtttggagacgacaagagtgctggctttacataaagcccatgtcattattgctgccaggaacatggttgctgcaaacgaagctaaacaacttattcttaaagaggatgaagatgcccgtgttgatgtcctaaaacttgatctgtcctctatcaaatccattagagaattcgctgataacttaaattctctcgatctgcctctcaacatcttaattaacaatgctggcatcatgttttgcccctaccagctctcagaagatggaatagagatgcaatttgccacaaatcacctgggtcattttctcttgacaaatctgctccttgacaaaatgaaagagaccgcaagaaccaccggtgtcgaggggaggattgtgaatttgtcatcagttgcccacattcacacttacaaagatgggatccggttcaataatattaatgacaagaagagatattctgacaaaagggcttatggccaatccaagttggcaaacatactgcatgccaaagagctttcccgtcgctttcaggaagagggtgtgaacattactgcaaatgcagtccatccagggttgattatgacaaatctcttcaaacactctgcaattttaatgagtaaatatggggcagccacaacatgctacgtcgcgttgcacccgagcttgaaaggtgttaccggtaaatactatgtggactgcaatagcttggggcccagtgcatttgctagagatgaagcattggcaaggaaactgtgggacttcagcaacaagctgattacttctgtttcaaaagcttga

SEQ ID NO: 2375 - protein, 309 aa, Populus balsamifera subsp. trichocarpa
  misc_feature (1)..(309): Ceres ANNOT ID no. 1507138
  misc_feature (34)..(185): Pfam Name: adh_short Pfam Description: short chain dehydrogenase
  misc_feature: SWISSPROT Homolog: RDH12_MOUSE Retinol dehydrogenase 12 (EC 1.1.1.-) with e-value of 6.0e-53 and BLAST sequence identity of 40.5
  misc_feature: SWISSPROT Homolog: RDH14_MOUSE Retinol dehydrogenase 14 (EC 1.1.1.-) (Alcohol dehydrogenase PAN2) with e-value of 3.3e-52 and BLAST sequence identity of 41.4
  misc_feature: SWISSPROT Homolog: RDH14_HUMAN Retinol dehydrogenase 14 (EC 1.1.1.-) (Alcohol dehydrogenase PAN2) with e-value of 4.2e-52 and BLAST sequence identity of 41.6
  misc_feature: SWISSPROT Homolog: RDH11_HUMAN Retinol dehydrogenase 11 (EC 1.1.1.-) Retinal reductase 1 (RalR1) with e-value of 2.7e-50 and BLAST sequence identity of 40.5
  misc_feature: SWISSPROT Homolog: RDH11_HUMAN Prostate short-chain dehydrogenase/reductase 1 Androgen-regulated short-chain dehydrogenase/reductase 1 HCV core-binding protein HCBP12
  misc_feature: SWISSPROT Homolog: RDH12_BOVIN Retinol dehydrogenase 12 with e-value of 5.6e-50 and BLAST sequence identity of 41.4
  misc_feature: SWISSPROT Homolog: RDH12_BOVIN EC 1.1.1.- (Double substrate specificity short chain dehydrogenase/reductase 2)
  misc_feature 266885:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature (1)..(309): Functional Homolog of  Ceres CLONE ID no. 115975 at SEQ ID NO. 2417 with e-value of 1.20E-115 and BLAST sequence identity of 73.0
MSFFSLVTGRPGTSGFGSASTAEQVTQGIDASNLTVLITGGASGIGLETTRVLALHKAHVIIAARNMVAANEAKQLILKEDEDARVDVLKLDLSSIKSIREFADNLNSLDLPLNILINNAGIMFCPYQLSEDGIEMQFATNHLGHFLLTNLLLDKMKETARTTGVEGRIVNLSSVAHIHTYKDGIRFNNINDKKRYSDKRAYGQSKLANILHAKELSRRFQEEGVNITANAVHPGLIMTNLFKHSAILMSKYGAATTCYVALHPSLKGVTGKYYVDCNSLGPSAFARDEALARKLWDFSNKLITSVSKA

SEQ ID NO: 2376 - protein, 379 aa, Arabidopsis thaliana
  misc_feature (1)..(379): Ceres CLONE ID no. 116117
  misc_feature (5)..(74): Pfam Name: RRM_1 Pfam Description: RNA recognition motif. (a.k.a. RRM RBD, or RNP domain)
  misc_feature: Phenotype: WHOLE PLANT - Small Useful for modulating plant size
  misc_feature: Phenotype: INFLORESCENCE - Short Useful for modulating plant height
MERKLVVLGIPWDIDSDGLKDYMSKFGDLEDCIVMKDRSTGRSRGFGYVTFASAEDAKNALKGEHFLGNRILEVKVATPKEEMRQPAKKVTRIFVARIPSSVSESDFRSHFERYGEITDLYMPKDYNSKQHRRIGFITFSSADSVEDLMEDTHDLGGTTVAVDRATPKEDDHPPRPPPVARMSRPPVAIAGGFGAPGGYGAYDAYISAATRYAALGAPTLYDNPATFYGRGEPTTRGIGNKIFVGRLPQEASVDDLRDYFGRFGHIQDAYIPKDPKRSGHRGFGFVTFAENGVADRVARRSHEICGQEVAIDSATPLDEAGPSAGASSMLSSSRPEYFGGYGGPMRAFGRMYGGMSLDDWGYGMPNARPSRPDRRYRPY

SEQ ID NO: 2377 - DNA, 1068 bp, Populus balsamifera subsp. trichocarpa
  misc_feature (1)..(1068): Ceres ANNOT ID no. 1456955
  misc_feature 267114:<222: Transcription Factor
  misc_feature: Phenotype: WHOLE PLANT - Small Useful for modulating plant size
  misc_feature: Phenotype: INFLORESCENCE - Short Useful for modulating plant height
atggttttgggtattccatgggagattgataccgagggtttgagagaatatatgaccaaatttggtggattagaggattgtattgttatgaaggaacggtcatcaggtcgatctcgtggttttggatatgttacttttgtgtcggctgaagatgctaaggctgtgctatcaagtgaacactttcttggtaaaagaatgctggaagttaaagtggctaccccaaaggaggagatgcgagcgccttcaaaaaaagcgactaggatatttgtggccaggattccaccatctgtgacagaaactacctttcgaagtcattttgagaaatatggggagataatagacctatacatgccaaaagatcatagctcgaaagcacatcgtggaattgggttcatcacatatgcaagtgcagattctgtggataatttgatggctgaaactcatgaattgggaggctctactgtagttgaagatgattttaggccaaatggaagaatggctcctggtggatatggtgcatacaatgcttatatttctgcggctactagatatgcagctcttggtgctcccaccttgtatgatcatcctggaccattctatggaagaggggaatcatctagaggaatgggtaaaaagatctttgttggaaggcttcctcaggaagcaagtgctgaagatttgcgccagtattttggtagatttggccacatattagatgtatatgttcccaaggatcccaagagaactggccacagaggttttggatttgtaacctttgctgaagatggtgtagcagatcgtgtatctcgaagatctcatgagatttgtggacatcaggttgcaatagattcagccacacctattgatgatgctggtccaagcggaaatttcatgatgagtggtcctgaaccttttgggagttatgctggtcccatgcgcaactttggcaggatgtatggaaccctggattacgatgatgcaagtgcatatatggttccttctaaatggggttatggaatggggagtgcaagaccttcaagggcagattggaggtacaggccatactag

SEQ ID NO: 2378 - protein, 355 aa, Populus balsamifera subsp. trichocarpa
  misc_feature (1)..(355): Ceres ANNOT ID no. 1456955
  misc_feature (213)..(282): Pfam Name: RRM_1 Pfam Description: RNA recognition motif. (a.k.a. RRM RBD, or RNP domain)
  misc_feature: SWISSPROT Homolog: RB27C_DROME Heterogeneous nuclear ribonucleoprotein 27C (Hrb27-C) (hnRNP 48) (HRP48.1) with e-value of 2.0e-34 and BLAST sequence identity of 36.6
  misc_feature: SWISSPROT Homolog: ROA1_HUMAN Heterogeneous nuclear ribonucleoprotein A1 with e-value of 7.8e-32 and BLAST sequence identity of 31.4
  misc_feature: SWISSPROT Homolog: ROA1_HUMAN Helix-destabilizing protein Single-strand RNA-binding protein hnRNP core protein A1
  misc_feature: SWISSPROT Homolog: ROA3_HUMAN Heterogeneous nuclear ribonucleoprotein A3 (hnRNP A3) with e-value of 5.3e-31 and BLAST sequence identity of 33.1
  misc_feature: SWISSPROT Homolog: ROA3_MOUSE Heterogeneous nuclear ribonucleoprotein A3 (hnRNP A3) with e-value of 6.6e-31 and BLAST sequence identity of 33.1
  misc_feature: SWISSPROT Homolog: ROA3_RAT Heterogeneous nuclear ribonucleoprotein A3 (hnRNP A3) with e-value of 6.6e-31 and BLAST sequence identity of 33.1
  misc_feature 267237:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature (1)..(355): Functional Homolog of  Ceres CLONE ID no. 116117 at SEQ ID NO. 2420 with e-value of 1.60E-136 and BLAST sequence identity of 76.5
MVLGIPWEIDTEGLREYMTKFGGLEDCIVMKERSSGRSRGFGYVTFVSAEDAKAVLSSEHFLGKRMLEVKVATPKEEMRAPSKKATRIFVARIPPSVTETTFRSHFEKYGEIIDLYMPKDHSSKAHRGIGFITYASADSVDNLMAETHELGGSTVVEDDFRPNGRMAPGGYGAYNAYISAATRYAALGAPTLYDHPGPFYGRGESSRGMGKKIFVGRLPQEASAEDLRQYFGRFGHILDVYVPKDPKRTGHRGFGFVTFAEDGVADRVSRRSHEICGHQVAIDSATPIDDAGPSGNFMMSGPEPFGSYAGPMRNFGRMYGTLDYDDASAYMVPSKWGYGMGSARPSRADWRYRPY

SEQ ID NO: 2379 - DNA, 1371 bp, Populus balsamifera subsp. trichocarpa
  misc_feature (1)..(1371): Ceres ANNOT ID no. 1451365
  misc_feature 267346:<222: Transcription Factor
  misc_feature: Phenotype: WHOLE PLANT - Small Useful for modulating plant size
  misc_feature: Phenotype: INFLORESCENCE - Short Useful for modulating plant height
atggagtcatgctccactgttatgacccgatccaatacatttaggtttaggccagacccggtccagcccctgaacagtgcagacgctctccactgttcactttgcagaacagtggagacgagaaaatgcagcagaagaagaaggaggaggagaaggggaaggggaaaatgcaacaaaagaagaaaaggagcgaccacccacgactgcgagaggagagatagagagctaagatttccttcttctgtttcttttgagtcttctaagagagctattctgggtattccatgggaaattgataccgagggtctgagacaatacatgagcaagtttggtgaattagaggattgtattgttatgaagcttattttctatcaatgtctgagagtgcacaatttggagcggtcatcaggtcgatctcgtggttttggatatgtgacttttgtatccgctgaagatgctaaggctgtactatcaggtgaacactttcttggtaaaagaatgctggaaattaaagtggctactccaaaggaggagatgcgagcaccaacaaaaaaagccacaaggatatttgtggccaggattccaccatctgtgacagaaactacttttcgaagtcactttgagaaatatggggagataattgacctatacatgccaaaagatcatagctcgaaagcacatcggggaattgggttcatcacatatgcaagtgcagattctgtggacagcttgatggctgaaactcatgaattgggaggctctactgtagttgaagatgactttaggcctatagcaagaacagcacctggaggatatggtgcatacaatgcttatatttctgcagctaccagatatgcagctcttggtgctcccaccttgtatgatcatcctggaccattctatggaagaggggaatcatctagaggaatgggcaaaaagatctttgttggaaggcttcctcaggaagcaagcaccgaagatttgcgccagtattttggtagatttggccacataatagatgtatatgttcctaaggatcccaagagaactggccatagaggttttggatttgtaacctttgctgaagatggtgttgcggatcgtgtatctcgaagatctcatgagatttgtggacatcaggttgcaatagattcagccacacctattgatgatgctggtccaagtggaaatttcatgatgagcgctcctgaaccttttgggggttatggtggtcccatgcgcaactttggcaggatgtatggaaccctggattatgatgatgcgggtgcatatatggttccttctaaatggggttatggtatggggagtgcaaggccttcaagagcagattggaggtacaggccttactag

SEQ ID NO: 2380 - protein, 456 aa, Populus balsamifera subsp. trichocarpa
  misc_feature (1)..(456): Ceres ANNOT ID no. 1451365
  misc_feature (93)..(120): Pfam Name: RRM_1 Pfam Description: RNA recognition motif. (a.k.a. RRM RBD, or RNP domain)
  misc_feature: SWISSPROT Homolog: RB27C_DROME Heterogeneous nuclear ribonucleoprotein 27C (Hrb27-C) (hnRNP 48) (HRP48.1) with e-value of 2.0e-34 and BLAST sequence identity of 36.6
  misc_feature: SWISSPROT Homolog: ROA1_HUMAN Heterogeneous nuclear ribonucleoprotein A1 with e-value of 7.8e-32 and BLAST sequence identity of 31.4
  misc_feature: SWISSPROT Homolog: ROA1_HUMAN Helix-destabilizing protein Single-strand RNA-binding protein hnRNP core protein A1
  misc_feature: SWISSPROT Homolog: ROA3_HUMAN Heterogeneous nuclear ribonucleoprotein A3 (hnRNP A3) with e-value of 5.3e-31 and BLAST sequence identity of 33.1
  misc_feature: SWISSPROT Homolog: ROA3_MOUSE Heterogeneous nuclear ribonucleoprotein A3 (hnRNP A3) with e-value of 6.6e-31 and BLAST sequence identity of 33.1
  misc_feature: SWISSPROT Homolog: ROA3_RAT Heterogeneous nuclear ribonucleoprotein A3 (hnRNP A3) with e-value of 6.6e-31 and BLAST sequence identity of 33.1
  misc_feature 267479:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature (1)..(456): Functional Homolog of  Ceres CLONE ID no. 116117 at SEQ ID NO. 2420 with e-value of 1.89E-135 and BLAST sequence identity of 77.0
MESCSTVMTRSNTFRFRPDPVQPLNSADALHCSLCRTVETRKCSRRRRRRRRGRGKCNKRRKGATTHDCERRDRELRFPSSVSFESSKRAILGIPWEIDTEGLRQYMSKFGELEDCIVMKLIFYQCLRVHNLERSSGRSRGFGYVTFVSAEDAKAVLSGEHFLGKRMLEIKVATPKEEMRAPTKKATRIFVARIPPSVTETTFRSHFEKYGEIIDLYMPKDHSSKAHRGIGFITYASADSVDSLMAETHELGGSTVVEDDFRPIARTAPGGYGAYNAYISAATRYAALGAPTLYDHPGPFYGRGESSRGMGKKIFVGRLPQEASTEDLRQYFGRFGHIIDVYVPKDPKRTGHRGFGFVTFAEDGVADRVSRRSHEICGHQVAIDSATPIDDAGPSGNFMMSAPEPFGGYGGPMRNFGRMYGTLDYDDAGAYMVPSKWGYGMGSARPSRADWRYRPY

SEQ ID NO: 2381 - DNA, 1242 bp, Populus balsamifera subsp. trichocarpa
  misc_feature (1)..(1242): Ceres ANNOT ID no. 1504433
  misc_feature 267606:<222: Transcription Factor
  misc_feature: Phenotype: WHOLE PLANT - Small Useful for modulating plant size
  misc_feature: Phenotype: INFLORESCENCE - Short Useful for modulating plant height
atggagtcatgctccactgttatgacccgatccaatacatttaggtttaggccagacccggtccagcccctgaacagtgcagacgctctccactgttcactttgcagaacagtggagacgagaaaatgcagcagaagaagaaggaggaggagaaggggaaggggaaaatgcaacaaaagaagaaaaggagcgaccacccacgactgcgagaggagagatagagagctaagatttccttcttctgtttcttttgagtcttctaagagagctattctgggtattccatgggaaattgataccgagggtctgagacaatacatgagcaagtttggtgaattagaggattgtattgttatgaagcttattttctatcaatgtctgagagtgcacaatttggagcggtcatcaggtcgatctcgtggttttggatatgtgacttttgtatccgctgaagatgctaaggctgtactatcaggtgaacactttcttggtaaaagaatgctggaaattaaagtggctactccaaaggaggagatgcgagcaccaacaaaaaaagccacaaggatatttgtggccaggattccaccatctgtgacagaaactacttttcgaagtcactttgagaaatatggggagataattgacctatacatgccaaaagatcatagctcgaaagcacatcggggaattgggttcatcacatatgcaagtgcagctaccagatatgcagctcttggtgctcccaccttgtatgatcatcctggaccattctatggaagaggggaatcatctagaggaatgggcaaaaagatctttgttggaaggcttcctcaggaagcaagcaccgaagatttgcgccagtattttggtagatttggccacataatagatgtatatgttcctaaggatcccaagagaactggccatagaggttttggatttgtaacctttgctgaagatggtgttgcggatcgtgtatctcgaagatctcatgagatttgtggacatcaggttgcaatagattcagccacacctattgatgatgctggtccaagtggaaatttcatgatgagcgctcctgaaccttttgggggttatggtggtcccatgcgcaactttggcaggatgtatggaaccctggattatgatgatgcgggtgcatatatggttccttctaaatggggttatggtatggggagtgcaaggccttcaagagcagattggaggtacaggccttactag

SEQ ID NO: 2382 - protein, 406 aa, Populus balsamifera subsp. trichocarpa
  misc_feature (1)..(406): Ceres ANNOT ID no. 1504433
  misc_feature (86)..(113): Pfam Name: RRM_1 Pfam Description: RNA recognition motif. (a.k.a. RRM RBD, or RNP domain)
  misc_feature: SWISSPROT Homolog: RB27C_DROME Heterogeneous nuclear ribonucleoprotein 27C (Hrb27-C) (hnRNP 48) (HRP48.1) with e-value of 2.0e-34 and BLAST sequence identity of 36.6
  misc_feature: SWISSPROT Homolog: ROA1_HUMAN Heterogeneous nuclear ribonucleoprotein A1 with e-value of 7.8e-32 and BLAST sequence identity of 31.4
  misc_feature: SWISSPROT Homolog: ROA1_HUMAN Helix-destabilizing protein Single-strand RNA-binding protein hnRNP core protein A1
  misc_feature: SWISSPROT Homolog: ROA3_HUMAN Heterogeneous nuclear ribonucleoprotein A3 (hnRNP A3) with e-value of 5.3e-31 and BLAST sequence identity of 33.1
  misc_feature: SWISSPROT Homolog: ROA3_MOUSE Heterogeneous nuclear ribonucleoprotein A3 (hnRNP A3) with e-value of 6.6e-31 and BLAST sequence identity of 33.1
  misc_feature: SWISSPROT Homolog: ROA3_RAT Heterogeneous nuclear ribonucleoprotein A3 (hnRNP A3) with e-value of 6.6e-31 and BLAST sequence identity of 33.1
  misc_feature 267735:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature (1)..(406): Functional Homolog of  Ceres CLONE ID no. 116117 at SEQ ID NO. 2420 with e-value of 5.09E-110 and BLAST sequence identity of 78.0
MTRSNTFRFRPDPVQPLNSADALHCSLCRTVETRKCSRRRRRRRRGRGKCNKRRKGATTHDCERRDRELRFPSSVSFESSKRAILGIPWEIDTEGLRQYMSKFGELEDCIVMKLIFYQCLRVHNLERSSGRSRGFGYVTFVSAEDAKAVLSGEHFLGKRMLEIKVATPKEEMRAPTKKATRIFVARIPPSVTETTFRSHFEKYGEIIDLYMPKDHSSKAHRGIGFITYASAATRYAALGAPTLYDHPGPFYGRGESSRGMGKKIFVGRLPQEASTEDLRQYFGRFGHIIDVYVPKDPKRTGHRGFGFVTFAEDGVADRVSRRSHEICGHQVAIDSATPIDDAGPSGNFMMSAPEPFGGYGGPMRNFGRMYGTLDYDDAGAYMVPSKWGYGMGSARPSRADWRYRPY

SEQ ID NO: 2383 - protein, 353 aa, Arabidopsis thaliana
  misc_feature (1)..(353): Ceres CLONE ID no. 116237
  misc_feature (163)..(310): Pfam Name: ADH_zinc_N Pfam Description: Zinc-binding dehydrogenase
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
MANIGVVTTATNNQVILRNYVSGFPKESDLYIAATTVDLRVPPGSMAVLVKNLYLSCDPFSRIRMEKPDPSSPASLARAYSIGKPISGYGVAKAIDSGHPNYKTGDLLWGRVGWEEYSVINPTPSSHFKIHHADVPLSFYTGLLGIPGLTAYVGFYEICSPKKGETVFVSAASGAVGQLVGQFAKMAGCYVVGSASSKEKVDLLKTKFGYDDAFNYKEEHDLSAALKRCFPEGIDIYFENVGGKMLEAVLENMRTHGRIAACGMISQYNLKEPEGVHNLASIVYKRIRVQGFAAVEFFDKYSKFLDFILPYVREGKITYVEDIAQGLENGPSALIGLFHGKNVGKQLVAVARE

SEQ ID NO: 2384 - DNA, 1056 bp, Populus balsamifera subsp. trichocarpa
  misc_feature (1)..(1056): Ceres ANNOT ID no. 1455816
  misc_feature 267971:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
atggcaagtgatatcagaggtgaagtgagcaataagcaagtggtactcaagaactatgcctgtggttttccaaaagaatcagatttcgaagtgacaaccacaacaataaaactcaaagtaccagaagatagtaaaaatgctgttttgctaaagaccctatacctttcttgtgatccttacctccgtggtcgcatgagatacacgccggttaccgatcctgacttctgttcctacacccttggctcaccaatatctggatttgcagtagctacagtggttgattcggggcaccctgacttcaagaaaggtgatcttgtttgggggaggagagtaggctgggaagagtatagtttagttaccacacctgaatgcctcaccaaaatcctccatattgatgtacccctttcctactatactggaattcttggcatgcctggaatcactgcttattttggtttctttgaaatttgttctcccaagaaaggggaaagcgtctacgtttcagcggcatctggtgcagttggtcagcttgtggggcagattgctaagttgatgggttgctatgttgttggaagtgctggtagtaaagaaaaggttgaactgttgaagagcaaatttgggtttgatggtgctttcaactataaagaggaacatgacttggatgctgccttaaaaaggtacttccccgaaggcatcgacatttactttgagaatgttggggggaaaatgcttgatgctgtgcttctaaacatgagattgcgcggccgcattgctgcttgtggaatgatctcgcagtacaatcttcatcaacctgaaaccattcaaaacttgacgaatattgtttataagcggattcgaatacaagggtttgtggttatggattactttgaccagtactccaagttcttggattttattctgccttgtatcagagaagggaagattgtttatgtggaagacatagctgaaggactcgagagtggccctgctgctttgatcggcctttttagcggccgcaacatcggaaagcaagtagtgaaggttactgatgagtga

SEQ ID NO: 2385 - protein, 351 aa, Populus balsamifera subsp. trichocarpa
  misc_feature (1)..(351): Ceres ANNOT ID no. 1455816
  misc_feature (161)..(308): Pfam Name: ADH_zinc_N Pfam Description: Zinc-binding dehydrogenase
  misc_feature: SWISSPROT Homolog: P1_ARATH Probable NADP-dependent oxidoreductase P1 (EC 1.3.1.74) with e-value of 7.0e-146 and BLAST sequence identity of 75.9
  misc_feature: SWISSPROT Homolog: P2_ARATH Probable NADP-dependent oxidoreductase P2 (EC 1.3.1.74) with e-value of 3.5e-144 and BLAST sequence identity of 75.5
  misc_feature: SWISSPROT Homolog: LTB4D_CAVPO NADP-dependent leukotriene B4 12-hydroxydehydrogenase with e-value of 1.3e-55 and BLAST sequence identity of 40.4
  misc_feature: SWISSPROT Homolog: LTB4D_CAVPO EC 1.3.1.74 (LTB4) (12-HD) 15- oxoprostaglandin 13-reductase (EC 1.3.1.48) (PGR)
  misc_feature: SWISSPROT Homolog: YNCB_ECOLI Putative NADP-dependent oxidoreductase yncB (EC 1.-.-.-) with e-value of 4.6e-55 and BLAST sequence identity of 38.5
  misc_feature: SWISSPROT Homolog: LTB4D_RABIT NADP-dependent leukotriene B4 12-hydroxydehydrogenase(EC 1.3.1.74) (ADRAB-F) (15-oxoprostaglandin 13-reductase) (EC 1.3.1.48) with e-value of 1.2e-54 and BLAST sequence identity of 39.5
  misc_feature 268106:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature (1)..(351): Functional Homolog of  Ceres CLONE ID no. 116237 at SEQ ID NO. 2427 with e-value of 8.00E-128 and BLAST sequence identity of 69.7
MASDIRGEVSNKQVVLKNYACGFPKESDFEVTTTTIKLKVPEDSKNAVLLKTLYLSCDPYLRGRMRYTPVTDPDFCSYTLGSPISGFAVATVVDSGHPDFKKGDLVWGRRVGWEEYSLVTTPECLTKILHIDVPLSYYTGILGMPGITAYFGFFEICSPKKGESVYVSAASGAVGQLVGQIAKLMGCYVVGSAGSKEKVELLKSKFGFDGAFNYKEEHDLDAALKRYFPEGIDIYFENVGGKMLDAVLLNMRLRGRIAACGMISQYNLHQPETIQNLTNIVYKRIRIQGFVVMDYFDQYSKFLDFILPCIREGKIVYVEDIAEGLESGPAALIGLFSGRNIGKQVVKVTDE

SEQ ID NO: 2386 - DNA, 1086 bp, Populus balsamifera subsp. trichocarpa; identical to SEQ ID NO: 1950
  misc_feature (1)..(1086): Ceres ANNOT ID no. 1482502
  misc_feature 268226:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves

SEQ ID NO: 2387 - protein, 361 aa, Populus balsamifera subsp. trichocarpa; identical to SEQ ID NO: 1951
  misc_feature (1)..(361): Ceres ANNOT ID no. 1482502
  misc_feature (171)..(318): Pfam Name: ADH_zinc_N Pfam Description: Zinc-binding dehydrogenase
  misc_feature: SWISSPROT Homolog: P1_ARATH Probable NADP-dependent oxidoreductase P1 (EC 1.3.1.74) with e-value of 7.0e-146 and BLAST sequence identity of 75.9
  misc_feature: SWISSPROT Homolog: P2_ARATH Probable NADP-dependent oxidoreductase P2 (EC 1.3.1.74) with e-value of 3.5e-144 and BLAST sequence identity of 75.5
  misc_feature: SWISSPROT Homolog: LTB4D_CAVPO NADP-dependent leukotriene B4 12-hydroxydehydrogenase with e-value of 1.3e-55 and BLAST sequence identity of 40.4
  misc_feature: SWISSPROT Homolog: LTB4D_CAVPO EC 1.3.1.74 (LTB4) (12-HD) 15- oxoprostaglandin 13-reductase (EC 1.3.1.48) (PGR)
  misc_feature: SWISSPROT Homolog: YNCB_ECOLI Putative NADP-dependent oxidoreductase yncB (EC 1.-.-.-) with e-value of 4.6e-55 and BLAST sequence identity of 38.5
  misc_feature: SWISSPROT Homolog: LTB4D_RABIT NADP-dependent leukotriene B4 12-hydroxydehydrogenase(EC 1.3.1.74) (ADRAB-F) (15-oxoprostaglandin 13-reductase) (EC 1.3.1.48) with e-value of 1.2e-54 and BLAST sequence identity of 39.5
  misc_feature 268363:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature (1)..(361): Functional Homolog of  Ceres CLONE ID no. 116237 at SEQ ID NO. 2427 with e-value of 3.99E-126 and BLAST sequence identity of 66.2

SEQ ID NO: 2388 - DNA, 1086 bp, Populus balsamifera subsp. trichocarpa
  misc_feature (1)..(1086): Ceres ANNOT ID no. 1482508
  misc_feature 268486:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
atggctagtgatcatagtgtcggtggtgaggaagtgatcagcaacaaacaagtgatcctcaaggactatgtgagtggttttccaagagaatcaaacctgtacctgacgacaagtaacatcaaactcaaagtgccagaagaagagagtggtaaagatgctgtgctggttaagaatctctacttgtctagtgatcctttcatgcgtggacgcatgcagagagatctgccacccgttactgtgaatttacttactcttgttggagacattgagcagccaattgttggatatggagtggctagagttgttgattccaggcactctgacttcaagaaaggcgatttggtctggggaaggacaatcggctgggaagaatacagtctaataacaacacctgaatacctcttcaaaatcaaccatactgatgatatacccctttcctactacactggaattcttggaatgcctggcatgactgcttatttttgcttctttgacattggttctcccaaggaaggagaccgtgtcttcgtttcatcagcatcaggcgcagttggtcagcttgttgggcaatttgcaaagctgataggttgttatgttgttggaagtgctggaagtaaagaaaaggttgaactattgaagaccaagtttggatttgatgatgctttcaattataaagaggagcatgacttggatgcagccttgaaaaggtacttccctgaaggcatcgacatttactttgagaatgttggaggaaaaatgcttgatgctgtccttctaaacatgagacaccatggccgtattgctttgtgtggaatgatctctcaatacaatctcgagcagcctgaaagtgtgcagaacttaatcgctctactctttaagcagatccggatggaagggtttgcggtttacgagtactatgaccaatactccaagttcttggattttgttctgccgtatattaaagaagggaagattgtttatgtggaagacataactgaaggactcgagagtggccctgctgcattgataggcctattcagcggccgaaatgtaggcaagcaagtagtgaaagttgctcaggagtga

SEQ ID NO: 2389 - protein, 361 aa, Populus balsamifera subsp. trichocarpa
  misc_feature (1)..(361): Ceres ANNOT ID no. 1482508
  misc_feature (171)..(318): Pfam Name: ADH_zinc_N Pfam Description: Zinc-binding dehydrogenase
  misc_feature: SWISSPROT Homolog: P1_ARATH Probable NADP-dependent oxidoreductase P1 (EC 1.3.1.74) with e-value of 7.0e-146 and BLAST sequence identity of 75.9
  misc_feature: SWISSPROT Homolog: P2_ARATH Probable NADP-dependent oxidoreductase P2 (EC 1.3.1.74) with e-value of 3.5e-144 and BLAST sequence identity of 75.5
  misc_feature: SWISSPROT Homolog: LTB4D_CAVPO NADP-dependent leukotriene B4 12-hydroxydehydrogenase with e-value of 1.3e-55 and BLAST sequence identity of 40.4
  misc_feature: SWISSPROT Homolog: LTB4D_CAVPO EC 1.3.1.74 (LTB4) (12-HD) 15- oxoprostaglandin 13-reductase (EC 1.3.1.48) (PGR)
  misc_feature: SWISSPROT Homolog: YNCB_ECOLI Putative NADP-dependent oxidoreductase yncB (EC 1.-.-.-) with e-value of 4.6e-55 and BLAST sequence identity of 38.5
  misc_feature: SWISSPROT Homolog: LTB4D_RABIT NADP-dependent leukotriene B4 12-hydroxydehydrogenase(EC 1.3.1.74) (ADRAB-F) (15-oxoprostaglandin 13-reductase) (EC 1.3.1.48) with e-value of 1.2e-54 and BLAST sequence identity of 39.5
  misc_feature 268623:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature (1)..(361): Functional Homolog of  Ceres CLONE ID no. 116237 at SEQ ID NO. 2427 with e-value of 5.80E-125 and BLAST sequence identity of 66.8
MASDHSVGGEEVISNKQVILKDYVSGFPRESNLYLTTSNIKLKVPEEESGKDAVLVKNLYLSSDPFMRGRMQRDLPPVTVNLLTLVGDIEQPIVGYGVARVVDSRHSDFKKGDLVWGRTIGWEEYSLITTPEYLFKINHTDDIPLSYYTGILGMPGMTAYFCFFDIGSPKEGDRVFVSSASGAVGQLVGQFAKLIGCYVVGSAGSKEKVELLKTKFGFDDAFNYKEEHDLDAALKRYFPEGIDIYFENVGGKMLDAVLLNMRHHGRIALCGMISQYNLEQPESVQNLIALLFKQIRMEGFAVYEYYDQYSKFLDFVLPYIKEGKIVYVEDITEGLESGPAALIGLFSGRNVGKQVVKVAQE

SEQ ID NO: 2390 - DNA, 1056 bp, Populus balsamifera subsp. trichocarpa; identical to SEQ ID NO: 1958
  misc_feature (1)..(1056): Ceres ANNOT ID no. 1535990
  misc_feature 268746:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves

SEQ ID NO: 2391 - protein, 351 aa, Populus balsamifera subsp. trichocarpa; identical to SEQ ID NO: 1959
  misc_feature (1)..(351): Ceres ANNOT ID no. 1535990
  misc_feature (161)..(308): Pfam Name: ADH_zinc_N Pfam Description: Zinc-binding dehydrogenase
  misc_feature: SWISSPROT Homolog: P1_ARATH Probable NADP-dependent oxidoreductase P1 (EC 1.3.1.74) with e-value of 7.0e-146 and BLAST sequence identity of 75.9
  misc_feature: SWISSPROT Homolog: P2_ARATH Probable NADP-dependent oxidoreductase P2 (EC 1.3.1.74) with e-value of 3.5e-144 and BLAST sequence identity of 75.5
  misc_feature: SWISSPROT Homolog: LTB4D_CAVPO NADP-dependent leukotriene B4 12-hydroxydehydrogenase with e-value of 1.3e-55 and BLAST sequence identity of 40.4
  misc_feature: SWISSPROT Homolog: LTB4D_CAVPO EC 1.3.1.74 (LTB4) (12-HD) 15- oxoprostaglandin 13-reductase (EC 1.3.1.48) (PGR)
  misc_feature: SWISSPROT Homolog: YNCB_ECOLI Putative NADP-dependent oxidoreductase yncB (EC 1.-.-.-) with e-value of 4.6e-55 and BLAST sequence identity of 38.5
  misc_feature: SWISSPROT Homolog: LTB4D_RABIT NADP-dependent leukotriene B4 12-hydroxydehydrogenase(EC 1.3.1.74) (ADRAB-F) (15-oxoprostaglandin 13-reductase) (EC 1.3.1.48) with e-value of 1.2e-54 and BLAST sequence identity of 39.5
  misc_feature 268881:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature (1)..(351): Functional Homolog of  Ceres CLONE ID no. 116237 at SEQ ID NO. 2427 with e-value of 1.40E-123 and BLAST sequence identity of 68.6

SEQ ID NO: 2392 - DNA, 1008 bp, Populus balsamifera subsp. trichocarpa; identical to SEQ ID NO: 1956
  misc_feature (1)..(1008): Ceres ANNOT ID no. 1509013
  misc_feature 269001:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves

SEQ ID NO: 2393 - protein, 335 aa, Populus balsamifera subsp. trichocarpa; identical to SEQ ID NO: 1957
  misc_feature (1)..(335): Ceres ANNOT ID no. 1509013
  misc_feature (145)..(292): Pfam Name: ADH_zinc_N Pfam Description: Zinc-binding dehydrogenase
  misc_feature: SWISSPROT Homolog: P1_ARATH Probable NADP-dependent oxidoreductase P1 (EC 1.3.1.74) with e-value of 7.0e-146 and BLAST sequence identity of 75.9
  misc_feature: SWISSPROT Homolog: P2_ARATH Probable NADP-dependent oxidoreductase P2 (EC 1.3.1.74) with e-value of 3.5e-144 and BLAST sequence identity of 75.5
  misc_feature: SWISSPROT Homolog: LTB4D_CAVPO NADP-dependent leukotriene B4 12-hydroxydehydrogenase with e-value of 1.3e-55 and BLAST sequence identity of 40.4
  misc_feature: SWISSPROT Homolog: LTB4D_CAVPO EC 1.3.1.74 (LTB4) (12-HD) 15- oxoprostaglandin 13-reductase (EC 1.3.1.48) (PGR)
  misc_feature: SWISSPROT Homolog: YNCB_ECOLI Putative NADP-dependent oxidoreductase yncB (EC 1.-.-.-) with e-value of 4.6e-55 and BLAST sequence identity of 38.5
  misc_feature: SWISSPROT Homolog: LTB4D_RABIT NADP-dependent leukotriene B4 12-hydroxydehydrogenase(EC 1.3.1.74) (ADRAB-F) (15-oxoprostaglandin 13-reductase) (EC 1.3.1.48) with e-value of 1.2e-54 and BLAST sequence identity of 39.5
  misc_feature 269134:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature (1)..(335): Functional Homolog of  Ceres CLONE ID no. 116237 at SEQ ID NO. 2427 with e-value of 2.90E-123 and BLAST sequence identity of 70.0

SEQ ID NO: 2394 - protein, 175 aa, Arabidopsis thaliana
  misc_feature (1)..(175): Ceres CLONE ID no. 116257
  misc_feature (1)..(173): Pfam Name: AOX Pfam Description: Alternative oxidase
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: ROSETTE LEAVES - Oval Shaped Useful for making plants with increased biomass and foliage
MMLETVAAVPGMVGGMLLHCKSLRRFEQSGGWIKALLEEAENERMHLMTFMEVAKPKWYERALVITVQGVFFNAYFLGYLISPKFAHRMVGYLEEEAIHSYTEFLKELDKGNIENVPAPAIAIDYWRLPADATLRDVVMVVRADEAHHRDVNHFASDIHYQGRELKEAPAPIGYH

SEQ ID NO: 2395 - DNA, 1059 bp, Populus balsamifera subsp. trichocarpa
  misc_feature (1)..(1059): Ceres ANNOT ID no. 1520806
  misc_feature 269340:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: ROSETTE LEAVES - Oval Shaped Useful for making plants with increased biomass and foliage
atgatgatggcaagtcgcgagggagcctccaagttggtgagttccatgatgttagtttcacgttctttctcaacagccaccgcccgtgggatagtagccaaagaggccgtcccagctaaagcggtggggtttaatggggatgttgtgcgtaggaatattggtgagttttgggttcggggttcggtttttgggttgaggcatgggagtactgcgagttatagcgggaaagatcaacaacaggaggaggtgaagcatagccagccggttgcggagggtggtgataaagcagaggagaagaatgcgattgttagttactggggtgttcctcctagtagggtaactaaagaagatggaactgagtggaagtggaattgttttagaccatgggagacatattctgctgatttatcaattaatctgacgaagcatcatgccccagtcacttttttggacaaaatggcttattggactgtcaagtctctcagatggcccactgatttgttctttcagagaaggtatggctgccgcgcaatgatgttggagactgtggcagcagtgccaggaatggtaggaggcatgctgctgcactgcaagtccttgaggcgatttgagcacagtggaggatggatcaaagcattacttgaagaggctgaaaacgagcgaatgcatctcatgacattcatggaggtggcaaatcccaggtggtatgaacgtgctctagtgattactgtccaaggtgttttcttcaatgcttacttccttggctacctcatctccccgaaattcgctcatcgcatggtggggtatctcgaggaggaagctattcattcttacaccgagttcctgaaggagttggacaaaggcaacattaagaatgttccagctcctgccatcgctattgattattggcgcttgcctcctaactccaccctccgcgatgttgttgaggttgttagagctgatgaagcacatcaccgtgatgtaaatcactttgcatcggacatacactatcaaggacgcgaactgaaggaagctcctgctcctatcggttaccactaa

SEQ ID NO: 2396 - protein, 350 aa, Populus balsamifera subsp. trichocarpa
  misc_feature (1)..(350): Ceres ANNOT ID no. 1520806
  misc_feature (67)..(348): Pfam Name: AOX Pfam Description: Alternative oxidase
  misc_feature: SWISSPROT Homolog: AOX1A_ARATH Alternative oxidase 1a, (EC 1.-.-.-) with e-value of 5.3e-93 and BLAST sequence identity of 100.0
  misc_feature: SWISSPROT Homolog: AOX1B_ARATH Alternative oxidase 1b, (EC 1.-.-.-) with e-value of 8.0e-90 and BLAST sequence identity of 96.0
  misc_feature: SWISSPROT Homolog: AOX1_SOYBN Alternative oxidase 1, (EC 1.-.-.-) with e-value of 1.7e-87 and BLAST sequence identity of 93.7
  misc_feature: SWISSPROT Homolog: AOX1C_ARATH Alternative oxidase 1c, (EC 1.-.-.-) with e-value of 2.2e-87 and BLAST sequence identity of 93.1
  misc_feature: SWISSPROT Homolog: AOX2_TOBAC Alternative oxidase 2, (EC 1.-.-.-) with e-value of 2.2e-85 and BLAST sequence identity of 90.3
  misc_feature 269475:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: ROSETTE LEAVES - Oval Shaped Useful for making plants with increased biomass and foliage
  misc_feature (1)..(350): Functional Homolog of  Ceres CLONE ID no. 116257 at SEQ ID NO. 2438 with e-value of 3.79E-89 and BLAST sequence identity of 95.4
MASREGASKLVSSMMLVSRSFSTATARGIVAKEAVPAKAVGFNGDVVRRNIGEFWVRGSVFGLRHGSTASYSGKDQQQEEVKHSQPVAEGGDKAEEKNAIVSYWGVPPSRVTKEDGTEWKWNCFRPWETYSADLSINLTKHHAPVTFLDKMAYWTVKSLRWPTDLFFQRRYGCRAMMLETVAAVPGMVGGMLLHCKSLRRFEHSGGWIKALLEEAENERMHLMTFMEVANPRWYERALVITVQGVFFNAYFLGYLISPKFAHRMVGYLEEEAIHSYTEFLKELDKGNIKNVPAPAIAIDYWRLPPNSTLRDVVEVVRADEAHHRDVNHFASDIHYQGRELKEAPAPIGYH

SEQ ID NO: 2397 - DNA, 1050 bp, Populus balsamifera subsp. trichocarpa
  misc_feature (1)..(1050): Ceres ANNOT ID no. 1473089
  misc_feature 269602:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: ROSETTE LEAVES - Oval Shaped Useful for making plants with increased biomass and foliage
atggcaagccgtggcggaggcgtcaagttggcgagttccatgatgttggtttcacgttctttctcaacagccatctctcgtggcataatagccaaagaggcagtcacagccaaagcggtggggtttcatggggatgttgtgcgtaagaatattggtgaattttgggttcgtggttcggtttttggtgtgaggcatggaagtactatgagtttcggcgagaaggatcaacagaaggtggagatgaagcaaacccaaccggttgcggaaggtggtgataaagaggagaagaaggagattgctagttactggggtgttcctcctagtagggttactaaagaagatggggctgaatggaagtggaattgttttaggccatgggagacgtattctgctgatttatcaattgacctgaagaaacatcatgtcccagccaccgttttggacaaaatggctttttggattgtcaaggctttgagattgcccactgatctgttctttcagaggaggtatggctgccgtgcaatgatgctagaaactgtggcagcagtgccaggaatggtaggaggcatgctgctacactgcaagtcattgaggcgatttgagcacagtggaggatggatcaaaacattacttgacgaggctgaaaacgagcgtatgcatctcatgacattcatggaggtggcaaagcccaggtggtatgagcgcgctctggtgattactgtccaaggtgttttcttgaatgcttacttccttggctacattatctcccccaaattcgctcatcgcatggtggggtacctcgaggaagaagctatccattcctacaccgagttcctgaaggagttggacaaaggcaacattgagaatgttcctgctcctgccattgctgttgattactggcggttgcctcctaacgccaccctccgcgatgttgttctggttgtgagagctgatgaggcccatcaccgcgatgtgaatcattttgcttcggacatacactatcaaggacgtgaactaaaagaagctcctgctcctattggttatcactaa

SEQ ID NO: 2398 - protein, 335 aa, Populus balsamifera subsp. trichocarpa
  misc_feature (1)..(335): Ceres ANNOT ID no. 1473089
  misc_feature (54)..(333): Pfam Name: AOX Pfam Description: Alternative oxidase
  misc_feature: SWISSPROT Homolog: AOX1A_ARATH Alternative oxidase 1a, (EC 1.-.-.-) with e-value of 5.3e-93 and BLAST sequence identity of 100.0
  misc_feature: SWISSPROT Homolog: AOX1B_ARATH Alternative oxidase 1b, (EC 1.-.-.-) with e-value of 8.0e-90 and BLAST sequence identity of 96.0
  misc_feature: SWISSPROT Homolog: AOX1_SOYBN Alternative oxidase 1, (EC 1.-.-.-) with e-value of 1.7e-87 and BLAST sequence identity of 93.7
  misc_feature: SWISSPROT Homolog: AOX1C_ARATH Alternative oxidase 1c, (EC 1.-.-.-) with e-value of 2.2e-87 and BLAST sequence identity of 93.1
  misc_feature: SWISSPROT Homolog: AOX2_TOBAC Alternative oxidase 2, (EC 1.-.-.-) with e-value of 2.2e-85 and BLAST sequence identity of 90.3
  misc_feature 269737:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: ROSETTE LEAVES - Oval Shaped Useful for making plants with increased biomass and foliage
  misc_feature (1)..(335): Functional Homolog of  Ceres CLONE ID no. 116257 at SEQ ID NO. 2438 with e-value of 3.79E-89 and BLAST sequence identity of 94.2
MLVSRSFSTAISRGIIAKEAVTAKAVGFHGDVVRKNIGEFWVRGSVFGVRHGSTMSFGEKDQQKVEMKQTQPVAEGGDKEEKKEIASYWGVPPSRVTKEDGAEWKWNCFRPWETYSADLSIDLKKHHVPATVLDKMAFWIVKALRLPTDLFFQRRYGCRAMMLETVAAVPGMVGGMLLHCKSLRRFEHSGGWIKTLLDEAENERMHLMTFMEVAKPRWYERALVITVQGVFLNAYFLGYIISPKFAHRMVGYLEEEAIHSYTEFLKELDKGNIENVPAPAIAVDYWRLPPNATLRDVVLVVRADEAHHRDVNHFASDIHYQGRELKEAPAPIGYH

SEQ ID NO: 2399 - DNA, 885 bp, Populus balsamifera subsp. trichocarpa
  misc_feature (1)..(885): Ceres ANNOT ID no. 1500150
  misc_feature 269861:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: ROSETTE LEAVES - Oval Shaped Useful for making plants with increased biomass and foliage
atgagctcgaccagatttgcttcttatggggtccgaggttggagtgcttcagcaccacctgttatgccaggtgaagaggagaaaccaaaggcagctgcaaattcatttactacagaagatggtaaggccatcgtgagctattggggtgtgactccccccaagatcaccaaggaggatggcacagcttggaagtggaactgcttcaggccatgggagtcctacaaacctgacatctcaattgatgtgaagaagcaccataagcctggtacaacaatggataaatttgcctactggaccgtccaggtcctcaaataccccacttacttattcttccagagacggcatatgtgccatgccatgctgctagagacagtagctgctgttccaggcatggttggagggatgctcttgcattgcaaatcactacgacgattcgagcaaagtggcggctggataaaagctcttttagaagaagctgagaacgagcggatgcatcttatgaccttcgttgaaatagctaagccccagtggtacgaacgagcccttgtatttgctgtccaaggtgccttcttcaatgcttattttctggcatatttagcctctccgaagcttgcacaccgtatagtagggtacttggaagaggaggcggtgaactcctactcagagttcctcgaggacttggacaatggtaattttgagaacgtgcctgcccctgctattgccattgactactggcgcttgcctcccaactccacgcttcgtgatgttgtgttcgttataagagctgatgaagcacatcaccgagaccttaaccactacgcatcggacattcaatgtcaaggacaagagttaaagcatacacctgctccaatcggatatcattaa

SEQ ID NO: 2400 - protein, 203 aa, Populus balsamifera subsp. trichocarpa
  misc_feature (1)..(203): Ceres ANNOT ID no. 1500150
  misc_feature (1)..(201): Pfam Name: AOX Pfam Description: Alternative oxidase
  misc_feature: SWISSPROT Homolog: AOX1A_ARATH Alternative oxidase 1a, (EC 1.-.-.-) with e-value of 5.3e-93 and BLAST sequence identity of 100.0
  misc_feature: SWISSPROT Homolog: AOX1B_ARATH Alternative oxidase 1b, (EC 1.-.-.-) with e-value of 8.0e-90 and BLAST sequence identity of 96.0
  misc_feature: SWISSPROT Homolog: AOX1_SOYBN Alternative oxidase 1, (EC 1.-.-.-) with e-value of 1.7e-87 and BLAST sequence identity of 93.7
  misc_feature: SWISSPROT Homolog: AOX1C_ARATH Alternative oxidase 1c, (EC 1.-.-.-) with e-value of 2.2e-87 and BLAST sequence identity of 93.1
  misc_feature: SWISSPROT Homolog: AOX2_TOBAC Alternative oxidase 2, (EC 1.-.-.-) with e-value of 2.2e-85 and BLAST sequence identity of 90.3
  misc_feature 269990:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: ROSETTE LEAVES - Oval Shaped Useful for making plants with increased biomass and foliage
  misc_feature (1)..(203): Functional Homolog of  Ceres CLONE ID no. 116257 at SEQ ID NO. 2438 with e-value of 2.10E-79 and BLAST sequence identity of 82.8
MDKFAYWTVQVLKYPTYLFFQRRHMCHAMLLETVAAVPGMVGGMLLHCKSLRRFEQSGGWIKALLEEAENERMHLMTFVEIAKPQWYERALVFAVQGAFFNAYFLAYLASPKLAHRIVGYLEEEAVNSYSEFLEDLDNGNFENVPAPAIAIDYWRLPPNSTLRDVVFVIRADEAHHRDLNHYASDIQCQGQELKHTPAPIGYH

SEQ ID NO: 2401 - protein, 359 aa, Arabidopsis thaliana
  misc_feature (1)..(359): Ceres CLONE ID no. 116356
  misc_feature (207)..(307): Pfam Name: 2OG-FeII_Oxy Pfam Description: 2OG-Fe(II) oxygenase superfamily
  misc_feature: Utility: pH (high) Useful for making plants tolerant to high pH or low phosphate
  misc_feature: Utility: No Nitrogen Useful for making plants tolerant to low nitrogen
  misc_feature: Phenotype: WHOLE PLANT - No Nitrogen Useful for making plants tolerant to low nitrogen
  misc_feature: Phenotype: WHOLE PLANT - pH (high) Useful for making plants tolerant to high pH or low phosphate
MAENYDRASELKAFDEMKIGVKGLVDAGVTNVPRIFHNPHVNVANPKPTSTVVMIPTIDLGGVFESTVVRESVVAKVKDAMEKFGFFQAINHGVPLDVMEKMINGIRRFHDQDPEVRKMFYTRDKTKKLKYHSNADLYESPAASWRDTLSCVMAPDVPKAQELPEVCGEIMLEYSKEVMKLAELMFEILSEALGLSPNHLKEMDCAKGLWMLCHCFPPCPEPNRTFGGAQHTDRSFLTILLNDNNGGLQVLYDGYWIDVPPNPEALIFNVGDFLQLISNDKFVSMEHRILANGGEEPRISVACFFVHTFTSPSSRVYGPIKELLSELNPPKYRDTTSESSNHYVARKPNGNSSLDHLRI

SEQ ID NO: 2402 - DNA, 1107 bp, Populus balsamifera subsp. trichocarpa
  misc_feature (1)..(1107): Ceres ANNOT ID no. 1467190
  misc_feature: Utility: pH (high) Useful for making plants tolerant to high pH or low phosphate
  misc_feature: Utility: No Nitrogen Useful for making plants tolerant to low nitrogen
  misc_feature 270218:<222: Transcription Factor
  misc_feature: Phenotype: WHOLE PLANT - No Nitrogen Useful for making plants tolerant to low nitrogen
  misc_feature: Phenotype: WHOLE PLANT - pH (high) Useful for making plants tolerant to high pH or low phosphate
atggtgatcaaaagctcagctgaagttcaagaatcaaactatgacaaagaaagtcaactcaaagcttttgatgacacgagaactggagtgaagggtctaatagataatggaattaccaagattccaaagatattcgttcatgacaaaagatcagatgtttcaagtgattctgatcagtctgcggctgttccattgatagacttcgaaggcatagatgaagatagaagtcaacgtgcaaaggtagtcgagggagtaagagatgcttgtgccgagtggggtttctttcaagtggtcaatcatggaatcccagttagtgttttggaggaaatgattggtggggtagctaggtttcatgagcaagatagtgaagtgaagaaagaatggtattcaagggattacacaaggaaggtgctttataattcaaattttgatctttatcaagccccagctgccaattggagagatactttgagttgtgtcatggctcctcgccagccgaatccccatgacttgcctgatgtgtgcagagatatcatgaatgattactcaaacaaagtaatggttttagcacaaagattattcgaattgctgtcagaagcactgggacttgatcctaattaccttaaagacatacactgtgcagagggactcttttttctgggccattactacccagcatgtcctgaaccagatttgacttttggcactagcagccattctgatagtagcttcctcactgttcttgtacaagaccaaattggtggcctccaagtccttcatgaaaatcaatgggttgatcttaaccccattccaggagctcttgttataaacctgggagacatgttacagttaatttcgaatgacagatttattagtgtccagcacagagtgctagcaagaactgtaggtccaagaatttctgtggcatgctttataagacaacaccttccgcctgagaatgcctcgagactatatgggccaatcaaggagttgctatcagaagaaagcccagcaatctaccgagaaaccactgtgaaggacttggtaacccactactatgcaaaagggctcgatgggatctctgcattggagcatttcaagctgtga

SEQ ID NO: 2403 - protein, 368 aa, Populus balsamifera subsp. trichocarpa
  misc_feature (1)..(368): Ceres ANNOT ID no. 1467190
  misc_feature (215)..(314): Pfam Name: 2OG-FeII_Oxy Pfam Description: 2OG-Fe(II) oxygenase superfamily
  misc_feature: SWISSPROT Homolog: ACCO3_LYCES 1-aminocyclopropane-1-carboxylate oxidase homolog (Protein E8) with e-value of 1.9e-95 and BLAST sequence identity of 51.0
  misc_feature: SWISSPROT Homolog: DV4H_CATRO Desacetoxyvindoline 4-hydroxylase (EC 1.14.11.20) with e-value of 8.0e-90 and BLAST sequence identity of 48.7
  misc_feature: SWISSPROT Homolog: G2OX8_ARATH Gibberellin 2-beta-dioxygenase 8 with e-value of 5.9e-33 and BLAST sequence identity of 40.0
  misc_feature: SWISSPROT Homolog: G2OX8_ARATH EC 1.14.11.13 (Gibberellin 2-beta-hydroxylase 8) Gibberellin 2-oxidase 8 GA 2-oxidase 8
  misc_feature: SWISSPROT Homolog: LDOX_ARATH Leucoanthocyanidin dioxygenase with e-value of 4.0e-31 and BLAST sequence identity of 29.5
  misc_feature: SWISSPROT Homolog: LDOX_ARATH EC 1.14.11.19 (LDOX)(Leucocyanidin oxygenase) Leucoanthocyanidin hydroxylase Anthocyanidin synthase (ANS)
  misc_feature: SWISSPROT Homolog: FLS_PETHY Flavonol synthase/flavanone 3-hydroxylase (EC 1.14.11.23) (EC 1.14.11.9) (FLS) with e-value of 5.2e-31 and BLAST sequence identity of 30.4
  misc_feature: Utility: pH (high) Useful for making plants tolerant to high pH or low phosphate
  misc_feature: Utility: No Nitrogen Useful for making plants tolerant to low nitrogen
  misc_feature 270362:<222: Transcription Factor
  misc_feature: Phenotype: WHOLE PLANT - No Nitrogen Useful for making plants tolerant to low nitrogen
  misc_feature: Phenotype: WHOLE PLANT - pH (high) Useful for making plants tolerant to high pH or low phosphate
  misc_feature (1)..(368): Functional Homolog of  Ceres CLONE ID no. 116356 at SEQ ID NO. 2445 with e-value of 1.19E-101 and BLAST sequence identity of 53.8
MVIKSSAEVQESNYDKESQLKAFDDTRTGVKGLIDNGITKIPKIFVHDKRSDVSSDSDQSAAVPLIDFEGIDEDRSQRAKVVEGVRDACAEWGFFQVVNHGIPVSVLEEMIGGVARFHEQDSEVKKEWYSRDYTRKVLYNSNFDLYQAPAANWRDTLSCVMAPRQPNPHDLPDVCRDIMNDYSNKVMVLAQRLFELLSEALGLDPNYLKDIHCAEGLFFLGHYYPACPEPDLTFGTSSHSDSSFLTVLVQDQIGGLQVLHENQWVDLNPIPGALVINLGDMLQLISNDRFISVQHRVLARTVGPRISVACFIRQHLPPENASRLYGPIKELLSEESPAIYRETTVKDLVTHYYAKGLDGISALEHFKL

SEQ ID NO: 2404 - protein, 343 aa, Arabidopsis thaliana
  misc_feature (1)..(343): Ceres CLONE ID no. 117089
  misc_feature (1)..(343): Also Known As Ceres CDNA ID no. 23388445
  misc_feature (1)..(343): Also Known As Ceres GEMINI ID 533H3
  misc_feature (201)..(227): Pfam Name: zf-CCCH Pfam Description: Zinc finger C-x8-C-x5-C-x3-H type (and similar)
  misc_feature (277)..(314): Pfam Name: zf-C3HC4 Pfam Description: Zinc finger, C3HC4 type (RING finger)
  misc_feature 270500:<222: Transcription Factor
  misc_feature: Phenotype: Activates expression of the gene endogenous to the AtDXPR (SEQ ID NO 4143) regalutory region Useful for modulating Terpenoid Biosynthesis
MSDSGEPKPSQQEEPLPQPAAQETQSQQVCTFFKKPTKSKNIRKRTIDADEEDGDSKSESSILQNLKKVAKPDSKLYFSSGPSKSSTTTSGAPERSVFHYDSSKEIQVQNDSGATATLETETDFNQDARAIRERVLKKADEALKGNKKKASDEKLYKGIHGYTDHKAGFRREQTISSEKAGGSHGPLRASAHIRVSARFDYQPDICKDYKETGYCGYGDSCKFLHDRGDYKPGWQIEKEWEEAEKVRKRNKAMGVEDEDDEADKDSDEDENALPFACFICREPFVDPVVTKCKHYFCEHCALKHHTKNKKCFVCNQPTMGIFNAAHEIKKRMAEERSKAEEGL

SEQ ID NO: 2405 - DNA, 972 bp, Populus balsamifera subsp. trichocarpa; identical to SEQ ID NO: 146
  misc_feature (1)..(972): Ceres ANNOT ID no. 1471301
  misc_feature 270591:<222: Transcription Factor
  misc_feature: Phenotype: Activates expression of the gene endogenous to the AtDXPR (SEQ ID NO 4143) regalutory region Useful for modulating Terpenoid Biosynthesis

SEQ ID NO: 2406 - protein, 323 aa, Populus balsamifera subsp. trichocarpa; identical to SEQ ID NO: 147
  misc_feature (1)..(323): Ceres ANNOT ID no. 1471301
  misc_feature (186)..(212): Pfam Name: zf-CCCH Pfam Description: Zinc finger C-x8-C-x5-C-x3-H type (and similar)
  misc_feature (262)..(299): Pfam Name: zf-C3HC4 Pfam Description: Zinc finger, C3HC4 type (RING finger)
  misc_feature: SWISSPROT Homolog: ZN183_BOVIN Zinc finger protein 183 with e-value of 4.3e-59 and BLAST sequence identity of 42.0
  misc_feature: SWISSPROT Homolog: R113A_HUMAN RING finger protein 113A (Zinc finger protein 183) with e-value of 1.1e-58 and BLAST sequence identity of 41.7
  misc_feature: SWISSPROT Homolog: R113B_HUMAN RING finger protein 113B (Zinc finger protein 183-like 1) with e-value of 3.0e-58 and BLAST sequence identity of 39.9
  misc_feature: SWISSPROT Homolog: RN113_CAEEL Putative RING finger protein 113 homolog with e-value of 3.5e-48 and BLAST sequence identity of 37.6
  misc_feature: SWISSPROT Homolog: CWC24_CRYNE Pre-mRNA-splicing factor CWC24 with e-value of 2.4e-47 and BLAST sequence identity of 32.9
  misc_feature 270699:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(323): Functional Homolog of  Ceres CLONE ID no. 117089 at SEQ ID NO. 2448 with e-value of 3.09E-133 and BLAST sequence identity of 73.8

SEQ ID NO: 2407 - protein, 128 aa, Arabidopsis thaliana
  misc_feature (1)..(128): Ceres CLONE ID no. 117369
  misc_feature (13)..(81): Pfam Name: LSM Pfam Description: LSM domain
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: SILIQUES - Short Useful for increasing seed/fruit yield or modifying fruit content
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MSWAGPEEIYLSTSLASYLDRKLLVLLRDGRKLMGTLRSFDQFANAVLEGACERVIVGEQYCDIPLGLYVIRGENVVLIGELDTEREELPPHMIRVSEAEIKRAQKVEREASELRGTMRKRMEFLDFD

SEQ ID NO: 2408 - DNA, 387 bp, Populus balsamifera subsp. trichocarpa
  misc_feature (1)..(387): Ceres ANNOT ID no. 1499284
  misc_feature 270906:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: SILIQUES - Short Useful for increasing seed/fruit yield or modifying fruit content
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgtcttgggcaggcccggaagatatctacctctctacttctcttgctagctatcttgataagaagcttcttgtgcttctacgagatggccgaaagctcatgggaatacttcgttcttttgaccaatttgccaatgctgttcttgaaggtgcatgtgaaagagctattgttggcgacctttattgcgacatccacttgggtctatatgtaattcgtggcgagaatgttgtcttaattggggagctggatttggagagggaggaacttccaccacatatgactcgtgtttcagaagcagaaattaaaagggcacagaaagcagaaagggaggctacagatctcaaaggtacaatgaggaaaagaatggagttccttgatttggattag

SEQ ID NO: 2409 - protein, 128 aa, Populus balsamifera subsp. trichocarpa
  misc_feature (1)..(128): Ceres ANNOT ID no. 1499284
  misc_feature (13)..(81): Pfam Name: LSM Pfam Description: LSM domain
  misc_feature: SWISSPROT Homolog: LSM1_HUMAN U6 snRNA-associated Sm-like protein LSm1 (Small nuclear ribonuclear CaSm) (Cancer-associated Sm-like) with e-value of 5.3e-22 and BLAST sequence identity of 54.5
  misc_feature: SWISSPROT Homolog: LSM1_MOUSE U6 snRNA-associated Sm-like protein LSm1 with e-value of 6.7e-22 and BLAST sequence identity of 50.0
  misc_feature: SWISSPROT Homolog: YB18_SCHPO Hypothetical protein C3D6.08c in chromosome II with e-value of 1.4e-21 and BLAST sequence identity of 45.2
  misc_feature: SWISSPROT Homolog: LSM1_YEAST Sm-like protein LSm1 (SPB8 protein) with e-value of 2.4e-17 and BLAST sequence identity of 41.1
  misc_feature: SWISSPROT Homolog: LSM8_HUMAN U6 snRNA-associated Sm-like protein LSm8 with e-value of 3.3e-13 and BLAST sequence identity of 41.6
  misc_feature 271044:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: SILIQUES - Short Useful for increasing seed/fruit yield or modifying fruit content
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(128): Functional Homolog of  Ceres CLONE ID no. 117369 at SEQ ID NO. 2451 with e-value of 7.89E-57 and BLAST sequence identity of 89.0
MSWAGPEDIYLSTSLASYLDKKLLVLLRDGRKLMGILRSFDQFANAVLEGACERAIVGDLYCDIHLGLYVIRGENVVLIGELDLEREELPPHMTRVSEAEIKRAQKAEREATDLKGTMRKRMEFLDLD

SEQ ID NO: 2410 - DNA, 387 bp, Populus balsamifera subsp. trichocarpa
  misc_feature (1)..(387): Ceres ANNOT ID no. 1481671
  misc_feature 271160:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: SILIQUES - Short Useful for increasing seed/fruit yield or modifying fruit content
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgtcttgggcaggcccagaagatatctacctctctacttctcttgccaactatcttgataagaagcttcttgtgctcctacgagatggccgaaagctcatgggattacttcgttcttttgatcaatttgccaatgctgtccttgaaggtgcatgtgaaagagttattgttggtgacctttattgcgacatccacttgggtctatatgtgattcgtggggagaatgttgtcttaattggagagctggatttggagagggaggagcttccaccacatatgactcgtgtttcagaagcagagattagaagggcgcagaaagcagaaagggaggcaacagatctaaaaggtacaatgaggaaaagaatggagttccttgatttggactag

SEQ ID NO: 2411 - protein, 128 aa, Populus balsamifera subsp. trichocarpa
  misc_feature (1)..(128): Ceres ANNOT ID no. 1481671
  misc_feature (13)..(81): Pfam Name: LSM Pfam Description: LSM domain
  misc_feature: SWISSPROT Homolog: LSM1_HUMAN U6 snRNA-associated Sm-like protein LSm1 (Small nuclear ribonuclear CaSm) (Cancer-associated Sm-like) with e-value of 5.3e-22 and BLAST sequence identity of 54.5
  misc_feature: SWISSPROT Homolog: LSM1_MOUSE U6 snRNA-associated Sm-like protein LSm1 with e-value of 6.7e-22 and BLAST sequence identity of 50.0
  misc_feature: SWISSPROT Homolog: YB18_SCHPO Hypothetical protein C3D6.08c in chromosome II with e-value of 1.4e-21 and BLAST sequence identity of 45.2
  misc_feature: SWISSPROT Homolog: LSM1_YEAST Sm-like protein LSm1 (SPB8 protein) with e-value of 2.4e-17 and BLAST sequence identity of 41.1
  misc_feature: SWISSPROT Homolog: LSM8_HUMAN U6 snRNA-associated Sm-like protein LSm8 with e-value of 3.3e-13 and BLAST sequence identity of 41.6
  misc_feature 271298:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: SILIQUES - Short Useful for increasing seed/fruit yield or modifying fruit content
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(128): Functional Homolog of  Ceres CLONE ID no. 117369 at SEQ ID NO. 2451 with e-value of 1.30E-56 and BLAST sequence identity of 88.2
MSWAGPEDIYLSTSLANYLDKKLLVLLRDGRKLMGLLRSFDQFANAVLEGACERVIVGDLYCDIHLGLYVIRGENVVLIGELDLEREELPPHMTRVSEAEIRRAQKAEREATDLKGTMRKRMEFLDLD

SEQ ID NO: 2412 - protein, 510 aa, Arabidopsis thaliana
  misc_feature (1)..(510): Ceres CLONE ID no. 117895
  misc_feature (36)..(508): Pfam Name: p450 Pfam Description: Cytochrome P450
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Oval Shaped Useful for making plants with increased biomass and foliage
MDLTDVIIFLFALYFINLWWRRYFSAGSSQCSLNIPPGPKGWPLVGNLLQVIFQRRHFVFLMRDLRKKYGPIFTMQMGQRTMIIITDEKLIHEALVQRGPTFASRPPDSPIRLMFSVGKCAINSAEYGSLWRTLRRNFVTELVTAPRVKQCSWIRSWAMQNHMKRIKTENVEKGFVEVMSQCRLTICSILICLCFGAKISEEKIKNIENVLKDVMLITSPTLPDFLPVFTPLFRRQVREARELRKTQLECLVPLIRNRRKFVDAKENPNEEMVSPIGAAYVDSLFRLNLIERGGELGDEEIVTLCSEIVSAGTDTSATTLEWALFHLVTDQNIQEKLYEEVVGVVGKNGVVEEDDVAKMPYLEAIVKETLRRHPPGHFLLSHAAVKDTELGGYDIPAGAYVEIYTAWVTENPDIWSDPGKFRPERFLTGGDGVDADWTGTRGVTMLPFGAGRRICPAWSLGILHINLMLARMIHSFKWIPVPDSPPDPTETYAFTVVMKNSLKAQIRSRT

SEQ ID NO: 2413 - DNA, 1587 bp, Populus balsamifera subsp. trichocarpa
  misc_feature (1)..(1587): Ceres ANNOT ID no. 1448592
  misc_feature 271552:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Oval Shaped Useful for making plants with increased biomass and foliage
atggacttgatagacctccttattctttgtattgcacttatgtttgcccgcctatggtggcgacattggtccgtcaccggcggcgggccaaggaatcttcctccagggcctccaggttggcctattgtgggcaacttgttccaaatcatcctccaacgccgtccattcatctatgttgtacgtgatttacgtgcaaaatatggtccaatcttcaccttgcaaatgggccaacgtactcttgttattgtcactagctctgagctcatccatgaagccctagttcaaagaggccctacatttgcaagccggccggctgactcgccgatcaggctagtgttcagtgttggtaaatgtgctatcaattctgctgaatatggtcctctttggagatctctacgcaagaactttgtcacacagtttataaaccctgtgagaatcaagcaatgtagttgggttcgagagtgtgcttcagagaaccatatgaaaagactgaaaaccgaggcccttgaaaatgggtttgttgaggtgatgagcaactgtaggctcactatatgtagcatcttaatatgtctttgcttcggtgcaagaatctctgaagaaagaatcaagagcattgaagctatattgaaagaggtgatgttaatgacaacaccaaagcttcctgatttcttgccaattctagctcctttatttcgcaagaaaatggaagaagccaaagaattgagaaggaaacaaatggagtgtctggttccattgattagaaacaggagggcctttgtggagaaaggtgagaaccctgatttggaaatggcgagtccagttggtgcagcctatatagactctttgtttgccatgaaaccagtaaatagaggtcccttaggtgagcaagaatttgtgacgttatgctctgaggtgatcagtgctggtactgatactagtgcaacaacgattgaatgggctcttctaaacttggtacaaaatcaagaaatccaagaaaagctttaccaagaaattattggatgtgtagggaaacatggggtggtcaaagaagaggatactgagaaaatgccttatctcggtgcaatagttaaagaaactttcaggcgtcacccaccaagtcattttgtgttatctcatgctgccactaatgagactcagcttgctggctacaccattccagctgacgttaatgtggagttttacactgcatggctaactgaagatccggatttgtggaaggatccgggtgagtttcgacccgagaggttcttggagggtgatggggttgatgtggatatgaccgggactcgcggggtgaagatgatgccttttggcgtcggacgaaggatttgtccggcgtggagtcttggtgtattgcatgttaatatgttgcttgctcggatggttcatgctttcaagtggttgccttgcccgaccgccccacccgacccgacggagacttttgcttttactgttgtgatgaagaatcctctaaaagctgtgatattgcctagaaacttttgttcgtatttaaacattaattccatagaaaaagaattaactgatggaatcatggaaggaagatga

SEQ ID NO: 2414 - protein, 528 aa, Populus balsamifera subsp. trichocarpa
  misc_feature (1)..(528): Ceres ANNOT ID no. 1448592
  misc_feature (34)..(504): Pfam Name: p450 Pfam Description: Cytochrome P450
  misc_feature: SWISSPROT Homolog: C77A3_SOYBN Cytochrome P450 77A3 (EC 1.14.-.-) with e-value of 2.8e-119 and BLAST sequence identity of 44.9
  misc_feature: SWISSPROT Homolog: C77A2_SOLME Cytochrome P450 77A2 (EC 1.14.-.-) (CYPLXXVIIA2) (P-450EG5) with e-value of 4.8e-115 and BLAST sequence identity of 43.6
  misc_feature: SWISSPROT Homolog: C77A1_SOLME Cytochrome P450 77A1 (EC 1.14.-.-) (CYPLXXVIIA1) (P-450EG6) (Fragment) with e-value of 2.8e-110 and BLAST sequence identity of 43.9
  misc_feature: SWISSPROT Homolog: C89A2_ARATH Cytochrome P450 89A2 (EC 1.14.-.-) (CYPLXXXIX) (ATH 6-1) with e-value of 1.7e-89 and BLAST sequence identity of 39.3
  misc_feature: SWISSPROT Homolog: C76C1_ARATH Cytochrome P450 76C1 (EC 1.14.-.-) with e-value of 1.5e-54 and BLAST sequence identity of 30.1
  misc_feature 271691:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Oval Shaped Useful for making plants with increased biomass and foliage
  misc_feature (1)..(528): Functional Homolog of  Ceres CLONE ID no. 117895 at SEQ ID NO. 2456 with e-value of 3.19E-202 and BLAST sequence identity of 69.3
MDLIDLLILCIALMFARLWWRHWSVTGGGPRNLPPGPPGWPIVGNLFQIILQRRPFIYVVRDLRAKYGPIFTLQMGQRTLVIVTSSELIHEALVQRGPTFASRPADSPIRLVFSVGKCAINSAEYGPLWRSLRKNFVTQFINPVRIKQCSWVRECASENHMKRLKTEALENGFVEVMSNCRLTICSILICLCFGARISEERIKSIEAILKEVMLMTTPKLPDFLPILAPLFRKKMEEAKELRRKQMECLVPLIRNRRAFVEKGENPDLEMASPVGAAYIDSLFAMKPVNRGPLGEQEFVTLCSEVISAGTDTSATTIEWALLNLVQNQEIQEKLYQEIIGCVGKHGVVKEEDTEKMPYLGAIVKETFRRHPPSHFVLSHAATNETQLAGYTIPADVNVEFYTAWLTEDPDLWKDPGEFRPERFLEGDGVDVDMTGTRGVKMMPFGVGRRICPAWSLGVLHVNMLLARMVHAFKWLPCPTAPPDPTETFAFTVVMKNPLKAVILPRNFCSYLNINSIEKELTDGIMEGR

SEQ ID NO: 2415 - DNA, 1524 bp, Populus balsamifera subsp. trichocarpa
  misc_feature (1)..(1524): Ceres ANNOT ID no. 1448594
  misc_feature 271840:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Oval Shaped Useful for making plants with increased biomass and foliage
atggagttgatagatcttcttattcttggtctaacactcttttttcttgctatatggtggcggagcttctctgtcgtcaatggcggcggagccaagaacttgccaccaggaccaccaggttggcctcttgtgggcaacttgtttcaaataatacttgaacggcgtcatttcatctttgtcatacgtgatttacgtaagaaatacggtccaatcttctccatgcaaatgggccaaagtactcttgttatagtcactagccctgacctaatccatgaagcccttgttcaaaaaggccctatctttgctagtcggccaccggactcaccgatccggttggtgttcagtgtcgggaaatgtgccgtcaactcagctgaatatggacctctttggcggacacttcgtcggaactttgtcacggagttgataagcccggtcaggatcagacagtgtagttggatacgagaatgggcgttggagagtcacatgaagaggctcaaaagtgaagctttagaaaacgggtacgtagatgtaatggatgtttgtagattcactgtctgtagcattctagtatttatttgcttcggagcaaaaatctcagaacattggattcatgatatagataatgtgactaaagatgtcatgctaatatcaattccacagcttcccgatttcttgcctattctaactcccttgtttcgcaagcaaatgaagagggcaaaggatttaagaaagactcaaattgagtgcttggttcctttgataaggaacagaagagcatttgtagagaaaggtgaaaacccgaaaatggaaatgttgagtccagttggtgcagcctatgttgattcactttttacccttaaggcaccggggaggggtcttttaggagaagaagagcttgttacagtttgttcagagttgtttgttgctggaatcgatactagcacaagtgtgctacagtgggtttttcttgaattggtccttaaccaagacattcaagaaaagttgtaccgagaaattgttgagtctgtgggcaaagatggagtaatcaacgaagaagatgtggagaaaatgaactatctcaacgcagtggttaaagaaaccctaagggtacattctccggcgcatttcacgttatcacacgccacgacggaggagacggagcttggtggctacaagattccgagcaatgtgaatgttgagttctacattgaatggatgactgaggatccgagtttgtggaaggatccgggtatatttcggcccgagaggttcatagatggtgatggtgtcaacgtagacatgaccggaacgaagggcaaggtgaagatgttgccgttcggagccgggaggaggacttgcccagggttggctcttggtttgttgcatgtgaatttaatgcttgcaagaatggtacaagctttcaagtggctacccgcaccgaatgctccacccgacccgacagaggcctttgctttcacggttgtcatgaagaaccctctaaaagcagtcatattgcccaggtga

SEQ ID NO: 2416 - protein, 507 aa, Populus balsamifera subsp. trichocarpa
  misc_feature (1)..(507): Ceres ANNOT ID no. 1448594
  misc_feature (35)..(506): Pfam Name: p450 Pfam Description: Cytochrome P450
  misc_feature: SWISSPROT Homolog: C77A3_SOYBN Cytochrome P450 77A3 (EC 1.14.-.-) with e-value of 2.8e-119 and BLAST sequence identity of 44.9
  misc_feature: SWISSPROT Homolog: C77A2_SOLME Cytochrome P450 77A2 (EC 1.14.-.-) (CYPLXXVIIA2) (P-450EG5) with e-value of 4.8e-115 and BLAST sequence identity of 43.6
  misc_feature: SWISSPROT Homolog: C77A1_SOLME Cytochrome P450 77A1 (EC 1.14.-.-) (CYPLXXVIIA1) (P-450EG6) (Fragment) with e-value of 2.8e-110 and BLAST sequence identity of 43.9
  misc_feature: SWISSPROT Homolog: C89A2_ARATH Cytochrome P450 89A2 (EC 1.14.-.-) (CYPLXXXIX) (ATH 6-1) with e-value of 1.7e-89 and BLAST sequence identity of 39.3
  misc_feature: SWISSPROT Homolog: C76C1_ARATH Cytochrome P450 76C1 (EC 1.14.-.-) with e-value of 1.5e-54 and BLAST sequence identity of 30.1
  misc_feature 271977:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Oval Shaped Useful for making plants with increased biomass and foliage
  misc_feature (1)..(507): Functional Homolog of  Ceres CLONE ID no. 117895 at SEQ ID NO. 2456 with e-value of 4.59E-187 and BLAST sequence identity of 65.0
MELIDLLILGLTLFFLAIWWRSFSVVNGGGAKNLPPGPPGWPLVGNLFQIILERRHFIFVIRDLRKKYGPIFSMQMGQSTLVIVTSPDLIHEALVQKGPIFASRPPDSPIRLVFSVGKCAVNSAEYGPLWRTLRRNFVTELISPVRIRQCSWIREWALESHMKRLKSEALENGYVDVMDVCRFTVCSILVFICFGAKISEHWIHDIDNVTKDVMLISIPQLPDFLPILTPLFRKQMKRAKDLRKTQIECLVPLIRNRRAFVEKGENPKMEMLSPVGAAYVDSLFTLKAPGRGLLGEEELVTVCSELFVAGIDTSTSVLQWVFLELVLNQDIQEKLYREIVESVGKDGVINEEDVEKMNYLNAVVKETLRVHSPAHFTLSHATTEETELGGYKIPSNVNVEFYIEWMTEDPSLWKDPGIFRPERFIDGDGVNVDMTGTKGKVKMLPFGAGRRTCPGLALGLLHVNLMLARMVQAFKWLPAPNAPPDPTEAFAFTVVMKNPLKAVILPR

SEQ ID NO: 2417 - protein, 138 aa, Arabidopsis thaliana
  misc_feature (1)..(138): Ceres CLONE ID no. 118337
  misc_feature (26)..(62): Pfam Name: KOW Pfam Description: KOW motif
  misc_feature (84)..(137): Pfam Name: eIF-5a Pfam Description: Eukaryotic initiation factor 5A hypusine DNA-binding OB fold
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: INFLORESCENCE - Short Useful for modulating plant height
  misc_feature: Phenotype: ROSETTE LEAVES - Oval Shaped Useful for making plants with increased biomass and foliage
MSDDEHHFEASESGASKTYPQSAGNIRKGGHIVIKNRPCKVVEVSTSKTGKHGHAKCHFVAIDIFTAKKLEDIVPSSHNCDVPHVNRVDYQLIDITEDGFVSLLTDSGGTKDDLKLPTDDGLTAQLLCFVNAHEAWIR

SEQ ID NO: 2418 - DNA, 483 bp, Populus balsamifera subsp. trichocarpa
  misc_feature (1)..(483): Ceres ANNOT ID no. 1454773
  misc_feature 272203:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: INFLORESCENCE - Short Useful for modulating plant height
  misc_feature: Phenotype: ROSETTE LEAVES - Oval Shaped Useful for making plants with increased biomass and foliage
atgtcggacgaggagcaccactttgaatccaaggctgatgcaggagcctccaagacttaccctcagcaagctggtaccatccgtaagaatggttacatagtcattaagaaccgcccttgcaaggttgttgaggtttccacctcaaagacaggcaagcacggacatgctaagtgccactttgtgggaattgatatatttaatgggaaaaagcttgaagatattgttccctcatctcacaactgtgatgttccccatgttaatcgtgttgattatcaattgattgatatctctgaagatggttttgtgagtcttttgactgaaaatggaaataccaaggatgatctgaggcttcccactgatgacagtctacttactcagattaaagatggatttggcgaagggaaggaccttgtggtgtctgtcatgtctgccatgggagaggagcagatctgtgcccttaaggacattggcccaaaaaattga

SEQ ID NO: 2419 - protein, 160 aa, Populus balsamifera subsp. trichocarpa
  misc_feature (1)..(160): Ceres ANNOT ID no. 1454773
  misc_feature (27)..(63): Pfam Name: KOW Pfam Description: KOW motif
  misc_feature (85)..(154): Pfam Name: eIF-5a Pfam Description: Eukaryotic initiation factor 5A hypusine DNA-binding OB fold
  misc_feature: SWISSPROT Homolog: IF5A2_ARATH Eukaryotic translation initiation factor 5A-2 (eIF-5A-2) with e-value of 1.5e-65 and BLAST sequence identity of 99.2
  misc_feature: SWISSPROT Homolog: IF5A3_ARATH Eukaryotic translation initiation factor 5A-3 (eIF-5A-3) with e-value of 6.1e-60 and BLAST sequence identity of 89.7
  misc_feature: SWISSPROT Homolog: IF5A1_LYCES Eukaryotic translation initiation factor 5A-1 (eIF-5A-1) with e-value of 2.7e-57 and BLAST sequence identity of 85.8
  misc_feature: SWISSPROT Homolog: IF5A_DIACA Eukaryotic translation initiation factor 5A (eIF-5A) with e-value of 4.4e-57 and BLAST sequence identity of 85.8
  misc_feature: SWISSPROT Homolog: IF5A1_ARATH Eukaryotic translation initiation factor 5A-1 (eIF-5A-1) with e-value of 7.2e-57 and BLAST sequence identity of 84.9
  misc_feature 272320:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: INFLORESCENCE - Short Useful for modulating plant height
  misc_feature: Phenotype: ROSETTE LEAVES - Oval Shaped Useful for making plants with increased biomass and foliage
  misc_feature (1)..(160): Functional Homolog of  Ceres CLONE ID no. 118337 at SEQ ID NO. 2461 with e-value of 1.90E-55 and BLAST sequence identity of 83.3
MSDEEHHFESKADAGASKTYPQQAGTIRKNGYIVIKNRPCKVVEVSTSKTGKHGHAKCHFVGIDIFNGKKLEDIVPSSHNCDVPHVNRVDYQLIDISEDGFVSLLTENGNTKDDLRLPTDDSLLTQIKDGFGEGKDLVVSVMSAMGEEQICALKDIGPKN

SEQ ID NO: 2420 - DNA, 480 bp, Populus balsamifera subsp. trichocarpa
  misc_feature (1)..(480): Ceres ANNOT ID no. 1511811
  misc_feature 272407:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: INFLORESCENCE - Short Useful for modulating plant height
  misc_feature: Phenotype: ROSETTE LEAVES - Oval Shaped Useful for making plants with increased biomass and foliage
atgtctgacgaggagcatcacttcgagtcaaaggccgatgccggagcttcaaaaacttatcctcagcaagctggtaccattcgcaagaatggttacatagtcatcaagaatcgcccttgcaaggtcgtggaggtttcaacctccaaaactggcaagcatggccatgctaaatgtcactttgttgcgattgatattttcaatggaaaaaagcttgaagatattgttccttcttcccacaactgtgatgttccccacgtcacccgtactgactaccagctgattgatatctctgaggatggatttgtgagcttactgactgagaatggcaatactaaggatgacctgaaactcccaactgatgacagtctcctcactcagattaaggatggatttggtgaggggaaagatcttgttgtgacggtgatgtcttccatgggagaggagcagatctgcgccctcaaggacattggtcccaagtaa

SEQ ID NO: 2421 - protein, 159 aa, Populus balsamifera subsp. trichocarpa
  misc_feature (1)..(159): Ceres ANNOT ID no. 1511811
  misc_feature (27)..(63): Pfam Name: KOW Pfam Description: KOW motif
  misc_feature (85)..(154): Pfam Name: eIF-5a Pfam Description: Eukaryotic initiation factor 5A hypusine DNA-binding OB fold
  misc_feature: SWISSPROT Homolog: IF5A2_ARATH Eukaryotic translation initiation factor 5A-2 (eIF-5A-2) with e-value of 1.5e-65 and BLAST sequence identity of 99.2
  misc_feature: SWISSPROT Homolog: IF5A3_ARATH Eukaryotic translation initiation factor 5A-3 (eIF-5A-3) with e-value of 6.1e-60 and BLAST sequence identity of 89.7
  misc_feature: SWISSPROT Homolog: IF5A1_LYCES Eukaryotic translation initiation factor 5A-1 (eIF-5A-1) with e-value of 2.7e-57 and BLAST sequence identity of 85.8
  misc_feature: SWISSPROT Homolog: IF5A_DIACA Eukaryotic translation initiation factor 5A (eIF-5A) with e-value of 4.4e-57 and BLAST sequence identity of 85.8
  misc_feature: SWISSPROT Homolog: IF5A1_ARATH Eukaryotic translation initiation factor 5A-1 (eIF-5A-1) with e-value of 7.2e-57 and BLAST sequence identity of 84.9
  misc_feature 272524:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: INFLORESCENCE - Short Useful for modulating plant height
  misc_feature: Phenotype: ROSETTE LEAVES - Oval Shaped Useful for making plants with increased biomass and foliage
  misc_feature (1)..(159): Functional Homolog of  Ceres CLONE ID no. 118337 at SEQ ID NO. 2461 with e-value of 3.89E-55 and BLAST sequence identity of 83.3
MSDEEHHFESKADAGASKTYPQQAGTIRKNGYIVIKNRPCKVVEVSTSKTGKHGHAKCHFVAIDIFNGKKLEDIVPSSHNCDVPHVTRTDYQLIDISEDGFVSLLTENGNTKDDLKLPTDDSLLTQIKDGFGEGKDLVVTVMSSMGEEQICALKDIGPK

SEQ ID NO: 2422 - DNA, 483 bp, Populus balsamifera subsp. trichocarpa
  misc_feature (1)..(483): Ceres ANNOT ID no. 1478364
  misc_feature 272608:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: INFLORESCENCE - Short Useful for modulating plant height
  misc_feature: Phenotype: ROSETTE LEAVES - Oval Shaped Useful for making plants with increased biomass and foliage
atgtcggacgaggagcaccactttgaatcaaaggctgatgcaggagcctccaagacttaccctcagcaagctggtactatccgcaagaatggctatatagtcatcaagaaccgtccttgcaaggttgttgaggtttccacctcaaagacaggcaagcatggacatgctaagtgccactttgtggggattgatatatttaatgggaaaaagcttgaagatatcgttccttcatctcacaactgtgatgttccccatgttaatcgtactgattatcagctgattgatatctctgaagatggctttgtgagtcttttgactgaaaatggaaataccaaggatgatctgaggcttcccactgatgatagtctgcttactccgattaaagatgggtttggtgaaggaaaggaccttgtggtgactgtcatgtctgccatgggagaggagcagatctgtgcccttaaggacattggtccaaaaaattga

SEQ ID NO: 2423 - protein, 160 aa, Populus balsamifera subsp. trichocarpa
  misc_feature (1)..(160): Ceres ANNOT ID no. 1478364
  misc_feature (27)..(63): Pfam Name: KOW Pfam Description: KOW motif
  misc_feature (85)..(154): Pfam Name: eIF-5a Pfam Description: Eukaryotic initiation factor 5A hypusine DNA-binding OB fold
  misc_feature: SWISSPROT Homolog: IF5A2_ARATH Eukaryotic translation initiation factor 5A-2 (eIF-5A-2) with e-value of 1.5e-65 and BLAST sequence identity of 99.2
  misc_feature: SWISSPROT Homolog: IF5A3_ARATH Eukaryotic translation initiation factor 5A-3 (eIF-5A-3) with e-value of 6.1e-60 and BLAST sequence identity of 89.7
  misc_feature: SWISSPROT Homolog: IF5A1_LYCES Eukaryotic translation initiation factor 5A-1 (eIF-5A-1) with e-value of 2.7e-57 and BLAST sequence identity of 85.8
  misc_feature: SWISSPROT Homolog: IF5A_DIACA Eukaryotic translation initiation factor 5A (eIF-5A) with e-value of 4.4e-57 and BLAST sequence identity of 85.8
  misc_feature: SWISSPROT Homolog: IF5A1_ARATH Eukaryotic translation initiation factor 5A-1 (eIF-5A-1) with e-value of 7.2e-57 and BLAST sequence identity of 84.9
  misc_feature 272725:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: INFLORESCENCE - Short Useful for modulating plant height
  misc_feature: Phenotype: ROSETTE LEAVES - Oval Shaped Useful for making plants with increased biomass and foliage
  misc_feature (1)..(160): Functional Homolog of  Ceres CLONE ID no. 118337 at SEQ ID NO. 2461 with e-value of 2.20E-54 and BLAST sequence identity of 84.4
MSDEEHHFESKADAGASKTYPQQAGTIRKNGYIVIKNRPCKVVEVSTSKTGKHGHAKCHFVGIDIFNGKKLEDIVPSSHNCDVPHVNRTDYQLIDISEDGFVSLLTENGNTKDDLRLPTDDSLLTPIKDGFGEGKDLVVTVMSAMGEEQICALKDIGPKN

SEQ ID NO: 2424 - DNA, 480 bp, Populus balsamifera subsp. trichocarpa
  misc_feature (1)..(480): Ceres ANNOT ID no. 1464394
  misc_feature 272812:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: INFLORESCENCE - Short Useful for modulating plant height
  misc_feature: Phenotype: ROSETTE LEAVES - Oval Shaped Useful for making plants with increased biomass and foliage
atgtctgacgaggagcagcacttcgagtcaaaagctgatgcgggagcttcgaaaacttaccctcaacaagctggtaccattcgcaagagcggttacattgtcatcaagaatcgcccttgcaaggttgtggaggtttctacctctaaaactggcaagcacggccatgccaaatgtcactttgttgcaattgatatcttcaatggaaaaaaacttgaagatattgttccttcttcccacaactgtgatgttccccatgtcacccgtactgactatcagctgattgatatctcagaggatggatttgtgagcttgctgactgagaatggcaataccaaggatgacctgaggctcccaactgatgagagtctcctctctcagatcaaggatggatttggcgatgggaaagatcttgttgtgactgtgatgtcctccatgggagaggagcagatctgcgccctcaaggacgttggcccgaagtaa

SEQ ID NO: 2425 - protein, 159 aa, Populus balsamifera subsp. trichocarpa
  misc_feature (1)..(159): Ceres ANNOT ID no. 1464394
  misc_feature (27)..(63): Pfam Name: KOW Pfam Description: KOW motif
  misc_feature (85)..(154): Pfam Name: eIF-5a Pfam Description: Eukaryotic initiation factor 5A hypusine DNA-binding OB fold
  misc_feature: SWISSPROT Homolog: IF5A2_ARATH Eukaryotic translation initiation factor 5A-2 (eIF-5A-2) with e-value of 1.5e-65 and BLAST sequence identity of 99.2
  misc_feature: SWISSPROT Homolog: IF5A3_ARATH Eukaryotic translation initiation factor 5A-3 (eIF-5A-3) with e-value of 6.1e-60 and BLAST sequence identity of 89.7
  misc_feature: SWISSPROT Homolog: IF5A1_LYCES Eukaryotic translation initiation factor 5A-1 (eIF-5A-1) with e-value of 2.7e-57 and BLAST sequence identity of 85.8
  misc_feature: SWISSPROT Homolog: IF5A_DIACA Eukaryotic translation initiation factor 5A (eIF-5A) with e-value of 4.4e-57 and BLAST sequence identity of 85.8
  misc_feature: SWISSPROT Homolog: IF5A1_ARATH Eukaryotic translation initiation factor 5A-1 (eIF-5A-1) with e-value of 7.2e-57 and BLAST sequence identity of 84.9
  misc_feature 272929:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: INFLORESCENCE - Short Useful for modulating plant height
  misc_feature: Phenotype: ROSETTE LEAVES - Oval Shaped Useful for making plants with increased biomass and foliage
  misc_feature (1)..(159): Functional Homolog of  Ceres CLONE ID no. 118337 at SEQ ID NO. 2461 with e-value of 1.20E-53 and BLAST sequence identity of 80.9
MSDEEQHFESKADAGASKTYPQQAGTIRKSGYIVIKNRPCKVVEVSTSKTGKHGHAKCHFVAIDIFNGKKLEDIVPSSHNCDVPHVTRTDYQLIDISEDGFVSLLTENGNTKDDLRLPTDESLLSQIKDGFGDGKDLVVTVMSSMGEEQICALKDVGPK

SEQ ID NO: 2426 - protein, 583 aa, Arabidopsis thaliana
  misc_feature (1)..(583): Ceres CLONE ID no. 118640
  misc_feature (43)..(202): Pfam Name: MFS_1 Pfam Description: Major Facilitator Superfamily
  misc_feature: Utility: MSX Useful for making plants tolerant to low nitrogen
  misc_feature: Phenotype: WHOLE PLANT - MSX Useful for making plants tolerant to low nitrogen
MEAAKVYTQDGTVDLQGRPVLASKTGRWRACSFLLGYEAFERMAFYGIASNLVNYLTKRLHEDTISSVRNVNNWSGAVWITPIAGAYIADSYIGRFWTFTASSLIYVLGMILLTMAVTVKSLRPTCENGVCNKASSLQVTFFYISLYTIAIGAGGTKPNISTFGADQFDSYSIEEKKQKVSFFNWWMFSSFLGALFATLGLVYIQENLGWGLGYGIPTVGLLVSLVVFYIGTPFYRHKVIKTDNLAKDLVQVPIAAFKNRKLQCPDDHLELYELDSHYYKSNGKHQVHHTPVFRFLDKAAIKTSSRVPCTVTKVEVAKRVLGLIFIWLVTLIPSTLWAQVNTLFVKQGTTLDRKIGSNFQIPAASLGSFVTLSMLLSVPMYDQSFVPFMRKKTGNPRGITLLQRLGVGFAIQIVAIAIASAVEVKRMRVIKEFHITSPTQVVPMSIFWLLPQYSLLGIGDVFNAIGLLEFFYDQSPEEMQSLGTTFFTSGIGLGNFLNSFLVTMIDKITSKGGGKSWIGNNLNDSRLDYYYGFLVVISIVNMGLFVWAASKYVYKSDDDTKEFSGGGCVQMEAKALDTSPLSI

SEQ ID NO: 2427 - DNA, 1776 bp, Populus balsamifera subsp. trichocarpa
  misc_feature (1)..(1776): Ceres ANNOT ID no. 1479513
  misc_feature: Utility: MSX Useful for making plants tolerant to low nitrogen
  misc_feature 273164:<222: Transcription Factor
  misc_feature: Phenotype: WHOLE PLANT - MSX Useful for making plants tolerant to low nitrogen
atggataccaaatgctgcacccaagatggcactgtagatctccgtgggcgtcctgtccaagcctccagaactgggaaatggaaagcgtgtgcttttctggttggctatgaggcatttgaaaggatggctttctatggagtggcttcaaacttggtgaattacctgaccacccaactccatgaagagacggttgcatcggtgaggaatgtgaataactggtcaggagcagtgtggatcacaccaatactcggcgcctacatagcagatacttacctgggtcgatactggacgttcactgtgtcatctcttatctatgcaatgggaatgatactactaacaatggcagtttcattcaagttcatgaaaccaacatgcacaaatggagtctgcaataaggcctccccttcgcaaatcgcattcttttactctgctctctacatcatagcaataggggcaggagggacgaagcccaacatatcaacttttggtgcagaccagttcgatgattataacccgcaagaaaagaagctcaaggtctcattctttaactggtggatgttcagctcttttgtgggagctctgtttgccactctctgccttgtgtacattcaagagaacttgggttggggtttagggtatggtatccctgcagttggtcttttattatccctgtttatattctatctagggacaccaatttacaggcataaagttagaaagactaagagccctgcaagggagctatttcaagtcctcattgctgcctttaacaacaggaaacttcagctccctaacagtccctcggagcttcaggagtttgacctgcaatattacattcaaaccggaaaacggcaggtccaccacacaccagtgttgaggtgcttggacaaagctgcgatcaaagatggcagcaataatgcagatacctcaaacccatcatcatcgtcatgcacagtgacgcaggtagaaggagtcaagctcgtttttggaatgatgctgatatggctggtgacattaatccctagtaccatatgggcacagatcaacactttatttgtgaaacaagggacaacgttggaccgcaacttgggcccaaacttccaaattccagcagcttcactcggtagctttgtgacgttttcaatgcttctctccgtgccaatgtatgaccgtttctttgtaccattcatgcgtaagaagaccggaaacccaaggggaatcacgttacttcagaggctgggcatcggattcgccattcaagtgattgccattgcaatcgcttacgctgttgaagttcgaagaatgcacgtcataagaatgcaccacgttgttgggccaaaggaaatcgtccccatgagtatattttggctgttgcctcagtatgttctgctgggaatcgctgatgtttttaatgctatcggattgctggaatttttctacgatcaatctcctgaagacatgcaaagcctaggaaccacattcttcactagtgggatcggtgtcggcaacttcttgaatagctttctagtaacaatggttgccaagattacagggaccggaggaggcaagagttggatcggcaacaacttgaatgactcccacttggattattactacgggttcctcttagttatatctgcccttaatttaggggtcttcttgtgggcatcaagtagatatgtttacaagaaggaaaccctacaagcactgaacgaggattgtatccgaatcgacggcaaaaccatggacacgtctcctctagggttgcaagtataa

SEQ ID NO: 2428 - protein, 591 aa, Populus balsamifera subsp. trichocarpa
  misc_feature (1)..(591): Ceres ANNOT ID no. 1479513
  misc_feature (95)..(499): Pfam Name: PTR2 Pfam Description: POT family
  misc_feature: SWISSPROT Homolog: PTR2_ARATH Peptide transporter PTR2 (Histidine-transporting protein) with e-value of 9.8e-124 and BLAST sequence identity of 41.4
  misc_feature: SWISSPROT Homolog: CHL1_ARATH Nitrate/chlorate transporter with e-value of 4.4e-89 and BLAST sequence identity of 36.2
  misc_feature: SWISSPROT Homolog: S15A1_RABIT Oligopeptide transporter, small intestine isoform with e-value of 1.3e-29 and BLAST sequence identity of 30.4
  misc_feature: SWISSPROT Homolog: S15A1_RABIT Peptide transporter 1 Intestinal H(+)/peptide cotransporter Solute carrier family 15 member 1
  misc_feature: SWISSPROT Homolog: S15A1_RAT Oligopeptide transporter, small intestine isoform with e-value of 5.0e-29 and BLAST sequence identity of 29.7
  misc_feature: SWISSPROT Homolog: S15A1_RAT Peptide transporter 1 Intestinal H(+)/peptide cotransporter Solute carrier family 15 member 1 (Proton-coupled dipeptide cotransporter)
  misc_feature: SWISSPROT Homolog: OPT3_CAEEL Putative oligopeptide transporter opt-3 with e-value of 7.2e-29 and BLAST sequence identity of 30.7
  misc_feature: Utility: MSX Useful for making plants tolerant to low nitrogen
  misc_feature 273315:<222: Transcription Factor
  misc_feature: Phenotype: WHOLE PLANT - MSX Useful for making plants tolerant to low nitrogen
  misc_feature (1)..(591): Functional Homolog of  Ceres CLONE ID no. 118640 at SEQ ID NO. 2470 with e-value of 2.10E-239 and BLAST sequence identity of 75.5
MDTKCCTQDGTVDLRGRPVQASRTGKWKACAFLVGYEAFERMAFYGVASNLVNYLTTQLHEETVASVRNVNNWSGAVWITPILGAYIADTYLGRYWTFTVSSLIYAMGMILLTMAVSFKFMKPTCTNGVCNKASPSQIAFFYSALYIIAIGAGGTKPNISTFGADQFDDYNPQEKKLKVSFFNWWMFSSFVGALFATLCLVYIQENLGWGLGYGIPAVGLLLSLFIFYLGTPIYRHKVRKTKSPARELFQVLIAAFNNRKLQLPNSPSELQEFDLQYYIQTGKRQVHHTPVLRCLDKAAIKDGSNNADTSNPSSSSCTVTQVEGVKLVFGMMLIWLVTLIPSTIWAQINTLFVKQGTTLDRNLGPNFQIPAASLGSFVTFSMLLSVPMYDRFFVPFMRKKTGNPRGITLLQRLGIGFAIQVIAIAIAYAVEVRRMHVIRMHHVVGPKEIVPMSIFWLLPQYVLLGIADVFNAIGLLEFFYDQSPEDMQSLGTTFFTSGIGVGNFLNSFLVTMVAKITGTGGGKSWIGNNLNDSHLDYYYGFLLVISALNLGVFLWASSRYVYKKETLQALNEDCIRIDGKTMDTSPLGLQV

SEQ ID NO: 2429 - protein, 525 aa, Arabidopsis thaliana
  misc_feature (1)..(525): Ceres CLONE ID no. 118648
  misc_feature (56)..(342): Pfam Name: DAO Pfam Description: FAD dependent oxidoreductase
  misc_feature: Phenotype: WHOLE PLANT - Large Useful for making bigger plants
  misc_feature: Phenotype: INFLORESCENCE - Strong Useful for making stronger plants
MAPTIFVDHCILTTTFVASLFAFLLLYVLGRRSKTIHGSVNVRNGTLTVKSGTDVDIIIVGAGVAGAALAHTLGKEGRRVHVIERDLTEPDRIVGELLQPGGYLKLIELGLEDCVKDIDAQRVLGYALFKDGKHTKLSYPLDQFDSDVAGRSFHNGRFVQRMREKASLLPNVRMKQGTVTSLVEENGIIKGVQYKTKDGQELKSFAPLTIVCDGCFSNLRRSLCKPKVEVPSNFVGLVLENCELPFPNHGHVVLGDPSPILFYPISSSEVRCLVDVPGSKLPSVASGEMAHHLKTMVAPQVPPQIRDAFISAVEKGNIRTMPNRSMPADPIHTPGALLLGDAFNMRHPLTGGGMTVALSDIVILRDLLNPLVDLTNKESLSKYIESFYTLRKPVASTINTLAGALYKVFLASPDDARSEMRRACFDYLSLGGVCSSGPVALLSGLNPRPMSLVLHFFAVAIFGVGRLLVPLPSVKRLWLGARLISSASGIIFPIIKAEGVRQMFFPRTIPAIYRAPPTPSSSSPQ

SEQ ID NO: 2430 - DNA, 1839 bp, Populus balsamifera subsp. trichocarpa
  misc_feature (1)..(1839): Ceres ANNOT ID no. 1510664
  misc_feature 273593:<222: Transcription Factor
  misc_feature: Phenotype: WHOLE PLANT - Large Useful for making bigger plants
  misc_feature: Phenotype: INFLORESCENCE - Strong Useful for making stronger plants
atgaatttggagctcaccagggtaccacgacaactcccgctccaccacaaccacacgttaaaagtctctctccataaagggaaaccttcccctaaaatctctatctaccttgccttctccgtatcctcttcaagaagcaccaaaccacaaacaccccacaggagaagagaacctaaagaaccaatctttgttttctcttcttcttcctcttcttcttcttctgtgcatcagtgtcataattattatataaagaagatgacggtggtgattgataagcacaatgtccttgtgggcactttctttgcctttcttttcttgtacattttgcgccaaaatatctggaaaagagaaaagatcaggaagagaacaacattgaagatccaaaacgatagtgctgtgtctgtcttaaggcatgaaaatggaggaggcttctcctctgctgatgacgtcattgttgtcggtgctggtgttgctggtgctgccttggcttatactcttggcaaggatggaagacgtgttcatgtgatagaaagagacatgaaagagcctgacagaattgtcggtgaactgctccaacccgggggatatctaaaattaatcgaattaggccttgaggattgtgtggaggaaattgatgcccaacgagtgcttggatatgctctcttcaaggatgggaagaatactagattgtcataccctttggaaaaattccacacagatgtttctgggagaagcttccataatggacgtttcattcagaggatgagagaaaaggctgctaccctgcccaatgtaagactagaacaaggaacagtcacatctctgcttgaagaagatgggactgttaagggtgttcaatacaaaacgaaggatggccaagaacttaaagcttatgctcctcttacaattgtgtgtgatggctgcttctcaaatctgcgccgctctctatgcaaccctaaggttgatgtgccttcgtgtttcgtgggtttgatcctggagaactgtcagcttccatttgaaaatcatgggcatgtcattctagcagatccatcaccaattttgttttatccgattagcagcacagaggttcgctgtttggttgatgtaccaggtcgaaaagtgccttccattgctaatggtgaaatggccaattatttaaagaacatggttgcaccacagattccatctgagcttcgcaatgccttcatatctgctatagataaaggtaatatcaggaccatgccaaatagaagcatgccagcggaaccacatcctactcctggagcgcttctgatgggtgatgctttcaacatgcgtcatccattaactggtggtgggatgactgtggcattgtctgatattgttgtacttcgtgatcttcttaaaccacttcgtgaccttaatgatgcagcttcgttgaccaaatatcttgaatccttttacaccttgcgcaagccagttgcatctacgataaatactctagcaggtgctttgtataaagtgttctctgcttcctctgatgatgcaaggaaggaaatgcgcgaagcatgttttgactatttaagccttgggggtaatttctcagcaggacctgtggcattactgtctggtctaaaccctcgtccactgagtttggtccttcatttctttgcggttgccgtatatggtgttggtcgtttgctacttccatttccatcgcctaaacgcgtgtggattggagcgagattaatttcgagtgcatcaggcattattttcccaattatcaaagcagagggagtgaggcaaatgtttttccctgccactattcctgctgtttatagagctcctcctgttgattga

SEQ ID NO: 2431 - protein, 527 aa, Populus balsamifera subsp. trichocarpa
  misc_feature (1)..(527): Ceres ANNOT ID no. 1510664
  misc_feature (64)..(453): Pfam Name: DAO Pfam Description: FAD dependent oxidoreductase
  misc_feature: SWISSPROT Homolog: ERG1_PANGI Squalene monooxygenase (EC 1.14.99.7) (Squalene epoxidase) (SE) with e-value of 1.0e-206 and BLAST sequence identity of 74.4
  misc_feature: SWISSPROT Homolog: ERG11_ARATH Squalene monooxygenase 1,1 (EC 1.14.99.7) (Squalene epoxidase 1,1) (SE 1,1) with e-value of 7.2e-128 and BLAST sequence identity of 48.8
  misc_feature: SWISSPROT Homolog: ERG12_BRANA Squalene monooxygenase 1,2 (EC 1.14.99.7) (Squalene epoxidase 1,2) (SE 1,2) with e-value of 6.9e-123 and BLAST sequence identity of 46.9
  misc_feature: SWISSPROT Homolog: ERG12_ARATH Squalene monooxygenase 1,2 (EC 1.14.99.7) (Squalene epoxidase 1,2) (SE 1,2) with e-value of 4.9e-122 and BLAST sequence identity of 46.5
  misc_feature: SWISSPROT Homolog: ERG11_BRANA Squalene monooxygenase 1,1 (EC 1.14.99.7) (Squalene epoxidase 1,1) (SE 1,1) with e-value of 1.5e-120 and BLAST sequence identity of 47.7
  misc_feature 273733:<222: Transcription Factor
  misc_feature: Phenotype: WHOLE PLANT - Large Useful for making bigger plants
  misc_feature: Phenotype: INFLORESCENCE - Strong Useful for making stronger plants
  misc_feature (1)..(527): Functional Homolog of  Ceres CLONE ID no. 118648 at SEQ ID NO. 2473 with e-value of 6.19E-215 and BLAST sequence identity of 77.4
MTVVIDKHNVLVGTFFAFLFLYILRQNIWKREKIRKRTTLKIQNDSAVSVLRHENGGGFSSADDVIVVGAGVAGAALAYTLGKDGRRVHVIERDMKEPDRIVGELLQPGGYLKLIELGLEDCVEEIDAQRVLGYALFKDGKNTRLSYPLEKFHTDVSGRSFHNGRFIQRMREKAATLPNVRLEQGTVTSLLEEDGTVKGVQYKTKDGQELKAYAPLTIVCDGCFSNLRRSLCNPKVDVPSCFVGLILENCQLPFENHGHVILADPSPILFYPISSTEVRCLVDVPGRKVPSIANGEMANYLKNMVAPQIPSELRNAFISAIDKGNIRTMPNRSMPAEPHPTPGALLMGDAFNMRHPLTGGGMTVALSDIVVLRDLLKPLRDLNDAASLTKYLESFYTLRKPVASTINTLAGALYKVFSASSDDARKEMREACFDYLSLGGNFSAGPVALLSGLNPRPLSLVLHFFAVAVYGVGRLLLPFPSPKRVWIGARLISSASGIIFPIIKAEGVRQMFFPATIPAVYRAPPVD

SEQ ID NO: 2432 - DNA, 1866 bp, Populus balsamifera subsp. trichocarpa
  misc_feature (1)..(1866): Ceres ANNOT ID no. 1457458
  misc_feature 273872:<222: Transcription Factor
  misc_feature: Phenotype: WHOLE PLANT - Large Useful for making bigger plants
  misc_feature: Phenotype: INFLORESCENCE - Strong Useful for making stronger plants
atgaatttggagctcaccagggtaccacgacaactcccgctccaccacaaccacacgttaaaagtctctctccataaagggaaaccttcccctaaaatctctatctaccttgccttctccgtatcctcttcaagaagcaccaaaccacaaacaccccacaggagaagagaacctaaagaaccaatctttgttttctcttcttcttcctcttcttcttcttctgtgcatcagtgtcataattattatataaagaagatgacggtggtgattgataagcacaatgtccttgtgggcactttctttgcctttcttttcttgtacattttgcgccaaaatatctggaaaagagaaaagatcaggaagagaacaacattgaagatccaaaacgatagtgctgtgtctgtcttaaggcatgaaaatggaggaggcttctcctctgctgatgacgtcattgttgtcggtgctggtgttgctggtgctgccttggcttatactcttggcaaggatggaagacgtgttcatgtgatagaaagagacatgaaagagcctgacagaattgtcggtgaactgctccaacccgggggatatctaaaattaatcgaattaggccttgaggaatgtaaagcattctctctgaatgcagattgtgtggaggaaattgatgcccaacgagtgcttggatatgctctcttcaaggatgggaagaatactagattgtcataccctttggaaaaattccacacagatgtttctgggagaagcttccataatggacgtttcattcagaggatgagagaaaaggctgctaccctgcccaatgtaagactagaacaaggaacagtcacatctctgcttgaagaagatgggactgttaagggtgttcaatacaaaacgaaggatggccaagaacttaaagcttatgctcctcttacaattgtgtgtgatggctgcttctcaaatctgcgccgctctctatgcaaccctaaggttgatgtgccttcgtgtttcgtgggtttgatcctggagaactgtcagcttccatttgaaaatcatgggcatgtcattctagcagatccatcaccaattttgttttatccgattagcagcacagaggttcgctgtttggttgatgtaccaggtcgaaaagtgccttccattgctaatggtgaaatggccaattatttaaagaacatggttgcaccacagattccatctgagcttcgcaatgccttcatatctgctatagataaaggtaatatcaggaccatgccaaatagaagcatgccagcggaaccacatcctactcctggagcgcttctgatgggtgatgctttcaacatgcgtcatccattaactggtggtgggatgactgtggcattgtctgatattgttgtacttcgtgatcttcttaaaccacttcgtgaccttaatgatgcagcttcgttgaccaaatatcttgaatccttttacaccttgcgcaagccagttgcatctacgataaatactctagcaggtgctttgtataaagtgttctctgcttcctctgatgatgcaaggaaggaaatgcgcgaagcatgttttgactatttaagccttgggggtaatttctcagcaggacctgtggcattactgtctggtctaaaccctcgtccactgagtttggtccttcatttctttgcggttgccgtatatggtgttggtcgtttgctacttccatttccatcgcctaaacgcgtgtggattggagcgagattaatttcgagtgcatcaggcattattttcccaattatcaaagcagagggagtgaggcaaatgtttttccctgccactattcctgctgtttatagagctcctcctgttgattga

SEQ ID NO: 2433 - protein, 536 aa, Populus balsamifera subsp. trichocarpa
  misc_feature (1)..(536): Ceres ANNOT ID no. 1457458
  misc_feature (64)..(462): Pfam Name: DAO Pfam Description: FAD dependent oxidoreductase
  misc_feature: SWISSPROT Homolog: ERG1_PANGI Squalene monooxygenase (EC 1.14.99.7) (Squalene epoxidase) (SE) with e-value of 1.0e-206 and BLAST sequence identity of 74.4
  misc_feature: SWISSPROT Homolog: ERG11_ARATH Squalene monooxygenase 1,1 (EC 1.14.99.7) (Squalene epoxidase 1,1) (SE 1,1) with e-value of 7.2e-128 and BLAST sequence identity of 48.8
  misc_feature: SWISSPROT Homolog: ERG12_BRANA Squalene monooxygenase 1,2 (EC 1.14.99.7) (Squalene epoxidase 1,2) (SE 1,2) with e-value of 6.9e-123 and BLAST sequence identity of 46.9
  misc_feature: SWISSPROT Homolog: ERG12_ARATH Squalene monooxygenase 1,2 (EC 1.14.99.7) (Squalene epoxidase 1,2) (SE 1,2) with e-value of 4.9e-122 and BLAST sequence identity of 46.5
  misc_feature: SWISSPROT Homolog: ERG11_BRANA Squalene monooxygenase 1,1 (EC 1.14.99.7) (Squalene epoxidase 1,1) (SE 1,1) with e-value of 1.5e-120 and BLAST sequence identity of 47.7
  misc_feature 274014:<222: Transcription Factor
  misc_feature: Phenotype: WHOLE PLANT - Large Useful for making bigger plants
  misc_feature: Phenotype: INFLORESCENCE - Strong Useful for making stronger plants
  misc_feature (1)..(536): Functional Homolog of  Ceres CLONE ID no. 118648 at SEQ ID NO. 2473 with e-value of 2.79E-212 and BLAST sequence identity of 77.4
MTVVIDKHNVLVGTFFAFLFLYILRQNIWKREKIRKRTTLKIQNDSAVSVLRHENGGGFSSADDVIVVGAGVAGAALAYTLGKDGRRVHVIERDMKEPDRIVGELLQPGGYLKLIELGLEECKAFSLNADCVEEIDAQRVLGYALFKDGKNTRLSYPLEKFHTDVSGRSFHNGRFIQRMREKAATLPNVRLEQGTVTSLLEEDGTVKGVQYKTKDGQELKAYAPLTIVCDGCFSNLRRSLCNPKVDVPSCFVGLILENCQLPFENHGHVILADPSPILFYPISSTEVRCLVDVPGRKVPSIANGEMANYLKNMVAPQIPSELRNAFISAIDKGNIRTMPNRSMPAEPHPTPGALLMGDAFNMRHPLTGGGMTVALSDIVVLRDLLKPLRDLNDAASLTKYLESFYTLRKPVASTINTLAGALYKVFSASSDDARKEMREACFDYLSLGGNFSAGPVALLSGLNPRPLSLVLHFFAVAVYGVGRLLLPFPSPKRVWIGARLISSASGIIFPIIKAEGVRQMFFPATIPAVYRAPPVD

SEQ ID NO: 2434 - DNA, 1722 bp, Populus balsamifera subsp. trichocarpa
  misc_feature (1)..(1722): Ceres ANNOT ID no. 1443693
  misc_feature 274156:<222: Transcription Factor
  misc_feature: Phenotype: WHOLE PLANT - Large Useful for making bigger plants
  misc_feature: Phenotype: INFLORESCENCE - Strong Useful for making stronger plants
atggcggatcagtgcatgctaggatggattttagctactttgtttgttctcttcgctatctattgtttggtaattaagaagaaggaacggggtactaaaaaggatttgctagaatcgagaagtgagtccgttaattgcacagccaccaccaatgaagaatgcagatccggtaacgtttccgatgccgacgttatcattgtcggcgccggtgttgctggcgccgctcttgctcatactcttggcaaggatggacgtcgagtgcgcgtcattgaaagagacctgactgagcccgataggattgttggtgaattgctacagccagggggttacttaaagttaattgagttgggacttgaagattgtgtagagaaaattgatgctcagaaggtgtttggttatgctcttttcaaggatggaatgcatactcgactctcttatcccttggaaaagtttcactcagatgtagccggaaggagctttcacaatgggcgtttcatacagaggatgcgggaaaaagctgtgtccctccccaatgtacatttggagcaaggaactgtgacttctctgctcgaagagaaagggacaattagaggcgtgcagtacaaaacaaaagatgggcaagagctgacggcatttgctcctctgactattgtttgtgatggctgtttctcaaacctgcgccgctccctttgcgaccctaaggtggatgtgccctcatgttttgttggtatgatcctggagaattgccaacttccatgtgcaaatcatgggcatgttatattaggggatccatctccaattttgatgtatcctattagcagcacggagactcgctgtctggttgatattcctggtcagaaggttccttccatttcaagtggtgaaatggcaaaatatttgaagactctggtagcacctcagcttcccccggaagtttatgatgcctttctagctgcagttgataaaggaaacattaggacaatgccaaacagaagcatgccagctgctccttatcctactcccggtgcattgttgatgggcgatgcattcaatatgcggcatcctctaactgggggagggatgactgttgcgttgtccgacattgttgtgctacggaatcttctcaggcctttgcgtgaccttaatgattcccctaacctctgcaaataccttgaatctttctacaccttgcgtaagcctgtagcatccacaatcaatacactggcaggtgcactttacaaggtcttctgtgcttcacctgatgaagcaaggaaggaaatgcgccaggcatgctttgattatttaagtcttggaggtgtatgttcagaaggaccagtgtctctgctctcaggtttgaacccccgtccgttgagcttggttgcccacttctttgcagttgctatatatggtgttggtcgtttgttactgccattcccttcacctaaacgcatctggattggagctagattgatttcaagtgcatcgggaattatcttccccatcattaggtcagaaggagttagacaaatgttcttccctgcaactgttcctgcatattacagatctcctccagtcatgacatttcatcgacctgcactgctggtaaggctcactgtaaaaaacgaagacaaggaaagacgggaagaaaataaaagagcacgcaggaagcccccccgacggctttgtcccgctcttgacacaaatctgcgactcgtaaaatga

SEQ ID NO: 2435 - protein, 573 aa, Populus balsamifera subsp. trichocarpa
  misc_feature (1)..(573): Ceres ANNOT ID no. 1443693
  misc_feature (63)..(319): Pfam Name: DAO Pfam Description: FAD dependent oxidoreductase
  misc_feature: SWISSPROT Homolog: ERG1_PANGI Squalene monooxygenase (EC 1.14.99.7) (Squalene epoxidase) (SE) with e-value of 1.0e-206 and BLAST sequence identity of 74.4
  misc_feature: SWISSPROT Homolog: ERG11_ARATH Squalene monooxygenase 1,1 (EC 1.14.99.7) (Squalene epoxidase 1,1) (SE 1,1) with e-value of 7.2e-128 and BLAST sequence identity of 48.8
  misc_feature: SWISSPROT Homolog: ERG12_BRANA Squalene monooxygenase 1,2 (EC 1.14.99.7) (Squalene epoxidase 1,2) (SE 1,2) with e-value of 6.9e-123 and BLAST sequence identity of 46.9
  misc_feature: SWISSPROT Homolog: ERG12_ARATH Squalene monooxygenase 1,2 (EC 1.14.99.7) (Squalene epoxidase 1,2) (SE 1,2) with e-value of 4.9e-122 and BLAST sequence identity of 46.5
  misc_feature: SWISSPROT Homolog: ERG11_BRANA Squalene monooxygenase 1,1 (EC 1.14.99.7) (Squalene epoxidase 1,1) (SE 1,1) with e-value of 1.5e-120 and BLAST sequence identity of 47.7
  misc_feature 274292:<222: Transcription Factor
  misc_feature: Phenotype: WHOLE PLANT - Large Useful for making bigger plants
  misc_feature: Phenotype: INFLORESCENCE - Strong Useful for making stronger plants
  misc_feature (1)..(573): Functional Homolog of  Ceres CLONE ID no. 118648 at SEQ ID NO. 2473 with e-value of 6.60E-211 and BLAST sequence identity of 75.9
MADQCMLGWILATLFVLFAIYCLVIKKKERGTKKDLLESRSESVNCTATTNEECRSGNVSDADVIIVGAGVAGAALAHTLGKDGRRVRVIERDLTEPDRIVGELLQPGGYLKLIELGLEDCVEKIDAQKVFGYALFKDGMHTRLSYPLEKFHSDVAGRSFHNGRFIQRMREKAVSLPNVHLEQGTVTSLLEEKGTIRGVQYKTKDGQELTAFAPLTIVCDGCFSNLRRSLCDPKVDVPSCFVGMILENCQLPCANHGHVILGDPSPILMYPISSTETRCLVDIPGQKVPSISSGEMAKYLKTLVAPQLPPEVYDAFLAAVDKGNIRTMPNRSMPAAPYPTPGALLMGDAFNMRHPLTGGGMTVALSDIVVLRNLLRPLRDLNDSPNLCKYLESFYTLRKPVASTINTLAGALYKVFCASPDEARKEMRQACFDYLSLGGVCSEGPVSLLSGLNPRPLSLVAHFFAVAIYGVGRLLLPFPSPKRIWIGARLISSASGIIFPIIRSEGVRQMFFPATVPAYYRSPPVMTFHRPALLVRLTVKNEDKERREENKRARRKPPRRLCPALDTNLRLVK

SEQ ID NO: 2436 - DNA, 1581 bp, Populus balsamifera subsp. trichocarpa
  misc_feature (1)..(1581): Ceres ANNOT ID no. 1496628
  misc_feature 274440:<222: Transcription Factor
  misc_feature: Phenotype: WHOLE PLANT - Large Useful for making bigger plants
  misc_feature: Phenotype: INFLORESCENCE - Strong Useful for making stronger plants
atggcggatcagtgcatgctaggatggattttagctactttgtttgttctcttcgctatctattgtttggtaattaagaagaaggaacggggtactaaaaaggatttgctagaatcgagaagtgagtccgttaattgcacagccaccaccaatgaagaatgcagatccggtaacgtttccgatgccgacgttatcattgtcggcgccggtgttgctggcgccgctcttgctcatactcttggcaaggatggacgtcgagtgcgcgtcattgaaagagacctgactgagcccgataggattgttggtgaattgctacagccagggggttacttaaagttaattgagttgggacttgaagattgtgtagagaaaattgatgctcagaaggtgtttggttatgctcttttcaaggatggaatgcatactcgactctcttatcccttggaaaagtttcactcagatgtagccggaaggagctttcacaatgggcgtttcatacagaggatgcgggaaaaagctgtgtccctccccaatgtacatttggagcaaggaactgtgacttctctgctcgaagagaaagggacaattagaggcgtgcagtacaaaacaaaagatgggcaagagctgacggcatttgctcctctgactattgtttgtgatggctgtttctcaaacctgcgccgctccctttgcgaccctaaggtggatgtgccctcatgttttgttggtatgatcctggagaattgccaacttccatgtgcaaatcatgggcatgttatattaggggatccatctccaattttgatgtatcctattagcagcacggagactcgctgtctggttgatattcctggtcagaaggttccttccatttcaagtggtgaaatggcaaaatatttgaagactctggtagcacctcagcttcccccggaagtttatgatgcctttctagctgcagttgataaaggaaacattaggacaatgccaaacagaagcatgccagctgctccttatcctactcccggtgcattgttgatgggcgatgcattcaatatgcggcatcctctaactgggggagggatgactgttgcgttgtccgacattgttgtgctacggaatcttctcaggcctttgcgtgaccttaatgattcccctaacctctgcaaataccttgaatctttctacaccttgcgtaagcctgtagcatccacaatcaatacactggcaggtgcactttacaaggtcttctgtgcttcacctgatgaagcaaggaaggaaatgcgccaggcatgctttgattatttaagtcttggaggtgtatgttcagaaggaccagtgtctctgctctcaggtttgaacccccgtccgttgagcttggttgcccacttctttgcagttgctatatatggtgttggtcgtttgttactgccattcccttcacctaaacgcatctggattggagctagattgatttcaagtgcatcgggaattatcttccccatcattaggtcagaaggagttagacaaatgttcttccctgcaactgttcctgcatattacagatctcctccagtcatgtga

SEQ ID NO: 2437 - protein, 526 aa, Populus balsamifera subsp. trichocarpa
  misc_feature (1)..(526): Ceres ANNOT ID no. 1496628
  misc_feature (63)..(319): Pfam Name: DAO Pfam Description: FAD dependent oxidoreductase
  misc_feature: SWISSPROT Homolog: ERG1_PANGI Squalene monooxygenase (EC 1.14.99.7) (Squalene epoxidase) (SE) with e-value of 1.0e-206 and BLAST sequence identity of 74.4
  misc_feature: SWISSPROT Homolog: ERG11_ARATH Squalene monooxygenase 1,1 (EC 1.14.99.7) (Squalene epoxidase 1,1) (SE 1,1) with e-value of 7.2e-128 and BLAST sequence identity of 48.8
  misc_feature: SWISSPROT Homolog: ERG12_BRANA Squalene monooxygenase 1,2 (EC 1.14.99.7) (Squalene epoxidase 1,2) (SE 1,2) with e-value of 6.9e-123 and BLAST sequence identity of 46.9
  misc_feature: SWISSPROT Homolog: ERG12_ARATH Squalene monooxygenase 1,2 (EC 1.14.99.7) (Squalene epoxidase 1,2) (SE 1,2) with e-value of 4.9e-122 and BLAST sequence identity of 46.5
  misc_feature: SWISSPROT Homolog: ERG11_BRANA Squalene monooxygenase 1,1 (EC 1.14.99.7) (Squalene epoxidase 1,1) (SE 1,1) with e-value of 1.5e-120 and BLAST sequence identity of 47.7
  misc_feature 274572:<222: Transcription Factor
  misc_feature: Phenotype: WHOLE PLANT - Large Useful for making bigger plants
  misc_feature: Phenotype: INFLORESCENCE - Strong Useful for making stronger plants
  misc_feature (1)..(526): Functional Homolog of  Ceres CLONE ID no. 118648 at SEQ ID NO. 2473 with e-value of 1.10E-210 and BLAST sequence identity of 76.8
MADQCMLGWILATLFVLFAIYCLVIKKKERGTKKDLLESRSESVNCTATTNEECRSGNVSDADVIIVGAGVAGAALAHTLGKDGRRVRVIERDLTEPDRIVGELLQPGGYLKLIELGLEDCVEKIDAQKVFGYALFKDGMHTRLSYPLEKFHSDVAGRSFHNGRFIQRMREKAVSLPNVHLEQGTVTSLLEEKGTIRGVQYKTKDGQELTAFAPLTIVCDGCFSNLRRSLCDPKVDVPSCFVGMILENCQLPCANHGHVILGDPSPILMYPISSTETRCLVDIPGQKVPSISSGEMAKYLKTLVAPQLPPEVYDAFLAAVDKGNIRTMPNRSMPAAPYPTPGALLMGDAFNMRHPLTGGGMTVALSDIVVLRNLLRPLRDLNDSPNLCKYLESFYTLRKPVASTINTLAGALYKVFCASPDEARKEMRQACFDYLSLGGVCSEGPVSLLSGLNPRPLSLVAHFFAVAIYGVGRLLLPFPSPKRIWIGARLISSASGIIFPIIRSEGVRQMFFPATVPAYYRSPPVM

SEQ ID NO: 2438 - DNA, 1581 bp, Populus balsamifera subsp. trichocarpa
  misc_feature (1)..(1581): Ceres ANNOT ID no. 1451509
  misc_feature 274711:<222: Transcription Factor
  misc_feature: Phenotype: WHOLE PLANT - Large Useful for making bigger plants
  misc_feature: Phenotype: INFLORESCENCE - Strong Useful for making stronger plants
atggcggatcagtgcatgccaggatggatcttagctactctgtttggtctctctgctatctattatttggtaaccaagaaaaaggaacagagagctaataaggatttgttggaggcgagaagcgagtccgttaatagcatagccaccaccagtggagaatgcagatccagtaatgtttccgatgtcgacgttatcattgtcggcgccggtgttgctggcgctgctctcgctcatactcttggcaaggatggacgtcaagtgcatgtcattgaaagagacttgactgagcctgataggattgtgggtgaatttctacagccagggggttaccttaagttaattgaattgggacttgaagattgtgtggagaaaattgatgctcagagggtgtttggttatgcacttttcaaggatggaaaacatactcgactctcttatcctttggaaaagttccactcaaatgtagctggaaggagctttcacaatgggcgtttcatacagagaatgcgggacaaagctgcgtccctccccaatgtacaattggagcaaggaactgtcatatctctacttgaagataaagggactattagaggcgtgcagtacaaaacaaaagatgggcaagagctgaaggcatttgcacctctgacaattgtttgtgatggctgtttctcaaacctgcgccgctccctttgcaaccctaaggtggatgtgccctcttgttttgttggcatggtcctggagaattgccagcttccatgtgcaaatcatgctcatgttatcttaggggatccgtctccgattttgatgtatcctattagcagtaccgaggtccgctgtctggttgatgtacctggtcagaaggttccttccatttcaagtggtgaaatggcaaaatatttgaagactgtggtggcacctcagcttcccccagaagtttatgatgcctttctagctgctgttgataaaggaaatataaggacaatgccaaacagaagcatgccagctgctccttatcctactcctggtgcattgttgatgggcgatgcattcaacatgcgtcatcctcttaccgggggaggaatgactgttgcattgtctgacattgttgttttacggaatcttctcaggcctttgcgcaaccttaatgatgcacctacactctgcaaatatcttgaatctttctacaccttgcgcaagcctgtagcatccacaatcaatacactggcaggtgccctctacaaggttttttgtgcttcacctgatcaagcaatgaaggaaatgcgtcaggcgtgctttgattatttaagtcttggaggcgttttttcagcaggacccgtgtctttgctctcaggcttaaacccccgtccgttgagcttggttgcccacttctttgcggttgctatatacggggttgggcgtttgttactgccattcccttcacctaaacgcatctggattggagctagattgatttcaggtgcatcaggaatcatcttccccatcattagggcagaaggagttagacagatgttcttccctgcaactgttccagcatattatagagctcctccagtcaagtga

SEQ ID NO: 2439 - protein, 521 aa, Populus balsamifera subsp. trichocarpa
  misc_feature (1)..(521): Ceres ANNOT ID no. 1451509
  misc_feature (58)..(89): Pfam Name: Thi4 Pfam Description: Thi4 family
  misc_feature: SWISSPROT Homolog: ERG1_PANGI Squalene monooxygenase (EC 1.14.99.7) (Squalene epoxidase) (SE) with e-value of 1.0e-206 and BLAST sequence identity of 74.4
  misc_feature: SWISSPROT Homolog: ERG11_ARATH Squalene monooxygenase 1,1 (EC 1.14.99.7) (Squalene epoxidase 1,1) (SE 1,1) with e-value of 7.2e-128 and BLAST sequence identity of 48.8
  misc_feature: SWISSPROT Homolog: ERG12_BRANA Squalene monooxygenase 1,2 (EC 1.14.99.7) (Squalene epoxidase 1,2) (SE 1,2) with e-value of 6.9e-123 and BLAST sequence identity of 46.9
  misc_feature: SWISSPROT Homolog: ERG12_ARATH Squalene monooxygenase 1,2 (EC 1.14.99.7) (Squalene epoxidase 1,2) (SE 1,2) with e-value of 4.9e-122 and BLAST sequence identity of 46.5
  misc_feature: SWISSPROT Homolog: ERG11_BRANA Squalene monooxygenase 1,1 (EC 1.14.99.7) (Squalene epoxidase 1,1) (SE 1,1) with e-value of 1.5e-120 and BLAST sequence identity of 47.7
  misc_feature 274843:<222: Transcription Factor
  misc_feature: Phenotype: WHOLE PLANT - Large Useful for making bigger plants
  misc_feature: Phenotype: INFLORESCENCE - Strong Useful for making stronger plants
  misc_feature (1)..(521): Functional Homolog of  Ceres CLONE ID no. 118648 at SEQ ID NO. 2473 with e-value of 3.30E-209 and BLAST sequence identity of 77.9
MPGWILATLFGLSAIYYLVTKKKEQRANKDLLEARSESVNSIATTSGECRSSNVSDVDVIIVGAGVAGAALAHTLGKDGRQVHVIERDLTEPDRIVGEFLQPGGYLKLIELGLEDCVEKIDAQRVFGYALFKDGKHTRLSYPLEKFHSNVAGRSFHNGRFIQRMRDKAASLPNVQLEQGTVISLLEDKGTIRGVQYKTKDGQELKAFAPLTIVCDGCFSNLRRSLCNPKVDVPSCFVGMVLENCQLPCANHAHVILGDPSPILMYPISSTEVRCLVDVPGQKVPSISSGEMAKYLKTVVAPQLPPEVYDAFLAAVDKGNIRTMPNRSMPAAPYPTPGALLMGDAFNMRHPLTGGGMTVALSDIVVLRNLLRPLRNLNDAPTLCKYLESFYTLRKPVASTINTLAGALYKVFCASPDQAMKEMRQACFDYLSLGGVFSAGPVSLLSGLNPRPLSLVAHFFAVAIYGVGRLLLPFPSPKRIWIGARLISGASGIIFPIIRAEGVRQMFFPATVPAYYRAPPVK

SEQ ID NO: 2440 - DNA, 1572 bp, Populus balsamifera subsp. trichocarpa
  misc_feature (1)..(1572): Ceres ANNOT ID no. 1540402
  misc_feature 274982:<222: Transcription Factor
  misc_feature: Phenotype: WHOLE PLANT - Large Useful for making bigger plants
  misc_feature: Phenotype: INFLORESCENCE - Strong Useful for making stronger plants
atggaatatcagtatctattgggaggagtcattgcttctgtttttgtttgggggttacttttagcttttcatgcaaaaggaaggaaaaaggttagagtttcaatggatattccaagggacagtactttgaaaagctctgaaaatggaatgagctgggcacgcaatcctgaaagcacagatataatcattgttggtgctggtgttgccggttcagctcttgcttacactcttggaaaggatggtcgcagagtacacgtaattgaaagagacttgacagagcctgacagaattgttggagaactcctacaacctggaggttacctgaaattaattgaattgggccttgaagactgtgtgagtgacattgatgctcaaagagtgcttggatatgcgatcttcaaagatgggaaaagtaccaaactatcatatcccttagagaactttccttcagatgttgctggaagaagctttcatcatggccgttttattcagaaaatgcgagagaaagctgcaactctttccaatgtcaaactggaacaaggaactgtaacatctctgctgaaagaaaacggaactatcaaaggagttcagtacaaaaccagggtaggtcaagagttgacagcatatgctccattaacaatagtctgcgatggctgtttttcaaatctgcggcagtccctttgcaatcccaaggttgaaatcccatcctgttttgttggtttggtgctggagaactgcaaccttccatatgcaaatcatggacatgttgttctagctgacccatctccaatcttgttttatcctattagggatacagagattcgctgtttggtagatgttcctggacagaaagtaccttctgtttctaatggcgagatgtctcactatctgaaaaatacaatagctcctcagattcctcctgagctgcatgatgctttcatttctgcaattgacaaagggggcatgagaacaatgacaaacagaagcatgccagcttctccttaccctactccaggtgcacttttaatgggagatgcattcaacatgaggcatcccttaactggaggaggaatgactgtggctctatcagacattgtgctagtacgtgaccttcttcgacctctgaacaatctcaatgatgcgtcttccctttgcaattatctcgagtccttctacacactgcgtaagcctgtggcatctaccattaacacattggcaggtgccctgtacaaggtgtttagcgcatcacctgatccagctagaaacgaaatgcgccaagcatgtttcgaatacttgagccttggaggagtattttcgaaagggccaatagctctactttctggtctagaccctcggccgttgagcttggttctccatttctttgcagtggctatctatggagtcagccgcttaatgcttcccttaccatctcctaaacggctgtggaccagtgctagattgatttcgggggcatcaggaatcatctttcctataataaagggggaaggggttagacaaatgttcttccctgtaatggtaccagcataccacagatctcctccaatggcttga

SEQ ID NO: 2441 - protein, 523 aa, Populus balsamifera subsp. trichocarpa
  misc_feature (1)..(523): Ceres ANNOT ID no. 1540402
  misc_feature (58)..(89): Pfam Name: FAD_binding_3 Pfam Description: FAD binding domain
  misc_feature: SWISSPROT Homolog: ERG1_PANGI Squalene monooxygenase (EC 1.14.99.7) (Squalene epoxidase) (SE) with e-value of 1.0e-206 and BLAST sequence identity of 74.4
  misc_feature: SWISSPROT Homolog: ERG11_ARATH Squalene monooxygenase 1,1 (EC 1.14.99.7) (Squalene epoxidase 1,1) (SE 1,1) with e-value of 7.2e-128 and BLAST sequence identity of 48.8
  misc_feature: SWISSPROT Homolog: ERG12_BRANA Squalene monooxygenase 1,2 (EC 1.14.99.7) (Squalene epoxidase 1,2) (SE 1,2) with e-value of 6.9e-123 and BLAST sequence identity of 46.9
  misc_feature: SWISSPROT Homolog: ERG12_ARATH Squalene monooxygenase 1,2 (EC 1.14.99.7) (Squalene epoxidase 1,2) (SE 1,2) with e-value of 4.9e-122 and BLAST sequence identity of 46.5
  misc_feature: SWISSPROT Homolog: ERG11_BRANA Squalene monooxygenase 1,1 (EC 1.14.99.7) (Squalene epoxidase 1,1) (SE 1,1) with e-value of 1.5e-120 and BLAST sequence identity of 47.7
  misc_feature 275114:<222: Transcription Factor
  misc_feature: Phenotype: WHOLE PLANT - Large Useful for making bigger plants
  misc_feature: Phenotype: INFLORESCENCE - Strong Useful for making stronger plants
  misc_feature (1)..(523): Functional Homolog of  Ceres CLONE ID no. 118648 at SEQ ID NO. 2473 with e-value of 1.60E-202 and BLAST sequence identity of 75.0
MEYQYLLGGVIASVFVWGLLLAFHAKGRKKVRVSMDIPRDSTLKSSENGMSWARNPESTDIIIVGAGVAGSALAYTLGKDGRRVHVIERDLTEPDRIVGELLQPGGYLKLIELGLEDCVSDIDAQRVLGYAIFKDGKSTKLSYPLENFPSDVAGRSFHHGRFIQKMREKAATLSNVKLEQGTVTSLLKENGTIKGVQYKTRVGQELTAYAPLTIVCDGCFSNLRQSLCNPKVEIPSCFVGLVLENCNLPYANHGHVVLADPSPILFYPIRDTEIRCLVDVPGQKVPSVSNGEMSHYLKNTIAPQIPPELHDAFISAIDKGGMRTMTNRSMPASPYPTPGALLMGDAFNMRHPLTGGGMTVALSDIVLVRDLLRPLNNLNDASSLCNYLESFYTLRKPVASTINTLAGALYKVFSASPDPARNEMRQACFEYLSLGGVFSKGPIALLSGLDPRPLSLVLHFFAVAIYGVSRLMLPLPSPKRLWTSARLISGASGIIFPIIKGEGVRQMFFPVMVPAYHRSPPMA

SEQ ID NO: 2442 - DNA, 1482 bp, Populus balsamifera subsp. trichocarpa
  misc_feature (1)..(1482): Ceres ANNOT ID no. 1487005
  misc_feature 275253:<222: Transcription Factor
  misc_feature: Phenotype: WHOLE PLANT - Large Useful for making bigger plants
  misc_feature: Phenotype: INFLORESCENCE - Strong Useful for making stronger plants
atggaatatcagtatctattgggaggagtcattgcttctgtttttgtttgggggttacttttagcttttcatgcaaaaggaaggaaaaaggttagagtttcaatggatattccaagggacagtactttgaaaagctctgaaaatggaatgagctgggcacgcaatcctgaaagcacagatataatcattgttggtgctggtgttgccggttcagctcttgcttacactcttggaaaggatggtcgcagagtacacgtaattgaaagagacttgacagagcctgacagaattgttggagaactcctacaacctggaggttacctgaaattaattgaattgggccttgaagactgtgtgagtgacattgatgctcaaagagtgcttggatatgcgatcttcaaagatgggaaaagtaccaaactatcatatcccttagagaactttccttcagatgttgctggaagaagctttcatcatggccgttttattcagaaaatgcgagagaaagctgcaactctttccaatgtcaaactggaacaaggaactgtaacatctctgctgaaagaaaacggaactatcaaaggagttcagtacaaaaccagggttgaaatcccatcctgttttgttggtttggtgctggagaactgcaaccttccatatgcaaatcatggacatgttgttctagctgacccatctccaatcttgttttatcctattagggatacagagattcgctgtttggtagatgttcctggacagaaagtaccttctgtttctaatggcgagatgtctcactatctgaaaaatacaatagctcctcagattcctcctgagctgcatgatgctttcatttctgcaattgacaaagggggcatgagaacaatgacaaacagaagcatgccagcttctccttaccctactccaggtgcacttttaatgggagatgcattcaacatgaggcatcccttaactggaggaggaatgactgtggctctatcagacattgtgctagtacgtgaccttcttcgacctctgaacaatctcaatgatgcgtcttccctttgcaattatctcgagtccttctacacactgcgtaagcctgtggcatctaccattaacacattggcaggtgccctgtacaaggtgtttagcgcatcacctgatccagctagaaacgaaatgcgccaagcatgtttcgaatacttgagccttggaggagtattttcgaaagggccaatagctctactttctggtctagaccctcggccgttgagcttggttctccatttctttgcagtggctatctatggagtcagccgcttaatgcttcccttaccatctcctaaacggctgtggaccagtgctagattgatttcgggggcatcaggaatcatctttcctataataaagggggaaggggttagacaaatgttcttccctgtaatggtaccagcataccacagatctcctccaatggcttga

SEQ ID NO: 2443 - protein, 493 aa, Populus balsamifera subsp. trichocarpa
  misc_feature (1)..(493): Ceres ANNOT ID no. 1487005
  misc_feature (58)..(89): Pfam Name: FAD_binding_3 Pfam Description: FAD binding domain
  misc_feature: SWISSPROT Homolog: ERG1_PANGI Squalene monooxygenase (EC 1.14.99.7) (Squalene epoxidase) (SE) with e-value of 1.0e-206 and BLAST sequence identity of 74.4
  misc_feature: SWISSPROT Homolog: ERG11_ARATH Squalene monooxygenase 1,1 (EC 1.14.99.7) (Squalene epoxidase 1,1) (SE 1,1) with e-value of 7.2e-128 and BLAST sequence identity of 48.8
  misc_feature: SWISSPROT Homolog: ERG12_BRANA Squalene monooxygenase 1,2 (EC 1.14.99.7) (Squalene epoxidase 1,2) (SE 1,2) with e-value of 6.9e-123 and BLAST sequence identity of 46.9
  misc_feature: SWISSPROT Homolog: ERG12_ARATH Squalene monooxygenase 1,2 (EC 1.14.99.7) (Squalene epoxidase 1,2) (SE 1,2) with e-value of 4.9e-122 and BLAST sequence identity of 46.5
  misc_feature: SWISSPROT Homolog: ERG11_BRANA Squalene monooxygenase 1,1 (EC 1.14.99.7) (Squalene epoxidase 1,1) (SE 1,1) with e-value of 1.5e-120 and BLAST sequence identity of 47.7
  misc_feature 275381:<222: Transcription Factor
  misc_feature: Phenotype: WHOLE PLANT - Large Useful for making bigger plants
  misc_feature: Phenotype: INFLORESCENCE - Strong Useful for making stronger plants
  misc_feature (1)..(493): Functional Homolog of  Ceres CLONE ID no. 118648 at SEQ ID NO. 2473 with e-value of 2.40E-181 and BLAST sequence identity of 74.5
MEYQYLLGGVIASVFVWGLLLAFHAKGRKKVRVSMDIPRDSTLKSSENGMSWARNPESTDIIIVGAGVAGSALAYTLGKDGRRVHVIERDLTEPDRIVGELLQPGGYLKLIELGLEDCVSDIDAQRVLGYAIFKDGKSTKLSYPLENFPSDVAGRSFHHGRFIQKMREKAATLSNVKLEQGTVTSLLKENGTIKGVQYKTRVEIPSCFVGLVLENCNLPYANHGHVVLADPSPILFYPIRDTEIRCLVDVPGQKVPSVSNGEMSHYLKNTIAPQIPPELHDAFISAIDKGGMRTMTNRSMPASPYPTPGALLMGDAFNMRHPLTGGGMTVALSDIVLVRDLLRPLNNLNDASSLCNYLESFYTLRKPVASTINTLAGALYKVFSASPDPARNEMRQACFEYLSLGGVFSKGPIALLSGLDPRPLSLVLHFFAVAIYGVSRLMLPLPSPKRLWTSARLISGASGIIFPIIKGEGVRQMFFPVMVPAYHRSPPMA

SEQ ID NO: 2444 - protein, 295 aa, Arabidopsis thaliana
  misc_feature (1)..(295): Ceres CLONE ID no. 119104
  misc_feature (1)..(295): Also Known As Ceres CDNA ID no. 23376381
  misc_feature (1)..(295): Also Known As Ceres GEMINI ID 554C9
  misc_feature (147)..(185): Pfam Name: CCT Pfam Description: CCT motif
  misc_feature (217)..(254): Pfam Name: GATA Pfam Description: GATA zinc finger
  misc_feature (73)..(108): Pfam Name: Zim Pfam Description: ZIM motif
  misc_feature 275546:<222: Transcription Factor
  misc_feature: Phenotype: Activates expression of the gene endogenous to the AtATTPS3 (SEQ ID NO 4165) regalutory region Useful for modulating Terpenoid Biosynthesis
MDDLHGRNGRMHIGVAQNPMHVQYEDHGLHHIDNENGMMDDHADGGMDEGVETDIPSHPGNSADNRGEVVDRGIENGDQLTLSFQGQVYVFDRVSPEKVQAVLLLLGGREVPHTLPTTLGSPHQNNRGLSGTPQRLSVPQRLASLLRFREKRKGRNFDKTIRYTVRKEVALRMQRKKGQFTSAKSSNDDSGSTGSDWGSNQSWAVEGTETQKPEVLCRHCGTSEKSTPMMRRGPDGPRTLCNACGLMWANKGTLRDLSKVPPPQTPQHLSVNKNEDANLEADQMMEVTGDISNTQ

SEQ ID NO: 2445 - DNA, 921 bp, Populus balsamifera subsp. trichocarpa
  misc_feature (1)..(921): Ceres ANNOT ID no. 1465284
  misc_feature 275628:<222: Transcription Factor
  misc_feature: Phenotype: Activates expression of the gene endogenous to the AtATTPS3 (SEQ ID NO 4165) regalutory region Useful for modulating Terpenoid Biosynthesis
atggatggcatcaatggaagcaacatttctgcaaggatgcaaacgagcacagaagctcaaaacccatcgatgcaaatgcattatgatcatcatcaaaatcatcagaatgggattcaaatgatgaataatgctaatgggatgatcatgaacagtggagataatgatcaagatcataatggcgtggtgaacggtggtggtgatgatgatgatcatggggggaccatgatggtggcggctgataatcatggaaaagaaaatggagatcaactaactcttacatttcagggtcaagtttatgtttttgactctgtttcacctggaaaagttcaagctgtgctcttgctgttgggaggccgggaagtgcctgctgcaagcacacctactgttccaattacaacacatcataatagtaataatagggggctgtcaggtactccccaaaggtttagtgttcctcaaagattagcgtctttgattagatttcgagaaaaacgaaaagaacggaactttgacaagaaaattcgatatactgtccgtaaagaggtagcacttagaatgcaacggaataaaggccagttcacctcttcaaagcccaatcatgatgactctgcatcggcagctactagctggggttcaaatgagagcgggggctccgatagcaatggatcccaacatcaagaggccatttgtcggcattgtgggatcagtgagaagtctacaccaatgatgcggcgtggacctgaagggccaaggacactttgtaatgcatgcggacttatgtgggcaaataagggaactttgagggacctctccaaggcagctccccatactggacccagctcttcttccatgaacagcaatgccatggatggaaatactgatggaaaccaaagagtcgcatggaacaatgacttctcatga

SEQ ID NO: 2446 - protein, 306 aa, Populus balsamifera subsp. trichocarpa
  misc_feature (1)..(306): Ceres ANNOT ID no. 1465284
  misc_feature (160)..(198): Pfam Name: CCT Pfam Description: CCT motif
  misc_feature (230)..(267): Pfam Name: GATA Pfam Description: GATA zinc finger
  misc_feature (83)..(118): Pfam Name: Zim Pfam Description: ZIM motif
  misc_feature: SWISSPROT Homolog: GAT27_ARATH GATA transcription factor 27 (ZIM-like 1 protein) with e-value of 2.7e-160 and BLAST sequence identity of 98.7
  misc_feature: SWISSPROT Homolog: GAT25_ARATH GATA transcription factor 25 (ZIM-like 2 protein) with e-value of 3.9e-120 and BLAST sequence identity of 75.2
  misc_feature: SWISSPROT Homolog: GAT26_ARATH GATA transcription factor 26 (ZIM protein) with e-value of 2.2e-48 and BLAST sequence identity of 44.4
  misc_feature: SWISSPROT Homolog: GAT13_ARATH Putative GATA transcription factor 13 with e-value of 3.1e-06 and BLAST sequence identity of 29.6
  misc_feature: SWISSPROT Homolog: GATA2_ARATH GATA transcription factor 2 (AtGATA-2) with e-value of 3.9e-06 and BLAST sequence identity of 36.8
  misc_feature 275742:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(306): Functional Homolog of  Ceres CLONE ID no. 119104 at SEQ ID NO. 2488 with e-value of 1.60E-83 and BLAST sequence identity of 63.9
MDGINGSNISARMQTSTEAQNPSMQMHYDHHQNHQNGIQMMNNANGMIMNSGDNDQDHNGVVNGGGDDDDHGGTMMVAADNHGKENGDQLTLTFQGQVYVFDSVSPGKVQAVLLLLGGREVPAASTPTVPITTHHNSNNRGLSGTPQRFSVPQRLASLIRFREKRKERNFDKKIRYTVRKEVALRMQRNKGQFTSSKPNHDDSASAATSWGSNESGGSDSNGSQHQEAICRHCGISEKSTPMMRRGPEGPRTLCNACGLMWANKGTLRDLSKAAPHTGPSSSSMNSNAMDGNTDGNQRVAWNNDFS

SEQ ID NO: 2447 - DNA, 900 bp, Populus balsamifera subsp. trichocarpa
  misc_feature (1)..(900): Ceres ANNOT ID no. 1518608
  misc_feature 275835:<222: Transcription Factor
  misc_feature: Phenotype: Activates expression of the gene endogenous to the AtATTPS3 (SEQ ID NO 4165) regalutory region Useful for modulating Terpenoid Biosynthesis
atggatggcatcaatggaagcaacatttctgcaaggatgcaaacgagcacagaagctcaaaacccatcgatgcaaatgcattatgatcatcatcaaaatcatcagaatgggattcaaatgatgaataatgctaatgggatgatcatgaacagtggagataatgatcaagatcataatggcgtggtgaacggtggtggtgatgatgatgatcatggggggaccatgatggtggcggctgataatcatggaaaagaaaatggagatcaactaactcttacatttcagggtcaagtttatgtttttgactctgtttcacctggaaaagttcaagctgtgctcttgctgttgggaggccgggaagtgcctgctgcaagcacacctactgttccaattacaacacatcataatagtaataatagggggctgtcaggtactccccaaaggtttagtgttcctcaaagattagcgtctttgattagatttcgagaaaaacgaaaagaacggaactttgacaagaaaattcgatatactgtccgtaaagaggtagcacttagaatgcaacggaataaaggccagttcacctcttcaaagcccaatcatgatgactctgcatcggcagctactagctggggttcaaatgagagcgggggctccgatagcaatggatcccaacatcaagaggccattgagaagtctacaccaatgatgcggcgtggacctgaagggccaaggacactttgtaatgcatgcggacttatgtgggcaaataagggaactttgagggacctctccaaggcagctccccatactggacccagctcttcttccatgaacagcaatgccatggatggaaatactgatggaaaccaaagagtcgcatggaacaatgacttctcatga

SEQ ID NO: 2448 - protein, 299 aa, Populus balsamifera subsp. trichocarpa
  misc_feature (1)..(299): Ceres ANNOT ID no. 1518608
  misc_feature (160)..(198): Pfam Name: CCT Pfam Description: CCT motif
  misc_feature (232)..(260): Pfam Name: GATA Pfam Description: GATA zinc finger
  misc_feature (83)..(118): Pfam Name: Zim Pfam Description: ZIM motif
  misc_feature: SWISSPROT Homolog: GAT27_ARATH GATA transcription factor 27 (ZIM-like 1 protein) with e-value of 2.7e-160 and BLAST sequence identity of 98.7
  misc_feature: SWISSPROT Homolog: GAT25_ARATH GATA transcription factor 25 (ZIM-like 2 protein) with e-value of 3.9e-120 and BLAST sequence identity of 75.2
  misc_feature: SWISSPROT Homolog: GAT26_ARATH GATA transcription factor 26 (ZIM protein) with e-value of 2.2e-48 and BLAST sequence identity of 44.4
  misc_feature: SWISSPROT Homolog: GAT13_ARATH Putative GATA transcription factor 13 with e-value of 3.1e-06 and BLAST sequence identity of 29.6
  misc_feature: SWISSPROT Homolog: GATA2_ARATH GATA transcription factor 2 (AtGATA-2) with e-value of 3.9e-06 and BLAST sequence identity of 36.8
  misc_feature 275949:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(299): Functional Homolog of  Ceres CLONE ID no. 119104 at SEQ ID NO. 2488 with e-value of 4.60E-77 and BLAST sequence identity of 63.4
MDGINGSNISARMQTSTEAQNPSMQMHYDHHQNHQNGIQMMNNANGMIMNSGDNDQDHNGVVNGGGDDDDHGGTMMVAADNHGKENGDQLTLTFQGQVYVFDSVSPGKVQAVLLLLGGREVPAASTPTVPITTHHNSNNRGLSGTPQRFSVPQRLASLIRFREKRKERNFDKKIRYTVRKEVALRMQRNKGQFTSSKPNHDDSASAATSWGSNESGGSDSNGSQHQEAIEKSTPMMRRGPEGPRTLCNACGLMWANKGTLRDLSKAAPHTGPSSSSMNSNAMDGNTDGNQRVAWNNDFS

SEQ ID NO: 2449 - DNA, 1083 bp, Populus balsamifera subsp. trichocarpa
  misc_feature (1)..(1083): Ceres ANNOT ID no. 1443642
  misc_feature 276039:<222: Transcription Factor
  misc_feature: Phenotype: Activates expression of the gene endogenous to the AtATTPS3 (SEQ ID NO 4165) regalutory region Useful for modulating Terpenoid Biosynthesis
atggcggcggcgaatccacagcccctacaggcgcgtccgtacaaggaccacagaacgcgagctccaatacagatcgaggacgatgacgacggagagtacgaagacggtgatggtatggatgacatggaagaggaagcagcagtagcgcaagtgaattcaggcgtgagtgtggcagagcacaaccacggagctggtggtggtggtggtggtgtggttatagcttcgaggactagtgaactcactctctcttttgaaggagaagtttacgttttccctgctgttacccctgaaaaggtgcaagcagtgctcttgcttctgggaggacgagatatacctactgcggtacctactattgaagtgcaatatgatcaaaataataggggagtgggtgacaccccaaagcgctcaaatctttcacgaagaatagcctctcttgttaggttccgtgaaaaaaggaaggagagatgttttgacaagaaaataagatacactgtgcgaaaagaggttgcacagagaatgcaccgcaagaatgggcagtttgcatccataaaagaaaatccaggggattcaagttgggactctggtcagagttgccttcaggatggcacccctctttcagaaactgttgtccggagatgtaagcactgtggtgttagtgaaaataatactccagcaatgcgtcgtgggccagctggacctaggactttatgcaatgcttgtggactaatgtgggcaaataagggaacattgagggatctcagtaaaggaggaaggaatcttccagtggaccaaatagaacctgaaacactgatcgaagtcaagccttccatcattgaaggggaattctctggtaaccaggatgagcatggaactgctaaagatctttctaaggcagttagcgaaggattcaacaaccattctatcaatccagatgaggttttccaagaagctactgaagatattacaaatactttgccaatgggagttatccattcttccggagatgatgatgagcaggaaccactggttgagcttgccaatccttcagatacagaacttgacattcctgctaattttgattag

SEQ ID NO: 2450 - protein, 360 aa, Populus balsamifera subsp. trichocarpa
  misc_feature (1)..(360): Ceres ANNOT ID no. 1443642
  misc_feature (147)..(185): Pfam Name: CCT Pfam Description: CCT motif
  misc_feature (213)..(250): Pfam Name: GATA Pfam Description: GATA zinc finger
  misc_feature (80)..(108): Pfam Name: Zim Pfam Description: ZIM motif
  misc_feature: SWISSPROT Homolog: GAT27_ARATH GATA transcription factor 27 (ZIM-like 1 protein) with e-value of 2.7e-160 and BLAST sequence identity of 98.7
  misc_feature: SWISSPROT Homolog: GAT25_ARATH GATA transcription factor 25 (ZIM-like 2 protein) with e-value of 3.9e-120 and BLAST sequence identity of 75.2
  misc_feature: SWISSPROT Homolog: GAT26_ARATH GATA transcription factor 26 (ZIM protein) with e-value of 2.2e-48 and BLAST sequence identity of 44.4
  misc_feature: SWISSPROT Homolog: GAT13_ARATH Putative GATA transcription factor 13 with e-value of 3.1e-06 and BLAST sequence identity of 29.6
  misc_feature: SWISSPROT Homolog: GATA2_ARATH GATA transcription factor 2 (AtGATA-2) with e-value of 3.9e-06 and BLAST sequence identity of 36.8
  misc_feature 276159:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(360): Functional Homolog of  Ceres CLONE ID no. 119104 at SEQ ID NO. 2488 with e-value of 4.20E-58 and BLAST sequence identity of 51.3
MAAANPQPLQARPYKDHRTRAPIQIEDDDDGEYEDGDGMDDMEEEAAVAQVNSGVSVAEHNHGAGGGGGGVVIASRTSELTLSFEGEVYVFPAVTPEKVQAVLLLLGGRDIPTAVPTIEVQYDQNNRGVGDTPKRSNLSRRIASLVRFREKRKERCFDKKIRYTVRKEVAQRMHRKNGQFASIKENPGDSSWDSGQSCLQDGTPLSETVVRRCKHCGVSENNTPAMRRGPAGPRTLCNACGLMWANKGTLRDLSKGGRNLPVDQIEPETLIEVKPSIIEGEFSGNQDEHGTAKDLSKAVSEGFNNHSINPDEVFQEATEDITNTLPMGVIHSSGDDDEQEPLVELANPSDTELDIPANFD

SEQ ID NO: 2451 - protein, 430 aa, Arabidopsis thaliana
  misc_feature (1)..(430): Ceres CLONE ID no. 119256
  misc_feature (193)..(388): Pfam Name: DUF239 Pfam Description: Arabidopsis proteins of unknown function
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Serrate Margins Useful for making plants with increased biomass and foliage
MEVNVLASKRSLLLFLLIVSLSLSQKVRHISAFNDTKPYRQVSSLRLARIQKHLNKINKSPVFTIQSPDGDVIDCVPKRKQPALDHPLLKHHKIQKAPKKMPKMKGKDDDVKEAENVLEGAWQMWHVNGTRCPKGTVPIRRNTMNDVLRAKSLFDFGKKRRSIYLDQRTEKPDALGTNGHEHAIAYTESSSEIYGAKATINVWDPKIEEVNEFSLSQIWILSGSFVGPDLNSIEAGWQVSPELYGDNRPRLFTYWTSDSYQATGCYNLLCSGFIQTNNKIAIGAAISPLSTFKGNQFDITILIWKDPKMGNWWMGLGDSTLVGYWPAELFTHLADHATTVEWGGEVVNTRASGRHTTTQMGSGHFPDEGFGKASYFRNLEVVDSDNSLVPVHDVKILAENTECYDIKSSYSNEWGTYFYYGGPGFNPRCN

SEQ ID NO: 2452 - DNA, 1299 bp, Populus balsamifera subsp. trichocarpa
  misc_feature (1)..(1299): Ceres ANNOT ID no. 1469636
  misc_feature 276398:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Serrate Margins Useful for making plants with increased biomass and foliage
atgggttttctagtaaggaaaagagggtttctagcgcctctccttctagctcttcttcttgtccaaaggttgagtgctgttgtatcggccctaaattacacaagttacaggcaagtcagcagcatgagacttgaaaggattcaaaggcacttggacaagattaacaagcctcctgtcatgaccatagagagcccagatggagatattatagattgtgttcataagagaaaacagcctgctctagatcaccctctcttaaggaatcacaagatccagagagatccaccagaaaggcctagagtgaaaatgttgaaagaggatgacaaaacgaagaagagtaatgtcgaagaaggtgtgataagaggttcatggcaaatgtggcataggaatggaacaaggtgccctaaaggaactgttccgatacggcggagcacggctcatgatgtgttgagatccaagtctttgttcgactttggcaagaaacaagcaccaatctctcttgctagacgcaaagatgcacccgatgtagttagcgccaatggacatgagcatgcaattgcctacactggatcctcgcaagaggtgtatggagcgaaggcaacaattaacgtgtgggacccatcaatccaagtggtcaacgagtttagtctctcccagatatgggtgctctcgggatcattcgacggctcagatctcaacagcatagaagctgggtggcaggtcagtccggagctttatggtgacagcaggcctagactgtttacgtactggacaagtgattcataccaggcaacaggatgctacaaccttctctgctcaggatttgtgcaaacgaatagcagagtagccattggagctgccatttctcctgtatcatcgtacacaggaaaccaatatgatatcagcatcctcatttggaaggacccgaagctaggtaattggtggatgggttttggtgacaacaccctagtaggatactggccagcagagctttttacacacctagcaaaccatgccaccatggtggagtggggaggtgaagtggtgaactcaagggctaacggcgagcacacatcgacccagatgggctccggcaactttgcagaagatgggttcggaaaggcaagttattttcggaacctagagatcgtggactctgataacagcctcaccgcagtccagagcatctcaacgttagctgaaaacaccaattgttacaacatcaagagctcttacagcaatgaatggggcacacacttctactatggaggccctgggagcaatccactgtgcccatga

SEQ ID NO: 2453 - protein, 432 aa, Populus balsamifera subsp. trichocarpa
  misc_feature (1)..(432): Ceres ANNOT ID no. 1469636
  misc_feature (195)..(390): Pfam Name: DUF239 Pfam Description: Arabidopsis proteins of unknown function
  misc_feature 276501:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Serrate Margins Useful for making plants with increased biomass and foliage
  misc_feature (1)..(432): Functional Homolog of  Ceres CLONE ID no. 119256 at SEQ ID NO. 2495 with e-value of 2.09E-175 and BLAST sequence identity of 73.2
MGFLVRKRGFLAPLLLALLLVQRLSAVVSALNYTSYRQVSSMRLERIQRHLDKINKPPVMTIESPDGDIIDCVHKRKQPALDHPLLRNHKIQRDPPERPRVKMLKEDDKTKKSNVEEGVIRGSWQMWHRNGTRCPKGTVPIRRSTAHDVLRSKSLFDFGKKQAPISLARRKDAPDVVSANGHEHAIAYTGSSQEVYGAKATINVWDPSIQVVNEFSLSQIWVLSGSFDGSDLNSIEAGWQVSPELYGDSRPRLFTYWTSDSYQATGCYNLLCSGFVQTNSRVAIGAAISPVSSYTGNQYDISILIWKDPKLGNWWMGFGDNTLVGYWPAELFTHLANHATMVEWGGEVVNSRANGEHTSTQMGSGNFAEDGFGKASYFRNLEIVDSDNSLTAVQSISTLAENTNCYNIKSSYSNEWGTHFYYGGPGSNPLCP

SEQ ID NO: 2454 - DNA, 1467 bp, Populus balsamifera subsp. trichocarpa
  misc_feature (1)..(1467): Ceres ANNOT ID no. 1479002
  misc_feature 276646:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Serrate Margins Useful for making plants with increased biomass and foliage
atggtggcagatgaaggacattcaagtagcgcaataaaaaggagcctgcatatattgttggctgaatccaatgtcagcaatgatgaacttgatagtgaatgtttaagagatcagggagcaggcctctacatatgcagtaatggtttgttagttcccctcagtctccttctgtgtttctttcttggcactgaaagaaacatgggttttgtggtgaataagagagggtttctagctcctcttcctcctcttgttctagctcttctctttgtccaaaggtttactgttgttgtgtcagccctaaattacacaaatcataggcaagtcagtggcatgagacttgaaaggattcagaggcacttggacaagattaacaagcctccagtcatgaccatagagagcccagatggagatatcatagactgtgttcataaaagaaaacagcctgctttagatcaccctcttttaaagaatcacaagatccagagagagcccccagaaatgcctagagtgaaagcgttgaaggaggatgatgagttgagatcagaaagaacaaagaagagcaatgaagcagaaggcgtgagaggttcatggcaaatgtggcaccggaatgggacaaggtgcccgcagggcactgttcctatacggcggagcacagttcatgatgtgctgagagccaagtctttgtttgattttggcaagaaacaacaaagatcaatctctcttgctagacacatggatgcacctgatgtagttagtggcaatggacacgagcatgcaattgcctacactggatcatcacaagaggtgtatggagcaagggcaacaattaacgtgtggggtccaacaatccaaggtgtcaatgagttcagtctatcacagatctggattctctcgggatcgttcgacggctctgatctcaacagcatagaagctgggtggcagagtgattcatatcaagcaacagggtgctacaaccttctttgtgcaggatttgtgcaaacccatagcagaatagccattggagctgccatttctcctgtatcatcatacacaggcaaccaatatgatatcagcatcctcatttggaaggatccaaagctaggtaattggtggatgagttttggtgacaacaccctagtaggatactggccagctgagctatttacacacctagcagagcatgccaccatggtggagtggggcggcgaggtggtgaactcaagggccaacggccagcacacatcgacacagatggggtcgggccactttgcagaagatgggttcggaaaagcaagctattttcggaacctagagattgtagactctgataacagcctcagctcagcccgaagtatctcaaccctaactgaaaacaccaattgttacaacatccaaagctcctacagcaatgaatggggcacacacttctattatggtggccctgggaacaatccacggtgcccatga

SEQ ID NO: 2455 - protein, 422 aa, Populus balsamifera subsp. trichocarpa
  misc_feature (1)..(422): Ceres ANNOT ID no. 1479002
  misc_feature (203)..(382): Pfam Name: DUF239 Pfam Description: Arabidopsis proteins of unknown function
  misc_feature 276755:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Serrate Margins Useful for making plants with increased biomass and foliage
  misc_feature (1)..(422): Functional Homolog of  Ceres CLONE ID no. 119256 at SEQ ID NO. 2495 with e-value of 1.79E-155 and BLAST sequence identity of 72.0
MGFVVNKRGFLAPLPPLVLALLFVQRFTVVVSALNYTNHRQVSGMRLERIQRHLDKINKPPVMTIESPDGDIIDCVHKRKQPALDHPLLKNHKIQREPPEMPRVKALKEDDELRSERTKKSNEAEGVRGSWQMWHRNGTRCPQGTVPIRRSTVHDVLRAKSLFDFGKKQQRSISLARHMDAPDVVSGNGHEHAIAYTGSSQEVYGARATINVWGPTIQGVNEFSLSQIWILSGSFDGSDLNSIEAGWQSDSYQATGCYNLLCAGFVQTHSRIAIGAAISPVSSYTGNQYDISILIWKDPKLGNWWMSFGDNTLVGYWPAELFTHLAEHATMVEWGGEVVNSRANGQHTSTQMGSGHFAEDGFGKASYFRNLEIVDSDNSLSSARSISTLTENTNCYNIQSSYSNEWGTHFYYGGPGNNPRCP

SEQ ID NO: 2456 - protein, 264 aa, Arabidopsis thaliana
  misc_feature (1)..(264): Ceres CLONE ID no. 119598
  misc_feature (95)..(159): Pfam Name: RRM_1 Pfam Description: RNA recognition motif. (a.k.a. RRM RBD, or RNP domain)
  misc_feature: Phenotype: INFLORESCENCE - Late Flowering Useful for modulating flowering time
MRPVFVGNFEYETRQSDLERLFDKYGRVDRVDMKSGYAFVYFEDERDAEDAIRKLDNFPFGYEKRRLSVEWAKGERGRPRGDAKAPSNLKPTKTLFVINFDPIRTKEHDIEKHFEPYGKVTNVRIRRNFSFVQFETQEDATKALEATQRSKILDRVVSVEYALKDDDERDDRNGGRSPRRSLSPVYRRRPSPDYGRRPSPGQGRRPSPDYGRARSPEYDRYKGPAAYERRRSPDYGRRSSDYGRQRSPGYDRYRSRSPVPRGRP

SEQ ID NO: 2457 - DNA, 711 bp, Populus balsamifera subsp. trichocarpa
  misc_feature (1)..(711): Ceres ANNOT ID no. 1497424
  misc_feature 276977:<222: Transcription Factor
  misc_feature: Phenotype: INFLORESCENCE - Late Flowering Useful for modulating flowering time
atggcgcggccagttttcgtgggaaactttgagcacgagacaaggcaatcggacttggaacgcttgttcagcaagtacggaagggtggagcgagttgacatgaaatctgggtttgcttttgtttattttgaggatgaccgtgatgctgcagatgctgtacgtggacttgacaatataccttttggttatgacaggcgaaggctttcagtggagtgggctcggggtgaacgtggtcggcaccgagatgggccaaggtcgacagcaaaccagaggccaactaaaacattgtttgttattaatttcgatccaattcataccagggttgaagacataaagagacactttgagcgttatggagaggtgctgcatgtccgaattcgacggaactttgcatttgtgcagtttgagacacaagaagacgccaccaaagctctcgagtgcacacacatgaccaagatattggacagggtggtttctgttgagtatgctttgagggatgacagtgagaggggtgacagatatgatagtcccagaagaggaagttataatggaagatcaccaagtccagtttatcgcagacggccaagtcctgattatgttcgagctcgcagccctgtttatgataagtataatggtccagtatatgacaggcgccaaagtcctgattatggtaggaacagaagccctgagtatggcagaaaccgaaggtag

SEQ ID NO: 2458 - protein, 236 aa, Populus balsamifera subsp. trichocarpa
  misc_feature (1)..(236): Ceres ANNOT ID no. 1497424
  misc_feature (96)..(160): Pfam Name: RRM_1 Pfam Description: RNA recognition motif. (a.k.a. RRM RBD, or RNP domain)
  misc_feature: SWISSPROT Homolog: RSP31_ARATH Arginine/serine-rich splicing factor RSP31 with e-value of 2.1e-144 and BLAST sequence identity of 100.0
  misc_feature: SWISSPROT Homolog: RSP41_ARATH Arginine/serine-rich splicing factor RSP41 with e-value of 3.0e-74 and BLAST sequence identity of 57.0
  misc_feature: SWISSPROT Homolog: RSP40_ARATH Arginine/serine-rich splicing factor RSP40 with e-value of 1.3e-73 and BLAST sequence identity of 57.0
  misc_feature: SWISSPROT Homolog: RSP5_CAEEL Probable splicing factor, arginine/serine-rich 5 (RNA-binding protein srp-3) (CeSC35-2) with e-value of 2.8e-22 and BLAST sequence identity of 35.9
  misc_feature: SWISSPROT Homolog: RSP3_CAEEL Probable splicing factor, arginine/serine-rich 3 (CeSF2) (CeSF2/ASF) with e-value of 1.6e-21 and BLAST sequence identity of 47.1
  misc_feature 277070:<222: Transcription Factor
  misc_feature: Phenotype: INFLORESCENCE - Late Flowering Useful for modulating flowering time
  misc_feature (1)..(236): Functional Homolog of  Ceres CLONE ID no. 119598 at SEQ ID NO. 2500 with e-value of 8.09E-87 and BLAST sequence identity of 74.5
MARPVFVGNFEHETRQSDLERLFSKYGRVERVDMKSGFAFVYFEDDRDAADAVRGLDNIPFGYDRRRLSVEWARGERGRHRDGPRSTANQRPTKTLFVINFDPIHTRVEDIKRHFERYGEVLHVRIRRNFAFVQFETQEDATKALECTHMTKILDRVVSVEYALRDDSERGDRYDSPRRGSYNGRSPSPVYRRRPSPDYVRARSPVYDKYNGPVYDRRQSPDYGRNRSPEYGRNRR

SEQ ID NO: 2459 - DNA, 939 bp, Populus balsamifera subsp. trichocarpa
  misc_feature (1)..(939): Ceres ANNOT ID no. 1471357
  misc_feature 277148:<222: Transcription Factor
  misc_feature: Phenotype: INFLORESCENCE - Late Flowering Useful for modulating flowering time
atggcgcggccaattttcgttggaaactttgagcaggagacgaggcaatcggagttggagcgcttgttcagaaagtacggacgggtggagcgagttgacatgaaatctgggtttgcttttgtttatttcgaggacgaccgtgatgctgcagatgctatacgtggacttgacaatatacctttcggttatgacaggcgcaggctttctgttgagtgggctaggggtgaacgtggtcggcatcgagatggaccaaggtcgacagtgaaccagaggccaactaaaaccctgtttgttattaatttcgatccaattcatacaagggttgaggacataaaaagacactttgagcgttacggagaggttcttcatgtcagaattcgacggaactttgcatttgtgcagtttgagacacaagaagatgctaccaaagctcttcagcgcacacacatgaccaagatattggacagggtggtttctgttgagtatgctttgagagatgacagtgagaggggtgacagatatgatagtcctcgaagaggaagttattatgggaggtcgccgagtccagctcatcacaggcggccaaatcctgattatggtcgaggtcacagccctgtttatgataagtacaatggtccagtgcatgacaggcgccgaagtcctgattatggtaggaacagaagcccggagtatggcagacaccgcaggtattgctttccacttgaactgagagtttctccactcgttgtttttgctcgtttttccaagagacagcacagctgtttgaagcttatcttctcatctcttccagaggaacgcatatttttcaatgtcttgttttcttatgtttgtttacagtcgatcaccggtttgaagatcaagaacacgaggaatgatgggaagctttctgcttgtttcactgcaccatctcttgtgtaa

SEQ ID NO: 2460 - protein, 312 aa, Populus balsamifera subsp. trichocarpa
  misc_feature (1)..(312): Ceres ANNOT ID no. 1471357
  misc_feature (96)..(160): Pfam Name: RRM_1 Pfam Description: RNA recognition motif. (a.k.a. RRM RBD, or RNP domain)
  misc_feature: SWISSPROT Homolog: RSP31_ARATH Arginine/serine-rich splicing factor RSP31 with e-value of 2.1e-144 and BLAST sequence identity of 100.0
  misc_feature: SWISSPROT Homolog: RSP41_ARATH Arginine/serine-rich splicing factor RSP41 with e-value of 3.0e-74 and BLAST sequence identity of 57.0
  misc_feature: SWISSPROT Homolog: RSP40_ARATH Arginine/serine-rich splicing factor RSP40 with e-value of 1.3e-73 and BLAST sequence identity of 57.0
  misc_feature: SWISSPROT Homolog: RSP5_CAEEL Probable splicing factor, arginine/serine-rich 5 (RNA-binding protein srp-3) (CeSC35-2) with e-value of 2.8e-22 and BLAST sequence identity of 35.9
  misc_feature: SWISSPROT Homolog: RSP3_CAEEL Probable splicing factor, arginine/serine-rich 3 (CeSF2) (CeSF2/ASF) with e-value of 1.6e-21 and BLAST sequence identity of 47.1
  misc_feature 277249:<222: Transcription Factor
  misc_feature: Phenotype: INFLORESCENCE - Late Flowering Useful for modulating flowering time
  misc_feature (1)..(312): Functional Homolog of  Ceres CLONE ID no. 119598 at SEQ ID NO. 2500 with e-value of 7.29E-86 and BLAST sequence identity of 73.2
MARPIFVGNFEQETRQSELERLFRKYGRVERVDMKSGFAFVYFEDDRDAADAIRGLDNIPFGYDRRRLSVEWARGERGRHRDGPRSTVNQRPTKTLFVINFDPIHTRVEDIKRHFERYGEVLHVRIRRNFAFVQFETQEDATKALQRTHMTKILDRVVSVEYALRDDSERGDRYDSPRRGSYYGRSPSPAHHRRPNPDYGRGHSPVYDKYNGPVHDRRRSPDYGRNRSPEYGRHRRYCFPLELRVSPLVVFARFSKRQHSCLKLIFSSLPEERIFFNVLFSYVCLQSITGLKIKNTRNDGKLSACFTAPSLV

SEQ ID NO: 2461 - protein, 220 aa, Arabidopsis thaliana
  misc_feature (1)..(220): Ceres CLONE ID no. 119925
  misc_feature (64)..(212): Pfam Name: Cupin_1 Pfam Description: Cupin
  misc_feature: Phenotype: WHOLE PLANT - Large Useful for making bigger plants
  misc_feature: Phenotype: INFLORESCENCE - Strong Useful for making stronger plants
MTTLQISSSLFRSFLLVICVFVIPSLSSDSDPLQDFCVGDLKASPSINGFPCKSSVSASDFFFSGLGGPLNTSTPNGVAVSPANVLTFPGLNTLGLSMNNVEFAPGGVNPPHSHPRATEAGVVIEGSVFVGFLTTNNTLFSKVLNAGEMFVVPRGLVHFQWNVGKVKARLITSFNSQLPGSAVLPSTLFGSNPTIPNAVLTKTFRTDDVTVNKLKSKFAV

SEQ ID NO: 2462 - DNA, 663 bp, Populus balsamifera subsp. trichocarpa
  misc_feature (1)..(663): Ceres ANNOT ID no. 1473490
  misc_feature 277419:<222: Transcription Factor
  misc_feature: Phenotype: WHOLE PLANT - Large Useful for making bigger plants
  misc_feature: Phenotype: INFLORESCENCE - Strong Useful for making stronger plants
atgatctctatgccaccgtttcacttgctctgtaccctgatagggttgttgcttcttcccttgcatatcaattcagctgatccagatctactgcaggacttctgtgttgcagacttaaaagcccccctgtctgtaaatggcttcccttgtaaacctgaggcaaaagtaacttcagatgattttttctttgatgggttaagcaaagagggaaacacaacaaacatatttggttggtctgtgactgcagcaaatgtccttgcctttcctggcctcaattctcttggaatttccatgaaccgagtagactttgcccccggcggactgaacccacctcactcacaccctcgtgcaactgagactggtgtgatcattgaagggaagctacttgtaggatttgtgacaactagcaatgtgtttcattccaaagtattgactgtcgggcagatgtttgttgttcctaggggtcttgttcactttcagctaaatgttggggaagggaaggccctccttttcacagctttcaacagtcacttgcctgggtcagccgtcgtcccaacaactctctttgcttcaagaccttcaattcccgatgatgtgttaaccaaggccttccaagtaggaaatgatgtaatcgacaacataaaatccaagtttagttcttga

SEQ ID NO: 2463 - protein, 220 aa, Populus balsamifera subsp. trichocarpa
  misc_feature (1)..(220): Ceres ANNOT ID no. 1473490
  misc_feature (99)..(174): Pfam Name: Cupin_2 Pfam Description: Cupin domain
  misc_feature: SWISSPROT Homolog: GLT2_ARATH Germin-like protein subfamily T member 2 precursor with e-value of 1.6e-114 and BLAST sequence identity of 100.0
  misc_feature: SWISSPROT Homolog: GLT1_ARATH Germin-like protein subfamily T member 1 precursor with e-value of 3.0e-99 and BLAST sequence identity of 84.5
  misc_feature: SWISSPROT Homolog: GLT3_ARATH Putative germin-like protein subfamily T member 3 precursor with e-value of 1.2e-63 and BLAST sequence identity of 57.7
  misc_feature: SWISSPROT Homolog: OXO2_HORVU Oxalate oxidase 2 precursor (EC 1.2.3.4) (Germin) with e-value of 5.1e-56 and BLAST sequence identity of 55.0
  misc_feature: SWISSPROT Homolog: GER2_WHEAT Oxalate oxidase GF-2.8 precursor (EC 1.2.3.4) (Germin GF-2.8) with e-value of 1.5e-54 and BLAST sequence identity of 54.5
  misc_feature 277518:<222: Transcription Factor
  misc_feature: Phenotype: WHOLE PLANT - Large Useful for making bigger plants
  misc_feature: Phenotype: INFLORESCENCE - Strong Useful for making stronger plants
  misc_feature (1)..(220): Functional Homolog of  Ceres CLONE ID no. 119925 at SEQ ID NO. 2505 with e-value of 2.09E-63 and BLAST sequence identity of 59.3
MISMPPFHLLCTLIGLLLLPLHINSADPDLLQDFCVADLKAPLSVNGFPCKPEAKVTSDDFFFDGLSKEGNTTNIFGWSVTAANVLAFPGLNSLGISMNRVDFAPGGLNPPHSHPRATETGVIIEGKLLVGFVTTSNVFHSKVLTVGQMFVVPRGLVHFQLNVGEGKALLFTAFNSHLPGSAVVPTTLFASRPSIPDDVLTKAFQVGNDVIDNIKSKFSS

SEQ ID NO: 2464 - DNA, 654 bp, Populus balsamifera subsp. trichocarpa
  misc_feature (1)..(654): Ceres ANNOT ID no. 1526901
  misc_feature 277600:<222: Transcription Factor
  misc_feature: Phenotype: WHOLE PLANT - Large Useful for making bigger plants
  misc_feature: Phenotype: INFLORESCENCE - Strong Useful for making stronger plants
atgccaccgtttcacttgctctgtaccctgatagggttgttgcttcttcccttgcatatcaattcagctgatccagatctactgcaggacttctgtgttgcagacttaaaagcccccctgtctgtaaatggcttcccttgtaaacctgaggcaaaagtaacttcagatgattttttctttgatgggttaagcaaagagggaaacacaacaaacatatttggttggtctgtgactgcagcaaatgtccttgcctttcctggcctcaattctcttggaatttccatgaaccgagtagactttgcccccggcggactgaacccacctcactcacaccctcgtgcaactgagactggtgtgatcattgaagggaagctacttgtaggatttgtgacaactagcaatgtgtttcattccaaagtattgactgtcgggcagatgtttgttgttcctaggggtcttgttcactttcagctaaatgttggggaagggaaggccctccttttcacagctttcaacagtcacttgcctgggtcagccgtcgtcccaacaactctctttgcttcaagaccttcaattcccgatgatgtgttaaccaaggccttccaagtaggaaatgatgtaatcgacaacataaaatccaagtttagttcttga

SEQ ID NO: 2465 - protein, 217 aa, Populus balsamifera subsp. trichocarpa
  misc_feature (1)..(217): Ceres ANNOT ID no. 1526901
  misc_feature (96)..(171): Pfam Name: Cupin_2 Pfam Description: Cupin domain
  misc_feature: SWISSPROT Homolog: GLT2_ARATH Germin-like protein subfamily T member 2 precursor with e-value of 1.6e-114 and BLAST sequence identity of 100.0
  misc_feature: SWISSPROT Homolog: GLT1_ARATH Germin-like protein subfamily T member 1 precursor with e-value of 3.0e-99 and BLAST sequence identity of 84.5
  misc_feature: SWISSPROT Homolog: GLT3_ARATH Putative germin-like protein subfamily T member 3 precursor with e-value of 1.2e-63 and BLAST sequence identity of 57.7
  misc_feature: SWISSPROT Homolog: OXO2_HORVU Oxalate oxidase 2 precursor (EC 1.2.3.4) (Germin) with e-value of 5.1e-56 and BLAST sequence identity of 55.0
  misc_feature: SWISSPROT Homolog: GER2_WHEAT Oxalate oxidase GF-2.8 precursor (EC 1.2.3.4) (Germin GF-2.8) with e-value of 1.5e-54 and BLAST sequence identity of 54.5
  misc_feature 277697:<222: Transcription Factor
  misc_feature: Phenotype: WHOLE PLANT - Large Useful for making bigger plants
  misc_feature: Phenotype: INFLORESCENCE - Strong Useful for making stronger plants
  misc_feature (1)..(217): Functional Homolog of  Ceres CLONE ID no. 119925 at SEQ ID NO. 2505 with e-value of 3.50E-63 and BLAST sequence identity of 63.7
MPPFHLLCTLIGLLLLPLHINSADPDLLQDFCVADLKAPLSVNGFPCKPEAKVTSDDFFFDGLSKEGNTTNIFGWSVTAANVLAFPGLNSLGISMNRVDFAPGGLNPPHSHPRATETGVIIEGKLLVGFVTTSNVFHSKVLTVGQMFVVPRGLVHFQLNVGEGKALLFTAFNSHLPGSAVVPTTLFASRPSIPDDVLTKAFQVGNDVIDNIKSKFSS

SEQ ID NO: 2466 - protein, 282 aa, Arabidopsis thaliana
  misc_feature (1)..(282): Ceres CLONE ID no. 120302
  misc_feature (1)..(282): Also Known As Ceres CDNA ID no. 23449314
  misc_feature (1)..(282): Also Known As Ceres GEMINI ID 555C1
  misc_feature (14)..(61): Pfam Name: Myb_DNA-binding Pfam Description: Myb-like DNA-binding domain
  misc_feature 277799:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (234)..(234): Xaa is any aa, unknown, or other
  misc_feature (242)..(242): Xaa is any aa, unknown, or other
MGRSPCCEKAHINKGAWTKEEDERLIAYIKAHGEGCWRSLPKAAGLLRCGKSCRLRWINYLRPDLKRGNFTEEEDELIIKLHSLLGNKWSLIAGRLPGRTDNEIKNYWNTHIRRKLINRGIDPTSHRPIQESSASQDSKPTQLEPVTSNTINISFTSAPKVETFHESISFPGKSEKISMLTFKEEKDECPVQEKFPDLNLELRISLPDDVDRLQGHGKSTTPRCFKCSLGMINXMECRCGRXRCDVVGGSSKGSDMSNGFDFLGLAKKETTSLLGFRSLEMK

SEQ ID NO: 2467 - DNA, 1068 bp, Populus balsamifera subsp. trichocarpa
  misc_feature (1)..(1068): Ceres ANNOT ID no. 1450548
  misc_feature 277889:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggaagcaaggttatcggtcatagaaaaggtacgaaactggaccttgctacagatccactccctcactggtgtcagttccaacagcaataaggatataaatctaaggggtgtccgtgaattctggtacatgtgttgtctacaacaagaagaagaaggaaggcctccatttctaccacaacagtaccgcacgcccgtcaaaaaaagaaaagacgcaccaaaaacattgaggttaccattcctacttgtaaatcctactgaaatgggaaggtctccttgctgtgaaaaagctcatacaaacaaaggcgcatggactaaggaagaagatgatcgccttattgcttacattagaacccacggtgaaggttgctggcgttcacttcctaaagctgctggccttctaagatgcggcaagagctgcagacttcgttggatcaactatttaagacctgaccttaaacgtggcaattttactgaagaagaagatgagctcattatcaaactccatagtctcctcggcaacaaatggtcacttatagccggaaggttaccagggagaacagataatgagataaagaattattggaacacacatataagaaggaagctcttgaatagaggcatagatcctgcgactcataggccactcaatgaaccagcccaagaagcttcaacaacaatatctttcagcactactacctcagttaaagaagagtcgttgagttctgttaaagaggaaagtaataaggagaagataattagcgcagctgcttttatatgcaaagaagagaaaaccccagttcaagaaaggtgtccagacttgaatcttgaacttagaattagccttccttgccaaaaccagcctgatcgtcaccaggcattcaaaactggaggaagtacaagtctttgttttgcttgcagcttggggctacaaaacagcaaggattgcagttgcagtgtcattgtgggtactattggaagcagcagtagtgctggctccaaaactggctatgacttcttagggatgaaaagtggtgtgttggattatagaggtttggagatgaaatga

SEQ ID NO: 2468 - protein, 355 aa, Populus balsamifera subsp. trichocarpa
  misc_feature (1)..(355): Ceres ANNOT ID no. 1450548
  misc_feature (101)..(148): Pfam Name: Myb_DNA-binding Pfam Description: Myb-like DNA-binding domain
  misc_feature: SWISSPROT Homolog: MYB4_ARATH Transcription repressor MYB4 (Myb-related protein 4) (AtMYB4) with e-value of 2.7e-153 and BLAST sequence identity of 98.6
  misc_feature: SWISSPROT Homolog: MYB1_HORVU Myb-related protein Hv1 with e-value of 4.1e-70 and BLAST sequence identity of 60.2
  misc_feature: SWISSPROT Homolog: MYB38_MAIZE Myb-related protein Zm38 with e-value of 4.8e-67 and BLAST sequence identity of 57.1
  misc_feature: SWISSPROT Homolog: MYB2_PHYPA Myb-related protein Pp2 with e-value of 5.6e-50 and BLAST sequence identity of 52.0
  misc_feature: SWISSPROT Homolog: ODO1_PETHY ODORANT1 protein (MYB-like protein ODO1) with e-value of 9.1e-50 and BLAST sequence identity of 50.3
  misc_feature 277994:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(355): Functional Homolog of  Ceres CLONE ID no. 120302 at SEQ ID NO. 2510 with e-value of 2.69E-88 and BLAST sequence identity of 70.4
MEARLSVIEKVRNWTLLQIHSLTGVSSNSNKDINLRGVREFWYMCCLQQEEEGRPPFLPQQYRTPVKKRKDAPKTLRLPFLLVNPTEMGRSPCCEKAHTNKGAWTKEEDDRLIAYIRTHGEGCWRSLPKAAGLLRCGKSCRLRWINYLRPDLKRGNFTEEEDELIIKLHSLLGNKWSLIAGRLPGRTDNEIKNYWNTHIRRKLLNRGIDPATHRPLNEPAQEASTTISFSTTTSVKEESLSSVKEESNKEKIISAAAFICKEEKTPVQERCPDLNLELRISLPCQNQPDRHQAFKTGGSTSLCFACSLGLQNSKDCSCSVIVGTIGSSSSAGSKTGYDFLGMKSGVLDYRGLEMK

SEQ ID NO: 2469 - DNA, 816 bp, Populus balsamifera subsp. trichocarpa
  misc_feature (1)..(816): Ceres ANNOT ID no. 1460633
  misc_feature 278097:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atgggaaggtctccttgctgtgaaaaagcccatacaaacaagggtgcgtggaccaaggaggaagacgatcgccttgttgcttacattagagctcacggtgaaggttgctggcgctcacttcctaaagccgctggccttcttagatgtggcaagagttgcagacttcgttggatcaactatttaagacctgaccttaaacgtggcaatttcaccgaagcagaagatgagctcattatcaaactccatagcctccttggaaacaaatggtcactcatagctggaagattaccagggagaacagataatgagataaagaattattggaacacacatataagaaggaagcttttgaacagaggcatagatcccgcaactcataggccactcaacgaaccagcagtacaagaagccacaacaacaatatctttcaccacgactactacttcagtacttgaagaagagtctctgggttctataattaaagaggaaaataaagagaagataattagcgcaactgctttcgtatgcaaagaagagaaaacccaagttcaagaaaggtgtccagacttgaatctcgagcttggaattagccttccttcccaaaaccagcctgatcatcaccagccattcaaaactggaggaagtagaagtctttgttttgcttgcagtttggggctacaaaacagcaaggattgcagctgcaatgttattgtgagcactgttgggagcagtggcagcactagcacaaagactggttatgacttcttgggcatgaaaagtggtgttttggattatagaagtttagagatgaaataa

SEQ ID NO: 2470 - protein, 271 aa, Populus balsamifera subsp. trichocarpa
  misc_feature (1)..(271): Ceres ANNOT ID no. 1460633
  misc_feature (14)..(61): Pfam Name: Myb_DNA-binding Pfam Description: Myb-like DNA-binding domain
  misc_feature: SWISSPROT Homolog: MYB4_ARATH Transcription repressor MYB4 (Myb-related protein 4) (AtMYB4) with e-value of 2.7e-153 and BLAST sequence identity of 98.6
  misc_feature: SWISSPROT Homolog: MYB1_HORVU Myb-related protein Hv1 with e-value of 4.1e-70 and BLAST sequence identity of 60.2
  misc_feature: SWISSPROT Homolog: MYB38_MAIZE Myb-related protein Zm38 with e-value of 4.8e-67 and BLAST sequence identity of 57.1
  misc_feature: SWISSPROT Homolog: MYB2_PHYPA Myb-related protein Pp2 with e-value of 5.6e-50 and BLAST sequence identity of 52.0
  misc_feature: SWISSPROT Homolog: ODO1_PETHY ODORANT1 protein (MYB-like protein ODO1) with e-value of 9.1e-50 and BLAST sequence identity of 50.3
  misc_feature 278194:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(271): Functional Homolog of  Ceres CLONE ID no. 120302 at SEQ ID NO. 2510 with e-value of 2.49E-85 and BLAST sequence identity of 67.5
MGRSPCCEKAHTNKGAWTKEEDDRLVAYIRAHGEGCWRSLPKAAGLLRCGKSCRLRWINYLRPDLKRGNFTEAEDELIIKLHSLLGNKWSLIAGRLPGRTDNEIKNYWNTHIRRKLLNRGIDPATHRPLNEPAVQEATTTISFTTTTTSVLEEESLGSIIKEENKEKIISATAFVCKEEKTQVQERCPDLNLELGISLPSQNQPDHHQPFKTGGSRSLCFACSLGLQNSKDCSCNVIVSTVGSSGSTSTKTGYDFLGMKSGVLDYRSLEMK

SEQ ID NO: 2471 - DNA, 960 bp, Populus balsamifera subsp. trichocarpa
  misc_feature (1)..(960): Ceres ANNOT ID no. 1480232
  misc_feature 278279:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atgggcagatctccttgctgtgagaaagaacacaccaacaaaggtgcatggactaaagaagaagatgaacgtcttgttaattatatcaaagctcaaggtgaaggttgttggagatctctccctaaggctgctggtttgcttagatgtggcaagagttgtagactaaggtggataaactacctaaggcctgatctcaagagaggaaacttcagtgatgaagaagatgaactcatcatcaaccttcacagcttacttggtaacaagtggtctctcattgctgctaggctaccaggaagaactgacaatgagataaagaattattggaatactcatatcaaaaggaagctttttacccgtggaattgatcctcaaactcaccgtccactcaaatccaccaccaccaccacctcctcctccaccaccaccaccaccactactaacagcaccaacaataaaaatagcaaactggataccaaaaggagtactgattttcaactggaagaacaaaactattcgtttcttcaagtgcagcctgagtttacgatgagcaacatgaccaaaacggaaaacaattccagtattatcaaggtaggtggcagcagtgactcggctgaagattccaatagtagcagtggagtgacaacagaactagaagtgtatccagatcataaactggtcaatcttgagctctctattggccttccgtgtcagtctctagtctcttctatgaacaatcttaagcaagcaaaacaacaagaacaagaagaagtggtcacacatcaattgtttgagacatctactactcctacttctagtgctcctgtttctgttcataaagcagcatgtttgtgttacaaactagggttcaagaacagtcaagcatgtagcagttgtaatgccatggaaaaaacagtaacagctgataatcttcatagattttacagacctttggatgcttga

SEQ ID NO: 2472 - protein, 319 aa, Populus balsamifera subsp. trichocarpa
  misc_feature (1)..(319): Ceres ANNOT ID no. 1480232
  misc_feature (14)..(61): Pfam Name: Myb_DNA-binding Pfam Description: Myb-like DNA-binding domain
  misc_feature: SWISSPROT Homolog: MYB4_ARATH Transcription repressor MYB4 (Myb-related protein 4) (AtMYB4) with e-value of 2.7e-153 and BLAST sequence identity of 98.6
  misc_feature: SWISSPROT Homolog: MYB1_HORVU Myb-related protein Hv1 with e-value of 4.1e-70 and BLAST sequence identity of 60.2
  misc_feature: SWISSPROT Homolog: MYB38_MAIZE Myb-related protein Zm38 with e-value of 4.8e-67 and BLAST sequence identity of 57.1
  misc_feature: SWISSPROT Homolog: MYB2_PHYPA Myb-related protein Pp2 with e-value of 5.6e-50 and BLAST sequence identity of 52.0
  misc_feature: SWISSPROT Homolog: ODO1_PETHY ODORANT1 protein (MYB-like protein ODO1) with e-value of 9.1e-50 and BLAST sequence identity of 50.3
  misc_feature 278382:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(319): Functional Homolog of  Ceres CLONE ID no. 120302 at SEQ ID NO. 2510 with e-value of 1.89E-68 and BLAST sequence identity of 70.3
MGRSPCCEKEHTNKGAWTKEEDERLVNYIKAQGEGCWRSLPKAAGLLRCGKSCRLRWINYLRPDLKRGNFSDEEDELIINLHSLLGNKWSLIAARLPGRTDNEIKNYWNTHIKRKLFTRGIDPQTHRPLKSTTTTTSSSTTTTTTTNSTNNKNSKLDTKRSTDFQLEEQNYSFLQVQPEFTMSNMTKTENNSSIIKVGGSSDSAEDSNSSSGVTTELEVYPDHKLVNLELSIGLPCQSLVSSMNNLKQAKQQEQEEVVTHQLFETSTTPTSSAPVSVHKAACLCYKLGFKNSQACSSCNAMEKTVTADNLHRFYRPLDA

SEQ ID NO: 2473 - DNA, 957 bp, Populus balsamifera subsp. trichocarpa
  misc_feature (1)..(957): Ceres ANNOT ID no. 1478804
  misc_feature 278476:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atgggcagatctccttgttgtgagaaagaacacaccaacaaaggtgcctggactaaagaagaagatgaacgtctcattaattatatcaaatctcatggtgaaggttgttggaggtctctccctaaggcagctggtttgcttagatgtggcaaaagttgtagactgaggtggataaactacctaaggcctgatctcaagagaggaaacttcagtgacgaagaagatgaactcatcatcaaccttcacagcttacttggaaacaagtggtctctcattgctgctaggctgccaggaagaactgacaatgagataaagaattattggaatactcatatcaagagaaagctctttagccgtggagttgatcctcaaactcaccgtccactcaattccaccaccacctcctccaccacttccaccaccacaaacagcaccaacaataaaaatagcaacatgggcaccaaaaggattactaactttaaacttgaagaacaaaactatttatttgttcaagcccagccagagtttatgatgagcaacatagtcaagaaggctagcgattcaagtattatcaaggtaggtggcagcagtgactctgctgaagattccaatagtagcagtggcgtgacagcagaattagaagtgcatccaaatcataaactcaatcttgagctctctattggtcttccatgtcaatctcaactttcttctgtcaatgatcttaatgattcaaagcaagcaaaccaacagcatcaagaacaagtagtcacatatcaattgtttgggacccctgctactcccacctccagtgcccctgctgttgttcatagaacagcatgtttgtgttcttacaatcgagggttcaagaacagtcaagcatgtagttgttgtaatgccgtggaaaaatttgtaacagctgatagtctttatagattttacagacctttggatgcttga

SEQ ID NO: 2474 - protein, 318 aa, Populus balsamifera subsp. trichocarpa
  misc_feature (1)..(318): Ceres ANNOT ID no. 1478804
  misc_feature (14)..(61): Pfam Name: Myb_DNA-binding Pfam Description: Myb-like DNA-binding domain
  misc_feature: SWISSPROT Homolog: MYB4_ARATH Transcription repressor MYB4 (Myb-related protein 4) (AtMYB4) with e-value of 2.7e-153 and BLAST sequence identity of 98.6
  misc_feature: SWISSPROT Homolog: MYB1_HORVU Myb-related protein Hv1 with e-value of 4.1e-70 and BLAST sequence identity of 60.2
  misc_feature: SWISSPROT Homolog: MYB38_MAIZE Myb-related protein Zm38 with e-value of 4.8e-67 and BLAST sequence identity of 57.1
  misc_feature: SWISSPROT Homolog: MYB2_PHYPA Myb-related protein Pp2 with e-value of 5.6e-50 and BLAST sequence identity of 52.0
  misc_feature: SWISSPROT Homolog: ODO1_PETHY ODORANT1 protein (MYB-like protein ODO1) with e-value of 9.1e-50 and BLAST sequence identity of 50.3
  misc_feature 278577:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(318): Functional Homolog of  Ceres CLONE ID no. 120302 at SEQ ID NO. 2510 with e-value of 2.09E-67 and BLAST sequence identity of 82.2
MGRSPCCEKEHTNKGAWTKEEDERLINYIKSHGEGCWRSLPKAAGLLRCGKSCRLRWINYLRPDLKRGNFSDEEDELIINLHSLLGNKWSLIAARLPGRTDNEIKNYWNTHIKRKLFSRGVDPQTHRPLNSTTTSSTTSTTTNSTNNKNSNMGTKRITNFKLEEQNYLFVQAQPEFMMSNIVKKASDSSIIKVGGSSDSAEDSNSSSGVTAELEVHPNHKLNLELSIGLPCQSQLSSVNDLNDSKQANQQHQEQVVTYQLFGTPATPTSSAPAVVHRTACLCSYNRGFKNSQACSCCNAVEKFVTADSLYRFYRPLDA

SEQ ID NO: 2475 - protein, 359 aa, Arabidopsis thaliana
  misc_feature (1)..(359): Ceres CLONE ID no. 120982
  misc_feature: Utility: ABA Useful for making plants with enhanced tolerance to drought
  misc_feature: Phenotype: WHOLE PLANT - ABA Useful for making plants with enhanced tolerance to drought
MEKVSSPSSSFSRRSAYLEALTQEIKKKLTRAVVSPAQTRNLLQDLFADIALEVDDRAKDVILSKEEDVITSDEADADGPLCFFDVLADYYVKVSERGKDILDLMVQLWSQSFASHIFSLLFHKWLFEVELDNQEILLRYSSALVQGATNVFWIDIQTNTRRFQSLFRYLLEEVALEQIRLKKIPIQAQRELYLLLSRFIFFYNSVDKLDSFLRNFPEFPNAFLIGGPGDFLVIELTDQLQKLKVEPVLLHYLSQMKILQGMELRMTTSTRLKACLYSFTSPGGPMYPTRAVRHAAWDALDSLFPVGRYPRHLISLFFRLLYPWYWPSSCWNFVVSCIKAVLYSIVRLIFSRREKPRQS

SEQ ID NO: 2476 - DNA, 1089 bp, Populus balsamifera subsp. trichocarpa
  misc_feature (1)..(1089): Ceres ANNOT ID no. 1492884
  misc_feature: Utility: ABA Useful for making plants with enhanced tolerance to drought
  misc_feature 278774:<222: Transcription Factor
  misc_feature: Phenotype: WHOLE PLANT - ABA Useful for making plants with enhanced tolerance to drought
atggaaaagacaagtttaacgacgccaggaactggaagttcatcttatctgaaggctctcaccgttgaaatcgagaaaaagctgcaaagggcactagcttctgcatctcagagaccgaacttgttacaagaattgtttgctgacattgctttggaagttgatgatcgcgctcgaggtataattttcagcagggaagaagatgaaatttctcctgctgaagatgctgctgatggccaattgtgcttttacgatgtgcttgctgattattatgtttgggtgcctgagagtggaaaacaaattcttcatttgattgtccaactctggagccagtcatttgcatcacatattttctctcttttgttccataaatggctttttgaagctcagctggataatactgaagtacttgttcgtttctcatctgctcttgttcaaggtgctacaaatgttttgtggattgacatccaaacaaacaaaaggcatttccagtccctatttcagtatctccttgaggaagttgccttggagcctatgcggttgaacagaattccagtgcaggcccagagggaactgtttcttttactctcaaggttcatactcttttacaactcagttgacaagatcgacagcttcttaaaacaatttcctatttttccaaatgctttcttggttggtggtccagcagacttctttgttattgaacttgcagatcagcttcaaaagttaaaggtggagccagttctattgcattacctttcacaaattaaagttctccaaggtggcatggaattgagaatgaccacaagtacaagattaaaggcatgtttgtatagctttacttctccgggcggtccaatgtatcccactagagctgtccgtcatgctgcctgggatgctttggatttgctttttcccgttggacggtatcctcggcatttcataagcctgttttttcgactgctatatccatggtactggccatcttcatgttggaacttcataatatcttgcatcaaggccgtattctattctctgctgaggctgttgttttctagttgggataagctgagagagccaaagaactgctaa

SEQ ID NO: 2477 - protein, 362 aa, Populus balsamifera subsp. trichocarpa
  misc_feature (1)..(362): Ceres ANNOT ID no. 1492884
  misc_feature: Utility: ABA Useful for making plants with enhanced tolerance to drought
  misc_feature 278843:<222: Transcription Factor
  misc_feature: Phenotype: WHOLE PLANT - ABA Useful for making plants with enhanced tolerance to drought
  misc_feature (1)..(362): Functional Homolog of  Ceres CLONE ID no. 120982 at SEQ ID NO. 2519 with e-value of 3.59E-148 and BLAST sequence identity of 77.5
MEKTSLTTPGTGSSSYLKALTVEIEKKLQRALASASQRPNLLQELFADIALEVDDRARGIIFSREEDEISPAEDAADGQLCFYDVLADYYVWVPESGKQILHLIVQLWSQSFASHIFSLLFHKWLFEAQLDNTEVLVRFSSALVQGATNVLWIDIQTNKRHFQSLFQYLLEEVALEPMRLNRIPVQAQRELFLLLSRFILFYNSVDKIDSFLKQFPIFPNAFLVGGPADFFVIELADQLQKLKVEPVLLHYLSQIKVLQGGMELRMTTSTRLKACLYSFTSPGGPMYPTRAVRHAAWDALDLLFPVGRYPRHFISLFFRLLYPWYWPSSCWNFIISCIKAVFYSLLRLLFSSWDKLREPKNC

SEQ ID NO: 2478 - DNA, 1086 bp, Populus balsamifera subsp. trichocarpa
  misc_feature (1)..(1086): Ceres ANNOT ID no. 1515144
  misc_feature: Utility: ABA Useful for making plants with enhanced tolerance to drought
  misc_feature 278951:<222: Transcription Factor
  misc_feature: Phenotype: WHOLE PLANT - ABA Useful for making plants with enhanced tolerance to drought
atggaaaagacaagttcacccacgcccggaactggtagctcagcttatctgaacgctctcactgttgaaatcgagaaaaagctgcaaagggcactagcttctccaactcagagacgtaacttgttacaagagttgtttgctgacaatgctttggaagttgatgatcgcgctcgaggtataattttcagcagggaagaagatgcaatttctcctgtggaagatgatgctgatggccaactgtgctttttcaacttgctcgctgattattatgttagggtacctgagagtggaaaacaaatccttcatctgattctccaactctggagccagtcatttgcatcacatattttctttcttttgttccataaatggctttttgaagcccagctggataatactgaagtacttctacgtttctcatctgctcttgttcaaggtgctacaaatgttttctggattgacatccaaacaaacacaaggcgcttccagtccctatttcagtatctccttgatgaagttgccttggcgcctatgcagttgaataaaattccggtgcaggcccagcgagaactgtttcttttgctctcaaggttcaccctcttttacaactcagttgacaagcacgagagcttcttaaaacagtttcctgtttttctaaatgctttcttggttggtggcccagcagacttctttgttattgaagttgcagaccagcttcaaaagttaaaggtggaaccagttctattgcattacctttcacacattaaagttctccaaggcttggaattgagaatgaccacaagtacaagattgaaggcatgtttgtatagcttcacttcgcctggcggtccaatgtatcccacaagagctgtccgtcatgccgcctgggattctttggatttgcttttccctgtcgggcagtatcctcgacatctcataagcttcttttttcgactcctgtatccatggtgctggccctcttcatgttggagtttcataatatcttgcattaaggcggtattctattctctgttggggctgttgttttctagctgggataagctgagagagccaaagaactactga

SEQ ID NO: 2479 - protein, 361 aa, Populus balsamifera subsp. trichocarpa
  misc_feature (1)..(361): Ceres ANNOT ID no. 1515144
  misc_feature: Utility: ABA Useful for making plants with enhanced tolerance to drought
  misc_feature 279020:<222: Transcription Factor
  misc_feature: Phenotype: WHOLE PLANT - ABA Useful for making plants with enhanced tolerance to drought
  misc_feature (1)..(361): Functional Homolog of  Ceres CLONE ID no. 120982 at SEQ ID NO. 2519 with e-value of 4.69E-146 and BLAST sequence identity of 75.6
MEKTSSPTPGTGSSAYLNALTVEIEKKLQRALASPTQRRNLLQELFADNALEVDDRARGIIFSREEDAISPVEDDADGQLCFFNLLADYYVRVPESGKQILHLILQLWSQSFASHIFFLLFHKWLFEAQLDNTEVLLRFSSALVQGATNVFWIDIQTNTRRFQSLFQYLLDEVALAPMQLNKIPVQAQRELFLLLSRFTLFYNSVDKHESFLKQFPVFLNAFLVGGPADFFVIEVADQLQKLKVEPVLLHYLSHIKVLQGLELRMTTSTRLKACLYSFTSPGGPMYPTRAVRHAAWDSLDLLFPVGQYPRHLISFFFRLLYPWCWPSSCWSFIISCIKAVFYSLLGLLFSSWDKLREPKNY

SEQ ID NO: 2480 - protein, 359 aa, Arabidopsis thaliana
  misc_feature (1)..(359): Ceres CLONE ID no. 120988
  misc_feature (212)..(328): Pfam Name: NAD_binding_1 Pfam Description: Oxidoreductase NAD-binding domain
  misc_feature: Phenotype: WHOLE PLANT - Yellow-Green Viable 1 Useful for making lethal plants for genetic confinement systems
MAAAISAAVSLPSSKSSSLLTKISSVSPQRIFLKKSTVCYRRVVSVKAQVTTDTTEAPPVKVVKESKKQEEGIVVNKFKPKNPYTGRCLLNTKITGDDAPGETWHIVFTTEGEVPYREGQSIGVIPEGIDKNGKPHKLRLYSIASSAIGDFGDSKTVSLCVKRLVYTNDGGEIVKGVCSNFLCDLKPGDEAKITGPVGKEMLMPKDPNATIIMLGTGTGIAPFRSFLWKMFFEEHEDYKFNGLAWLFLGVPTSSSLLYKEEFEKMKEKNPDNFRLDFAVSRETNEKGEKMYIQTRMAEYAEELWELLKKDNTFVYMCGLKGMEKGIDDIMVSLAAKDGIDWLEYKKQLKRSEQWNVEVY

SEQ ID NO: 2481 - protein, 393 aa, Arabidopsis thaliana
  misc_feature (1)..(393): Ceres CLONE ID no. 122353
  misc_feature (160)..(385): Pfam Name: Abhydrolase_1 Pfam Description: alpha/beta hydrolase fold
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
MAVHIHNPNFFHTHHLRSSLTSASASPSSYLFHRHSASKYPSFLCKSNNKDDYLIDAPVSVGDGFSFSGGKYSDQPSPSDEWLNQGKWVKAHRVGGSGVEAKDPIFGLTMGASSQASKDLFRWFSVESGSVDSPPIILIHGFPSQAYSYRKTLPVLSKNYRAIAFDWLGFGFSDKPQAGYGFNYTMDEFVSSLESFIDEVTTSKVSLVVQGYFSAAVVKYARNRPDKIKNLILLNPPLTPEHAKLPSTLSVFSNFLLGEIFSQDPLRASDKPLTSCGPYKMKEDDAMVYRRPYLTSGSSGFALNAISRSMKKELKKYAEEMRTSLMDKNWKIPITVCWGQRDRWLSYEGVEEFCKSSGHNLVELPNAGHHVQEDCGEELGGIISRIISKSALF

SEQ ID NO: 2482 - DNA, 1239 bp, Populus balsamifera subsp. trichocarpa
  misc_feature (1)..(1239): Ceres ANNOT ID no. 1472265
  misc_feature 279343:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
atggcaattcttcaaccacaaatccctttgtctctttacccccatcatttccatctccctcttcactctcctactgcagcaccttttctttgcacacccttcaaaacaccaagaaaaccactcaatctcacctgctcatccaaaggccaagatgattatctgatagatgctcctgtttctgctggagatgggttttctttctctggagggaaatattcagacgggcctagcccgtccgatgaatggtttaagcaaggaaagattgtgaaagctcatcctgtttctggctctggagataaggcgaaagatcctatatttggacttaaaatgggtgctgcttctcaggcctcaaatgatcttttcagatggttttgcgtggaaagcggaaatgctgataatcctactgttatcttaattcatggtttcccttcacagcttaaggctagaattgattgcagttgtgacttcacttcttctacaggatttggattttcagacaagcctcaacccagatacggatttgactacactatggatgaatttgtagcatccttggagtccttaatcaatgaaattgccactgagaaggtatcgcttgttgtgcagggatacttttcaccaattgctgtcaaatatgctagcaatcttcagggaaagctcaatgatctaatactcctcaatcccccactaacttccctgctctatggtgacacatatttgttttttcacttgaaaacggaaagtatgcaaggctcggtgtcttccaatctaactgccacacatgccaatcttccatcagccttgtccattttcagcaccttcttactgggtgaaatcttttgccaggatcctttaagggccagtgacaaaaccttgaccagctctggaccctataaaatgaaagaagatgatgcaatggtatatagaagaccttatctcacatctgggtctgcagggtttgcattgaacgtgattagtaaggccatgaagaaggatctaaaggcctatgtggaagaaacaaggaaaacactcttggatgaaaattggaaagttagaaccacagtgtgttggggccagagagatcgttggttgagctatgatggagttgaagacttcttgaagaattccaaacataaactaatcgagcttccaatggctggtcatcatgtacaggaggattgtggtgaagaacttggaggaatcatctctggaatcctaggcagaaggagcagaatttga

SEQ ID NO: 2483 - protein, 412 aa, Populus balsamifera subsp. trichocarpa
  misc_feature (1)..(412): Ceres ANNOT ID no. 1472265
  misc_feature (152)..(404): Pfam Name: Abhydrolase_1 Pfam Description: alpha/beta hydrolase fold
  misc_feature: SWISSPROT Homolog: DHMA2_MYCBO Haloalkane dehalogenase 2 (EC 3.8.1.5) with e-value of 8.4e-16 and BLAST sequence identity of 25.5
  misc_feature: SWISSPROT Homolog: DHMA2_MYCTU Haloalkane dehalogenase 2 (EC 3.8.1.5) with e-value of 8.4e-16 and BLAST sequence identity of 25.5
  misc_feature: SWISSPROT Homolog: DHMA_MYCAV Haloalkane dehalogenase (EC 3.8.1.5) with e-value of 9.8e-14 and BLAST sequence identity of 25.2
  misc_feature: SWISSPROT Homolog: DHMA1_MYCBO Haloalkane dehalogenase 1 (EC 3.8.1.5) with e-value of 1.4e-12 and BLAST sequence identity of 32.6
  misc_feature: SWISSPROT Homolog: DHMA1_MYCTU Haloalkane dehalogenase 1 (EC 3.8.1.5) with e-value of 1.4e-12 and BLAST sequence identity of 32.6
  misc_feature 279477:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature (1)..(412): Functional Homolog of  Ceres CLONE ID no. 122353 at SEQ ID NO. 2525 with e-value of 9.09E-127 and BLAST sequence identity of 68.8
MAILQPQIPLSLYPHHFHLPLHSPTAAPFLCTPFKTPRKPLNLTCSSKGQDDYLIDAPVSAGDGFSFSGGKYSDGPSPSDEWFKQGKIVKAHPVSGSGDKAKDPIFGLKMGAASQASNDLFRWFCVESGNADNPTVILIHGFPSQLKARIDCSCDFTSSTGFGFSDKPQPRYGFDYTMDEFVASLESLINEIATEKVSLVVQGYFSPIAVKYASNLQGKLNDLILLNPPLTSLLYGDTYLFFHLKTESMQGSVSSNLTATHANLPSALSIFSTFLLGEIFCQDPLRASDKTLTSSGPYKMKEDDAMVYRRPYLTSGSAGFALNVISKAMKKDLKAYVEETRKTLLDENWKVRTTVCWGQRDRWLSYDGVEDFLKNSKHKLIELPMAGHHVQEDCGEELGGIISGILGRRSRI

SEQ ID NO: 2484 - protein, 261 aa, Arabidopsis thaliana
  misc_feature (1)..(261): Ceres CLONE ID no. 123105
  misc_feature (1)..(261): Also Known As Ceres CDNA ID no. 23384792
  misc_feature (1)..(261): Also Known As Ceres GEMINI ID 533G4
  misc_feature (17)..(261): Pfam Name: AUX_IAA Pfam Description: AUX/IAA family
  misc_feature 279629:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MNGLQEVCSSSGSVMIGLPAEEDENAAHSSEDSSCPDESVSETELDLALGLSIGRRKVRSSLSSSSSSLTRESGTKRSADSSPAAASNATRQVAVGWPPLRTYRINSLVNQAKSLATEGGLSSGIQKETTKSVVVAAKNDDACFIKSSRTSMLVKVTMDGVIIGRKVDLNALDSYAALEKTLDLMFFQIPSPVTRSNTQGYKTIKETCTSKLLDGSSEYIITYQDKDGDWMLVGDVPWQMFLGSVTRLRIMKTSIGAGVGK

SEQ ID NO: 2485 - DNA, 873 bp, Populus balsamifera subsp. trichocarpa
  misc_feature (1)..(873): Ceres ANNOT ID no. 1498819
  misc_feature 279706:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atgcaaggtggttttcttggtggaggaagtggtgggtcggtgtgtatgtcgacggtgtcaatggaggataacgtgttgatgtcatctgaggactcgtcaagcccggatgagggtgaacttgaactgggtcttggtttgagtcttggtggtgcttctggttttaaggattttggtcagcgtagcagtcaacaatatgcaaggattttgactgctaaggatttgccttccaaggtttcttcttcttcttgttgttcttcaacgacttcgtcttcttcttctaccttgagtagagctaatgctactgctgggactaagagggctgctgattctgtttctgcttctaatggtgctgccagcagtcaagttgttgggtggcctccaataagatctcatagaatgcacatcatggttaaccaggcaaagtcacaggctactgaagagttcaactcaatgaataaacgcaagaatgctgtggaagagaaggtgggcaacaaaaacattaatattggtaataccaagactaggacttccctatttgtcaaggtgaatatggatggaaccctgattggtagaaaggttgatctgaatgctcatggctgctatgagacactggctcaagccttggaaaatatgttcctaagaactaccacaactttgaacatggcacgattgagcacacctgaacataaaataatgatagatgcaaaaagacactcacaattgctgggcgggtcatctgagtttgtgctcacttatgaggacaaggatggggattggatgcttgtcggagatgttccttgggggatgtttattagctctgtgaagagactcagaatcatgaggatgtccgaggcaactggacttggcaaatga

SEQ ID NO: 2486 - protein, 290 aa, Populus balsamifera subsp. trichocarpa
  misc_feature (1)..(290): Ceres ANNOT ID no. 1498819
  misc_feature (120)..(291): Pfam Name: AUX_IAA Pfam Description: AUX/IAA family
  misc_feature: SWISSPROT Homolog: IAA10_ARATH Auxin-responsive protein IAA10 (Indoleacetic acid-induced protein 10) with e-value of 4.6e-133 and BLAST sequence identity of 100.0
  misc_feature: SWISSPROT Homolog: IAA11_ARATH Auxin-responsive protein IAA11 (Indoleacetic acid-induced protein 11) with e-value of 1.5e-42 and BLAST sequence identity of 47.1
  misc_feature: SWISSPROT Homolog: IAA13_ARATH Auxin-responsive protein IAA13 (Indoleacetic acid-induced protein 13) with e-value of 4.2e-36 and BLAST sequence identity of 44.0
  misc_feature: SWISSPROT Homolog: IAA10_ORYSA Auxin-responsive protein IAA10 (Indoleacetic acid-induced protein 10) with e-value of 2.7e-34 and BLAST sequence identity of 45.0
  misc_feature: SWISSPROT Homolog: IAA12_ARATH Auxin-responsive protein IAA12 Indoleacetic acid-induced protein 12 (BODENLOS protein) with e-value of 1.5e-33 and BLAST sequence identity of 41.3
  misc_feature 279808:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(290): Functional Homolog of  Ceres CLONE ID no. 123105 at SEQ ID NO. 2528 with e-value of 2.00E-44 and BLAST sequence identity of 52.0
MQGGFLGGGSGGSVCMSTVSMEDNVLMSSEDSSSPDEGELELGLGLSLGGASGFKDFGQRSSQQYARILTAKDLPSKVSSSSCCSSTTSSSSSTLSRANATAGTKRAADSVSASNGAASSQVVGWPPIRSHRMHIMVNQAKSQATEEFNSMNKRKNAVEEKVGNKNINIGNTKTRTSLFVKVNMDGTLIGRKVDLNAHGCYETLAQALENMFLRTTTTLNMARLSTPEHKIMIDAKRHSQLLGGSSEFVLTYEDKDGDWMLVGDVPWGMFISSVKRLRIMRMSEATGLGK

SEQ ID NO: 2487 - protein, 263 aa, Arabidopsis thaliana
  misc_feature (1)..(263): Ceres CLONE ID no. 123228
  misc_feature (201)..(256): Pfam Name: Abhydrolase_1 Pfam Description: alpha/beta hydrolase fold
  misc_feature: Utility: No Nitrogen Useful for making plants tolerant to low nitrogen
  misc_feature: Phenotype: WHOLE PLANT - No Nitrogen Useful for making plants tolerant to low nitrogen
  misc_feature (151)..(151): Xaa is any aa, unknown, or other
MSEHHFVFVHGAGHGGWCWYKLANSLRDNGHKATCIDLKGAGINPTDPNTVSSLDDYDEPLYAFLSQLPNDQKVILVSHSVGGGSMTAAMCLFPSKVSLAVYVAAAMVKPGTLIPERLKNVMKICSGLIEEETEKIWDFTFGNGPQNLPTXIMMKPEYVRDKFYNESPMEDYTLATTLLRPAPVMAFIGIMDIPGAPETDKIPRVYVKTGKDHLFEPVLQEVMLALWPPAHTFLLPDSDHSAFFSQPQELYQFLLQAASSLSP

SEQ ID NO: 2488 - DNA, 831 bp, Populus balsamifera subsp. trichocarpa
  misc_feature (1)..(831): Ceres ANNOT ID no. 1533417
  misc_feature: Utility: No Nitrogen Useful for making plants tolerant to low nitrogen
  misc_feature 279995:<222: Transcription Factor
  misc_feature: Phenotype: WHOLE PLANT - No Nitrogen Useful for making plants tolerant to low nitrogen
atgaacgaggaggcaggacttcaaaaaccgcactttgttctagtccatggagcatgccatggagcctggtgctggtacaagatcaggtgtctcatggaaacatctggctataaggtcacatgcctagaccttaaaagtgctggtattgatcagtccaatcccaacacgatcctcactttggatgagtacaatgcaccccttatcgacttcttgtcgaatttgccacacgatgaaaaggttatattggtaggacatagtgcaggaggtttgagcttgacagacgctatacacagatttcctaagagaattcatctggctatttatgttgctgccaacatgttgaagcatggcttctcttcagatcaagatttcaaagatggtgaccctgatgtatctgagtacggagagatagctgatttagaatacgggatgggtctagatgagcctccaacaagtgtcataataaaggaggagttccggaaacgaattctctatcaaatgagccctaaagaggactccatattagcatcaatgctactgcgagcagggcctgtcagggcattcaaaggtgctcgatttgagggaggaaaggatgctgattctgttccacgagtatatattaagacattgcacgatcacattctaagaccagtgcagcaagaggcaatgataaagagatggcaaccttgtcaagtttttgaattggagagtgatcacagcccttttttctctgccccatctttgcttttcgaaggcagcccctcccagtttccaaacacagctagcttaatttgttggttctatagaaaatttaccttaattttcttctaa

SEQ ID NO: 2489 - protein, 276 aa, Populus balsamifera subsp. trichocarpa
  misc_feature (1)..(276): Ceres ANNOT ID no. 1533417
  misc_feature (37)..(104): Pfam Name: Abhydrolase_1 Pfam Description: alpha/beta hydrolase fold
  misc_feature: SWISSPROT Homolog: PIR7A_ORYSA Putative esterase PIR7A (EC 3.1.-.-) with e-value of 6.2e-35 and BLAST sequence identity of 35.3
  misc_feature: SWISSPROT Homolog: PNAE_RAUSE Polyneuridine-aldehyde esterase precursor (EC 3.1.1.78) (Polyneuridine aldehyde esterase) with e-value of 3.2e-31 and BLAST sequence identity of 30.8
  misc_feature: SWISSPROT Homolog: PIR7B_ORYSA Putative esterase PIR7B (EC 3.1.-.-) with e-value of 2.2e-30 and BLAST sequence identity of 31.8
  misc_feature: SWISSPROT Homolog: HNL_MANES (S)-acetone-cyanohydrin lyase (EC 4.1.2.39) (( S)-hydroxynitrile lyase) ((S)-hydroxynitrilase) (Oxynitrilase) with e-value of 1.2e-24 and BLAST sequence identity of 27.4
  misc_feature: SWISSPROT Homolog: HNL_HEVBR S-acetone-cyanohydrin lyase with e-value of 2.8e-23 and BLAST sequence identity of 28.1
  misc_feature: SWISSPROT Homolog: HNL_HEVBR EC 4.1.2.39 ((S)-hydroxynitrile lyase) ((S)- hydroxynitrilase) (Oxynitrilase)
  misc_feature: Utility: No Nitrogen Useful for making plants tolerant to low nitrogen
  misc_feature 280107:<222: Transcription Factor
  misc_feature: Phenotype: WHOLE PLANT - No Nitrogen Useful for making plants tolerant to low nitrogen
  misc_feature (1)..(276): Functional Homolog of  Ceres CLONE ID no. 123228 at SEQ ID NO. 2531 with e-value of 8.20E-55 and BLAST sequence identity of 46.9
MNEEAGLQKPHFVLVHGACHGAWCWYKIRCLMETSGYKVTCLDLKSAGIDQSNPNTILTLDEYNAPLIDFLSNLPHDEKVILVGHSAGGLSLTDAIHRFPKRIHLAIYVAANMLKHGFSSDQDFKDGDPDVSEYGEIADLEYGMGLDEPPTSVIIKEEFRKRILYQMSPKEDSILASMLLRAGPVRAFKGARFEGGKDADSVPRVYIKTLHDHILRPVQQEAMIKRWQPCQVFELESDHSPFFSAPSLLFEGSPSQFPNTASLICWFYRKFTLIFF

SEQ ID NO: 2490 - DNA, 741 bp, Populus balsamifera subsp. trichocarpa
  misc_feature (1)..(741): Ceres ANNOT ID no. 1470723
  misc_feature: Utility: No Nitrogen Useful for making plants tolerant to low nitrogen
  misc_feature 280200:<222: Transcription Factor
  misc_feature: Phenotype: WHOLE PLANT - No Nitrogen Useful for making plants tolerant to low nitrogen
atggacgagcaggcaggacttccaaacctgcactttgttctagttcatggagtatgccacggagcctggtgctggtacaagatcaggtgtctcatggaaaaatctggccataaggttacttgtctcgaccttaaaagtgctggtattgatcagtccaatcccaacacaatcctcacttttgatgaatacaatgcacccccccttacccgcttcttgtcgaatttgcctgacaatgaaaaggttatattggtaggacatggtgcaggaggtttgagcttgacagatgctatacacagatttgctaggaaaattcgtatggctatatatgttgcagccaacatgttgaagcatggctcggatcaagatatcaaagatcacctaaagggcctaatctctgcctccatacctgtgccgtatatggagcagggtgatcctgatgtatctgaatatggagaggtagctgatttagaatatgggatggggcttgatcagcctccaacaagcatcataataaaggaggagttccagaaacgacttctctatcatatgagccccaaagaggacaccatattagcatcaatgctactgcgaccaggacctgtcagggcactcaaaggagctcgatttgaaggaggaaaggatgctgattctgttccacgaatatatatcaagacattgcacgatcagatgctaaaaccgatgaaacaagagcaaatgataaagagatggcaaccttgttaa

SEQ ID NO: 2491 - protein, 246 aa, Populus balsamifera subsp. trichocarpa
  misc_feature (1)..(246): Ceres ANNOT ID no. 1470723
  misc_feature: SWISSPROT Homolog: PIR7A_ORYSA Putative esterase PIR7A (EC 3.1.-.-) with e-value of 6.2e-35 and BLAST sequence identity of 35.3
  misc_feature: SWISSPROT Homolog: PNAE_RAUSE Polyneuridine-aldehyde esterase precursor (EC 3.1.1.78) (Polyneuridine aldehyde esterase) with e-value of 3.2e-31 and BLAST sequence identity of 30.8
  misc_feature: SWISSPROT Homolog: PIR7B_ORYSA Putative esterase PIR7B (EC 3.1.-.-) with e-value of 2.2e-30 and BLAST sequence identity of 31.8
  misc_feature: SWISSPROT Homolog: HNL_MANES (S)-acetone-cyanohydrin lyase (EC 4.1.2.39) (( S)-hydroxynitrile lyase) ((S)-hydroxynitrilase) (Oxynitrilase) with e-value of 1.2e-24 and BLAST sequence identity of 27.4
  misc_feature: SWISSPROT Homolog: HNL_HEVBR S-acetone-cyanohydrin lyase with e-value of 2.8e-23 and BLAST sequence identity of 28.1
  misc_feature: SWISSPROT Homolog: HNL_HEVBR EC 4.1.2.39 ((S)-hydroxynitrile lyase) ((S)- hydroxynitrilase) (Oxynitrilase)
  misc_feature: Utility: No Nitrogen Useful for making plants tolerant to low nitrogen
  misc_feature 280304:<222: Transcription Factor
  misc_feature: Phenotype: WHOLE PLANT - No Nitrogen Useful for making plants tolerant to low nitrogen
  misc_feature (1)..(246): Functional Homolog of  Ceres CLONE ID no. 123228 at SEQ ID NO. 2531 with e-value of 8.29E-46 and BLAST sequence identity of 44.6
MDEQAGLPNLHFVLVHGVCHGAWCWYKIRCLMEKSGHKVTCLDLKSAGIDQSNPNTILTFDEYNAPPLTRFLSNLPDNEKVILVGHGAGGLSLTDAIHRFARKIRMAIYVAANMLKHGSDQDIKDHLKGLISASIPVPYMEQGDPDVSEYGEVADLEYGMGLDQPPTSIIIKEEFQKRLLYHMSPKEDTILASMLLRPGPVRALKGARFEGGKDADSVPRIYIKTLHDQMLKPMKQEQMIKRWQPC

SEQ ID NO: 2492 - protein, 128 aa, Arabidopsis thaliana
  misc_feature (1)..(128): Ceres CLONE ID no. 123279
  misc_feature (1)..(121): Pfam Name: Arf Pfam Description: ADP-ribosylation factor family
  misc_feature: Phenotype: INFLORESCENCE - Corkscrew Appearance Useful for making ornamental plants with modified flowers
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
MFSSVFGNKEARILVLGLDNAGKTTILYRLQMGEVVSTIPTIGFNVETVQYNNIKFQVWDLGGQTSIRPYWRCYFPNTQAVIYVVDSSDTDRIGVAKEEFHAILEEDELKGAVVLIFANKQKPWSCIR

SEQ ID NO: 2493 - DNA, 519 bp, Populus balsamifera subsp. trichocarpa
  misc_feature (1)..(519): Ceres ANNOT ID no. 1508945
  misc_feature 280496:<222: Transcription Factor
  misc_feature: Phenotype: INFLORESCENCE - Corkscrew Appearance Useful for making ornamental plants with modified flowers
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
atgggtcttttgtttagtagaatgttctcttctttatttggtaataaagaagctcgaatacttgtcctcggcctcgacaatgctggcaaaaccaccattctctatcggcttcaaatgggagaggtagtctccacgatcccaacgattggattcaatgtagaaactgtacagtacaacaacattaagtttcaagtctgggatttaggtggacaaacaagtatcaggccatattggaggtgttatttcccgaatactcaagctgtaatttatgtggtagattcaagtgacacggagagaattggaatagccaaagaagaatttcattcaattttggaggaggaagaattgaaaggtgcagttgtcctcatttttgcaaacaagcaggatctccctggtgcacttgatgctgctgctgtgactgaggcattggagttgcacaaaataaaaagtcgccaatgggccatcttcaaagcttgtgctactaagggtgacggcctctttgagggcttggactggtaa

SEQ ID NO: 2494 - protein, 165 aa, Populus balsamifera subsp. trichocarpa
  misc_feature (1)..(165): Ceres ANNOT ID no. 1508945
  misc_feature (1)..(165): Pfam Name: Arf Pfam Description: ADP-ribosylation factor family
  misc_feature: SWISSPROT Homolog: ARF3_ARATH ADP-ribosylation factor 3 with e-value of 3.3e-61 and BLAST sequence identity of 100.0
  misc_feature: SWISSPROT Homolog: ARF1_BRARP ADP-ribosylation factor 1 with e-value of 8.6e-61 and BLAST sequence identity of 99.2
  misc_feature: SWISSPROT Homolog: ARL1_HUMAN ADP-ribosylation factor-like protein 1 with e-value of 1.2e-47 and BLAST sequence identity of 75.2
  misc_feature: SWISSPROT Homolog: ARL1_MOUSE ADP-ribosylation factor-like protein 1 with e-value of 1.2e-47 and BLAST sequence identity of 75.2
  misc_feature: SWISSPROT Homolog: ARL1_RAT ADP-ribosylation factor-like protein 1 with e-value of 1.2e-47 and BLAST sequence identity of 75.2
  misc_feature 280636:<222: Transcription Factor
  misc_feature: Phenotype: INFLORESCENCE - Corkscrew Appearance Useful for making ornamental plants with modified flowers
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
  misc_feature (1)..(165): Functional Homolog of  Ceres CLONE ID no. 123279 at SEQ ID NO. 2536 with e-value of 1.10E-59 and BLAST sequence identity of 95.8
MFSSLFGNKEARILVLGLDNAGKTTILYRLQMGEVVSTIPTIGFNVETVQYNNIKFQVWDLGGQTSIRPYWRCYFPNTQAVIYVVDSSDTERIGIAKEEFHSILEEEELKGAVVLIFANKQDLPGALDAAAVTEALELHKIKSRQWAIFKACATKGDGLFEGLDW

SEQ ID NO: 2495 - DNA, 696 bp, Populus balsamifera subsp. trichocarpa
  misc_feature (1)..(696): Ceres ANNOT ID no. 1531332
  misc_feature 280758:<222: Transcription Factor
  misc_feature: Phenotype: INFLORESCENCE - Corkscrew Appearance Useful for making ornamental plants with modified flowers
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
atgggccttttgtttagtagaatgttctcttctttatttggtaatcaagaagctcgaatcctagtcctcggtctcgacaatgctggcaaaaccaccattctttatcggcttcaaatgggagaggtagtctccacgatcccaacaattgggttcaatgtggaaactgtacagtataacaacattaagttccaagtgtgggatttaggtggacaaacaagtatcaggccatattggaggtgttatttcccaaatactcaagctgtaatttatgtggtagattcaagtgacacggaaagaattggaatagccaaagaagaatttcattcaattttggaggaggaagagttgaaaggtgcagttgtcctcatttttgcaaacaagcaggatctccctggtgcacttgatgatgctgctgtgactgaggcattggagttgcacaaaataaaaagtcgccaatgggccatcttcaaagcttgcgccacaaagggtgaaggtctctttgagggtttggactgtgattggtttggaaatgaaacaaaagattggtttggcctaatggggtcgcaagcacacttttacatgctttcacacaatatccataacttggttaccgcgctctatagtgccaatgtatatgcgattgctttctctatggtgagggtaggttggccaagtcttaaatccaacaagttgtag

SEQ ID NO: 2496 - protein, 224 aa, Populus balsamifera subsp. trichocarpa
  misc_feature (1)..(224): Ceres ANNOT ID no. 1531332
  misc_feature (11)..(122): Pfam Name: MMR_HSR1 Pfam Description: GTPase of unknown function
  misc_feature: SWISSPROT Homolog: ARF3_ARATH ADP-ribosylation factor 3 with e-value of 3.3e-61 and BLAST sequence identity of 100.0
  misc_feature: SWISSPROT Homolog: ARF1_BRARP ADP-ribosylation factor 1 with e-value of 8.6e-61 and BLAST sequence identity of 99.2
  misc_feature: SWISSPROT Homolog: ARL1_HUMAN ADP-ribosylation factor-like protein 1 with e-value of 1.2e-47 and BLAST sequence identity of 75.2
  misc_feature: SWISSPROT Homolog: ARL1_MOUSE ADP-ribosylation factor-like protein 1 with e-value of 1.2e-47 and BLAST sequence identity of 75.2
  misc_feature: SWISSPROT Homolog: ARL1_RAT ADP-ribosylation factor-like protein 1 with e-value of 1.2e-47 and BLAST sequence identity of 75.2
  misc_feature 280904:<222: Transcription Factor
  misc_feature: Phenotype: INFLORESCENCE - Corkscrew Appearance Useful for making ornamental plants with modified flowers
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
  misc_feature (1)..(224): Functional Homolog of  Ceres CLONE ID no. 123279 at SEQ ID NO. 2536 with e-value of 2.90E-59 and BLAST sequence identity of 95.0
MFSSLFGNQEARILVLGLDNAGKTTILYRLQMGEVVSTIPTIGFNVETVQYNNIKFQVWDLGGQTSIRPYWRCYFPNTQAVIYVVDSSDTERIGIAKEEFHSILEEEELKGAVVLIFANKQDLPGALDDAAVTEALELHKIKSRQWAIFKACATKGEGLFEGLDCDWFGNETKDWFGLMGSQAHFYMLSHNIHNLVTALYSANVYAIAFSMVRVGWPSLKSNKL

SEQ ID NO: 2497 - DNA, 549 bp, Populus balsamifera subsp. trichocarpa
  misc_feature (1)..(549): Ceres ANNOT ID no. 1482544
  misc_feature 281038:<222: Transcription Factor
  misc_feature: Phenotype: INFLORESCENCE - Corkscrew Appearance Useful for making ornamental plants with modified flowers
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
atgggaatcttcttttctaaaatgttctcctcagtatttggcaacaaagaggctcggatccttgttcttggtcttgacaatgctggcaaaactacaattctctatcggcttcagatgggtgaagttgtatccactattccaacaattggatttaatgtcgaaacagttcagtacaacaatatcaaatttcaagtttgggatctcggtgggcagacaagcatcagaccatactggagatgctattttcccaacacacaagccattatttatgttgtcgattcaagtgatactgacaggctcgtgatagctaaagatgagtttcatgcaatcttagaggaggaagagttaagaggtgctgttgttcttatctatgcaaacaagcaggatcttcctggtgcacttgatgatgcggctgtgactgaggctttggagttgcacaagattaagaatcgacaatgggcgatttttaaaacttctgccattaaaggagaaggtctttttgaaggtttggactggttgagtaatacacttaagtctggaggtggctaa

SEQ ID NO: 2498 - protein, 175 aa, Populus balsamifera subsp. trichocarpa
  misc_feature (1)..(175): Ceres ANNOT ID no. 1482544
  misc_feature (11)..(122): Pfam Name: MMR_HSR1 Pfam Description: GTPase of unknown function
  misc_feature: SWISSPROT Homolog: ARF3_ARATH ADP-ribosylation factor 3 with e-value of 3.3e-61 and BLAST sequence identity of 100.0
  misc_feature: SWISSPROT Homolog: ARF1_BRARP ADP-ribosylation factor 1 with e-value of 8.6e-61 and BLAST sequence identity of 99.2
  misc_feature: SWISSPROT Homolog: ARL1_HUMAN ADP-ribosylation factor-like protein 1 with e-value of 1.2e-47 and BLAST sequence identity of 75.2
  misc_feature: SWISSPROT Homolog: ARL1_MOUSE ADP-ribosylation factor-like protein 1 with e-value of 1.2e-47 and BLAST sequence identity of 75.2
  misc_feature: SWISSPROT Homolog: ARL1_RAT ADP-ribosylation factor-like protein 1 with e-value of 1.2e-47 and BLAST sequence identity of 75.2
  misc_feature 281180:<222: Transcription Factor
  misc_feature: Phenotype: INFLORESCENCE - Corkscrew Appearance Useful for making ornamental plants with modified flowers
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
  misc_feature (1)..(175): Functional Homolog of  Ceres CLONE ID no. 123279 at SEQ ID NO. 2536 with e-value of 1.59E-58 and BLAST sequence identity of 93.3
MFSSVFGNKEARILVLGLDNAGKTTILYRLQMGEVVSTIPTIGFNVETVQYNNIKFQVWDLGGQTSIRPYWRCYFPNTQAIIYVVDSSDTDRLVIAKDEFHAILEEEELRGAVVLIYANKQDLPGALDDAAVTEALELHKIKNRQWAIFKTSAIKGEGLFEGLDWLSNTLKSGGG

SEQ ID NO: 2499 - DNA, 576 bp, Populus balsamifera subsp. trichocarpa
  misc_feature (1)..(576): Ceres ANNOT ID no. 1478226
  misc_feature 281302:<222: Transcription Factor
  misc_feature: Phenotype: INFLORESCENCE - Corkscrew Appearance Useful for making ornamental plants with modified flowers
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
atgggaattttgttttccaaaatgttctcttcagtatttggcaacaaagaggctcggatccttgttcttggtcttgataatgctggcaaaactacaatcctctatcggcttcagatgggcgaagttgtatccaccattccaacaattggatttaatgtggaaacagttcagtacaacaatatcaaatttcaagtatgggatcttggtgggcagacaagcatcagctcactggctgcttatgtttgcaacagaccatattggagatgttattttcccaacacacaggccattatttatgttgtcgattcaagtgacgttgataggctcgtgatagctaaagatgagtttcatgcaatcctggaggaggaagagttaagaggtgctattgttcttatttttgcgaacaagcaggatcttcctggtgcacttgatgatgcggcagtgactgaggctttggagttgcacaagatcaagaatcgacaatgggcaatttttaaaacgtctgccattaaaggagaaggtctttttgaaggtttggactggttgagtaatacactgaagtctgggggtggctaa

SEQ ID NO: 2500 - protein, 184 aa, Populus balsamifera subsp. trichocarpa
  misc_feature (1)..(184): Ceres ANNOT ID no. 1478226
  misc_feature (12)..(181): Pfam Name: Ras Pfam Description: Ras family
  misc_feature: SWISSPROT Homolog: ARF3_ARATH ADP-ribosylation factor 3 with e-value of 3.3e-61 and BLAST sequence identity of 100.0
  misc_feature: SWISSPROT Homolog: ARF1_BRARP ADP-ribosylation factor 1 with e-value of 8.6e-61 and BLAST sequence identity of 99.2
  misc_feature: SWISSPROT Homolog: ARL1_HUMAN ADP-ribosylation factor-like protein 1 with e-value of 1.2e-47 and BLAST sequence identity of 75.2
  misc_feature: SWISSPROT Homolog: ARL1_MOUSE ADP-ribosylation factor-like protein 1 with e-value of 1.2e-47 and BLAST sequence identity of 75.2
  misc_feature: SWISSPROT Homolog: ARL1_RAT ADP-ribosylation factor-like protein 1 with e-value of 1.2e-47 and BLAST sequence identity of 75.2
  misc_feature 281444:<222: Transcription Factor
  misc_feature: Phenotype: INFLORESCENCE - Corkscrew Appearance Useful for making ornamental plants with modified flowers
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Other Useful for making ornamental plants with modified leaves
  misc_feature (1)..(184): Functional Homolog of  Ceres CLONE ID no. 123279 at SEQ ID NO. 2536 with e-value of 1.50E-55 and BLAST sequence identity of 92.5
MFSSVFGNKEARILVLGLDNAGKTTILYRLQMGEVVSTIPTIGFNVETVQYNNIKFQVWDLGGQTSISSLAAYVCNRPYWRCYFPNTQAIIYVVDSSDVDRLVIAKDEFHAILEEEELRGAIVLIFANKQDLPGALDDAAVTEALELHKIKNRQWAIFKTSAIKGEGLFEGLDWLSNTLKSGGG

SEQ ID NO: 2501 - protein, 244 aa, Arabidopsis thaliana
  misc_feature (1)..(244): Ceres CLONE ID no. 124720
  misc_feature (25)..(88): Pfam Name: AP2 Pfam Description: AP2 domain
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Short Useful for increasing seed/fruit yield or modifying fruit content
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
MRKGRGSSVVGPALPVTAGGSVKEPRYRGVRKRPWGRFAAEIRDPLKKSRVWLGTFDSAVDAARAYDTAARNLRGPKAKTNFPIDCSPSSPLQPLTYLHNQNLCSPPVIQNQIDPFMDHRLYGGGNFQEQQQQQIISRPASSSMSSTVKSCSGPRPMEAAAASSSVAKPLHAIKRYPRTPPVAPEDCHSDCDSSSSVIDDGDDIASSSSRRKTPFQFDLNFPPLDGVDLFAGGIDDLHCTDLRL

SEQ ID NO: 2502 - DNA, 660 bp, Populus balsamifera subsp. trichocarpa
  misc_feature (1)..(660): Ceres ANNOT ID no. 1441430
  misc_feature 281680:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Short Useful for increasing seed/fruit yield or modifying fruit content
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
atggggagaacaagaacaacaacaaaacaggctgttgacccaaatggatctgcaacccaaaatatgttagtaattgcaaaagagcccagatacagaggagtacgaaagagaccatggggaagattcgctgcggagattagagatccctggaaaaagaccagagtttggctgggcaccttcgactctgcagaggatgcagcgcgtgcctacgatgcggctgctcgcaccctccgcggagcaaaggccaagacaaactttcctatctccacaacgaaccagttattcaatcatcaaaatcaaaaccaaagcccaaccgatcccttcttggatcaccacagtataaatccccaaagacccacatctagcagtttgagcagtacagtggagtctttcagcggtcctaggcctccgcagccaacaacaacaacaaaatcgggaaatgggccgaggagatctcatccacggatcccaccggttgttccagaagattgtcatagcgattgcgattcatcttcttcggtggttgatgacagagatgtcgcatccgctgcttcttctttgtgccgcaagcctttgcctttcgatctaaatttcccaccgttggaccaggttgacttgggctctggtgatgatctccactgcactgctttatgcctttga

SEQ ID NO: 2503 - protein, 219 aa, Populus balsamifera subsp. trichocarpa
  misc_feature (1)..(219): Ceres ANNOT ID no. 1441430
  misc_feature (29)..(92): Pfam Name: AP2 Pfam Description: AP2 domain
  misc_feature: SWISSPROT Homolog: ERF7_ARATH Ethylene-responsive transcription factor 7 EREBP-7 (AtERF7) with e-value of 4.2e-132 and BLAST sequence identity of 100.0
  misc_feature: SWISSPROT Homolog: ERF3_ARATH Ethylene-responsive transcription factor 3 EREBP-3 (AtERF3) with e-value of 2.2e-48 and BLAST sequence identity of 59.2
  misc_feature: SWISSPROT Homolog: ERF3_TOBAC Ethylene-responsive transcription factor 3 EREBP-5 (NtERF5) with e-value of 2.6e-36 and BLAST sequence identity of 45.6
  misc_feature: SWISSPROT Homolog: ERF4_TOBAC Ethylene-responsive transcription factor 4 EREBP-3 (NtERF3) with e-value of 1.3e-27 and BLAST sequence identity of 77.1
  misc_feature: SWISSPROT Homolog: ERF4_NICSY Ethylene-responsive transcription factor 4 EREBP-3 (NsERF3) with e-value of 3.4e-27 and BLAST sequence identity of 82.5
  misc_feature 281810:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Short Useful for increasing seed/fruit yield or modifying fruit content
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature (1)..(219): Functional Homolog of  Ceres CLONE ID no. 124720 at SEQ ID NO. 2545 with e-value of 9.99E-57 and BLAST sequence identity of 67.8
MGRTRTTTKQAVDPNGSATQNMLVIAKEPRYRGVRKRPWGRFAAEIRDPWKKTRVWLGTFDSAEDAARAYDAAARTLRGAKAKTNFPISTTNQLFNHQNQNQSPTDPFLDHHSINPQRPTSSSLSSTVESFSGPRPPQPTTTTKSGNGPRRSHPRIPPVVPEDCHSDCDSSSSVVDDRDVASAASSLCRKPLPFDLNFPPLDQVDLGSGDDLHCTALCL

SEQ ID NO: 2504 - protein, 310 aa, Arabidopsis thaliana
  misc_feature (1)..(310): Ceres CLONE ID no. 125039
  misc_feature (108)..(264): Pfam Name: APS_kinase Pfam Description: Adenylylsulphate kinase
  misc_feature: Utility: Heat Useful for making plants with enhanced tolerance to heat
  misc_feature: Phenotype: WHOLE PLANT - Heat Useful for making plants with enhanced tolerance to heat
MDVAAMARCVGRCYVSPAFGESESHRLSERRFLKLSSSTNSDPAGSKSLKLRGKIHRRMSYFRPIMAKDESISSRSGETKQINGKQKNIVWHDCPVTKSDRQELIKHKGCVIWITGLSGSGKSSLACALSRALHNRGKLSYILDGDNVRHGLNSDLSFEADDRAENIRRVGEVAKLFADSGIICIASLISPYRIERAACRALLPQGDFIEVFMDVPLHVCEARDPKGLYKRARAGKIKGFTGVDDPYEAPLDCEIVIQNSRDKGLSSSSSSSSSPSSSSSSLCEMADIVVSYLDQNGYLKKHSTKSRDCM

SEQ ID NO: 2505 - DNA, 846 bp, Populus balsamifera subsp. trichocarpa
  misc_feature (1)..(846): Ceres ANNOT ID no. 1514426
  misc_feature: Utility: Heat Useful for making plants with enhanced tolerance to heat
  misc_feature 282020:<222: Transcription Factor
  misc_feature: Phenotype: WHOLE PLANT - Heat Useful for making plants with enhanced tolerance to heat
atgaatgcttccgggtttaagccagcactgcctggaatttcgagctcgaaaaggctcggattttttagcttcagtggcggtaatcaaccccttgatttgaaaccgagaggggtttgcctgatcaaggctgccatggaagagacccggacgcttaaactggatgtgaatggcaaggtggaggataagctgccaaatgggcacgcaggcaaaaatcataaccgattgtctacaatgggaaactcaacaaacataaagtggcatgaatgccctgttgaaaaaattgacagacagaagcttctcaaacaaaagggttgtgttgtatggatcaccggtctcagtggttcagggaagagcactgtagcatgtgccttgagtcacatgttgtaccagagaggaagcttgtcttacattcttgatggcgacaacatcaggcacggtctaaatcgtgaccttagttttaaagcagaagaccgtgccgagaatataaggagagttggggaggtagcaaaactttttgcagatgctggatttatttgcatcgcctgcctgatttctccatacagaagggaccgggctgaatgtcgtgcaatgttaccaagcgatgattttgttgaggtgtttatggatgttcccctccaagtttgtgagaacagagacccaaaaggcttgtataagcttgctcgtgctggaaagatcaaaggttttactggcgttgatgatccatatgaaccaccattggatgctgagatagtattgcaatgcaacacaggagactgttctaccccatgtgacatggctgagaaggtgatttcttacttggaggtaaaaggatatctccaagcataa

SEQ ID NO: 2506 - protein, 281 aa, Populus balsamifera subsp. trichocarpa
  misc_feature (1)..(281): Ceres ANNOT ID no. 1514426
  misc_feature (104)..(136): Pfam Name: ABC_tran Pfam Description: ABC transporter
  misc_feature: SWISSPROT Homolog: KAP1_ARATH Adenylyl-sulfate kinase 1, with e-value of 8.0e-79 and BLAST sequence identity of 58.3
  misc_feature: SWISSPROT Homolog: KAP1_ARATH EC 2.7.1.25 (APS kinase) (Adenosine-5'phosphosulfate kinase) (ATP adenosine-5'-phosphosulfate 3'- phosphotransferase)
  misc_feature: SWISSPROT Homolog: KAPS_CATRO Adenylyl-sulfate kinase, with e-value of 1.1e-78 and BLAST sequence identity of 62.2
  misc_feature: SWISSPROT Homolog: KAPS_CATRO EC 2.7.1.25 (APS kinase) (Adenosine-5'phosphosulfate kinase) (ATP adenosine-5'-phosphosulfate 3'- phosphotransferase)
  misc_feature: SWISSPROT Homolog: KAP2_ARATH Adenylyl-sulfate kinase 2, with e-value of 7.5e-78 and BLAST sequence identity of 55.7
  misc_feature: SWISSPROT Homolog: KAP2_ARATH EC 2.7.1.25 (APS kinase) (Adenosine-5'phosphosulfate kinase) (ATP adenosine-5'-phosphosulfate 3'- phosphotransferase)
  misc_feature: SWISSPROT Homolog: CYSC2_BACSU Probable adenylyl-sulfate kinase with e-value of 1.1e-58 and BLAST sequence identity of 59.2
  misc_feature: SWISSPROT Homolog: CYSC2_BACSU EC 2.7.1.25 (APS kinase)(Adenosine-5'phosphosulfate kinase) ( ATP adenosine-5'-phosphosulfate 3'-phosphotransferase)
  misc_feature: SWISSPROT Homolog: CYSC_CLOAB Adenylyl-sulfate kinase with e-value of 9.8e-53 and BLAST sequence identity of 55.0
  misc_feature: SWISSPROT Homolog: CYSC_CLOAB EC 2.7.1.25 (APS kinase) (Adenosine-5'phosphosulfate kinase) (ATP adenosine-5'-phosphosulfate 3'- phosphotransferase)
  misc_feature: Utility: Heat Useful for making plants with enhanced tolerance to heat
  misc_feature 282166:<222: Transcription Factor
  misc_feature: Phenotype: WHOLE PLANT - Heat Useful for making plants with enhanced tolerance to heat
  misc_feature (1)..(281): Functional Homolog of  Ceres CLONE ID no. 125039 at SEQ ID NO. 2548 with e-value of 9.50E-77 and BLAST sequence identity of 73.7
MNASGFKPALPGISSSKRLGFFSFSGGNQPLDLKPRGVCLIKAAMEETRTLKLDVNGKVEDKLPNGHAGKNHNRLSTMGNSTNIKWHECPVEKIDRQKLLKQKGCVVWITGLSGSGKSTVACALSHMLYQRGSLSYILDGDNIRHGLNRDLSFKAEDRAENIRRVGEVAKLFADAGFICIACLISPYRRDRAECRAMLPSDDFVEVFMDVPLQVCENRDPKGLYKLARAGKIKGFTGVDDPYEPPLDAEIVLQCNTGDCSTPCDMAEKVISYLEVKGYLQA

SEQ ID NO: 2507 - protein, 429 aa, Arabidopsis thaliana
  misc_feature (1)..(429): Ceres CLONE ID no. 125922
  misc_feature (1)..(429): Also Known As Ceres CDNA ID no. 23365512
  misc_feature (1)..(429): Also Known As Ceres GEMINI ID 539G7
  misc_feature (289)..(318): Pfam Name: zf-C3HC4 Pfam Description: Zinc finger, C3HC4 type (RING finger)
  misc_feature 282273:<222: Transcription Factor
  misc_feature: Phenotype: Activates expression of the gene endogenous to the AtPES (SEQ ID NO 4142) regalutory region Useful for modulating Terpenoid Biosynthesis
MGNACCVAARDKMVVPNSSAGENLQRSNIRHSPSWSFRWDNRGRVAGEETSLSWLSDGISRNDGSEIKFESAFVSSEGSPLDSFRTQTLQKSPASDLSFPRNSSMNTVFEQKENVSTESAAPSYLSPAQLSLSLASQPSSFPTSPLSSQSYLHPASSSTLKLTQHPRLSKQVSDGQIYGQNSLSRSSATEERQGTPTRYDSSQSGPSEGWSLQAFSEMMSSSRSNKALSYDNYDNDCFGLQRDKIDHHGNRMSKHQQHTCGACSRLLSEKSLWSSQKIFMTNELSVSAILACGHVYHGECLEQMTPEIDKFDPSCPICTMGEKKTAKLSEKALKVEMDLKARHNKRLRNRVLDSDFDCDDFVMFDHSHRTAAAASKSPRLVSSSSAKSYSAKPFLARHFSFGSRSNYKSPKENLPVKKKGFFWTKSSKI

SEQ ID NO: 2508 - DNA, 1317 bp, Populus balsamifera subsp. trichocarpa
  misc_feature (1)..(1317): Ceres ANNOT ID no. 1450377
  misc_feature 282379:<222: Transcription Factor
  misc_feature: Phenotype: Activates expression of the gene endogenous to the AtPES (SEQ ID NO 4142) regalutory region Useful for modulating Terpenoid Biosynthesis
atggggagtgcttgctgtgttgctgcgagagataaaaatatagtgagtggaccaggtggtgaaatcttgcatagaaatattcggtattcgccaacttggagctttagatgggataatcgagggcgagtagcaggggaagatacatcgataagttggttttctgatggaattagcagaaatgatggatcagaaattaaaaatgaatcaacctatacatcggaggatggaagcccaacggagagcttccagagacatacgtggcagaagtccccaacatctgaaggaaccgcagctcatgcgaggactcctgcttcagatcaatccctcccaaggaatatctcaatggacacgagtttggaacaggtgaaggagtcaacagaatccatggcggttctgaatccatctcctgagaaaatctctctgtcagtgccctctacttcatccttatcaacatctccacttcccccccaaagtcatttacatcctgccagcccaacaacatcaaggtggctacagcactctccgagacatcagctaacaaagccagtatctgatgtccgaatcccaggattgaggtcatcaaagagcatcccaggttctgaagagaggcctcctgtttcttcatggagccatgaatcaactcagggatgccatggcgagtcttcagatggctggtctatgcatgcattttctgagctcatggctacttctaatagagaaaggtggtcttttgataatgagtgcttggggtttaatcatgagaagaccagatccagtggtcgaagctcagcttttacttctgttgatcttcaaacatgtgggatctgctcaaagctattgactgataaatctttgtggggcagccagaagctcattgctactaatgagctctctgttgtcgcagttttaatttgtggtcacacttatcatgctgagtgtttggaagctctgactcctgaaattgacaagtatgatcctgcatgcccattttgtaccttgggagagaagcaggcctttaagctgtctcaaaaagctttaaaaacagaaatggacttgaaggctagaaacaagaaattgaggagccgagtggtagatagtgatcttgatggtgattcggcaatgtttgatcgctttaaagatggtggaagtgaaggaaagggtccaaagatgggcttaagttccagcatgaaaagttccttggcaaagcctttcttgaggcggcatttttcatttgcatccaaagcgagtagatcctctactgagaatcactcaaccagaaagaaaggtttcttctggacaagatctctgaggggttga

SEQ ID NO: 2509 - protein, 438 aa, Populus balsamifera subsp. trichocarpa
  misc_feature (1)..(438): Ceres ANNOT ID no. 1450377
  misc_feature 282448:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(438): Functional Homolog of  Ceres CLONE ID no. 125922 at SEQ ID NO. 2551 with e-value of 3.09E-110 and BLAST sequence identity of 57.7
MGSACCVAARDKNIVSGPGGEILHRNIRYSPTWSFRWDNRGRVAGEDTSISWFSDGISRNDGSEIKNESTYTSEDGSPTESFQRHTWQKSPTSEGTAAHARTPASDQSLPRNISMDTSLEQVKESTESMAVLNPSPEKISLSVPSTSSLSTSPLPPQSHLHPASPTTSRWLQHSPRHQLTKPVSDVRIPGLRSSKSIPGSEERPPVSSWSHESTQGCHGESSDGWSMHAFSELMATSNRERWSFDNECLGFNHEKTRSSGRSSAFTSVDLQTCGICSKLLTDKSLWGSQKLIATNELSVVAVLICGHTYHAECLEALTPEIDKYDPACPFCTLGEKQAFKLSQKALKTEMDLKARNKKLRSRVVDSDLDGDSAMFDRFKDGGSEGKGPKMGLSSSMKSSLAKPFLRRHFSFASKASRSSTENHSTRKKGFFWTRSLRG

SEQ ID NO: 2510 - DNA, 1242 bp, Populus balsamifera subsp. trichocarpa
  misc_feature (1)..(1242): Ceres ANNOT ID no. 1514052
  misc_feature 282565:<222: Transcription Factor
  misc_feature: Phenotype: Activates expression of the gene endogenous to the AtPES (SEQ ID NO 4142) regalutory region Useful for modulating Terpenoid Biosynthesis
atgggaggtgcctgttgtgttgctgctagagataaaaatatagtaagtggaccaggtggtgacatcttgcatagaaatattcgttattcaccatcttggagctttagatgggataatcgagggcgagtagcaggggaagatgcttcgataagttggttttctggtggaattagcaggaattatggatcagatattaaacatgaatcaacctatgcatctgaggatggaagcccaacggagagtttccagagacgtacatggcagaaatccccaacatctgaaggaactgctgtggaggagtcaacagaatccactgcagttctgaaactatctcctgcaaaatcctcgctttcattgccctcatcttcatcctcatcaacatctccacttccatcccaaggtcacttacatcctgccagctcaacaccaagatggctccagcattcttctagaaatcaactaacaaagccagtatctgatgcgctaatccctggattgaagtcatcaaagagcatcccagtttctgatgagaggcctcctattccttcatggagcaatggatcaactcggggatgccatggcgagtcttcagatggttggtctatgcatgcattttctgagctcacggccacttccaatagagaaaggtggtcttttgataacgagtgcttgggctttaatcataagaagacaagatccagcggtcgaaactcatcttttccttcggttgatcttcaaacatgtgggatctgcttgaagctattgactgaaaaatctttgtggagcagccagaagcttattgctagtaatgagctctccgttgttgctgtcttaacttgtggtcatgcttatcatgctgagtgtttggaagctttgacacctgaaattgataagtatgatcctgcatgcccattttgtaccttgggagagaagcaggcctttcagctgtctcaaaaagctttaaaaacagaaaccgatttgaaggctagaaacaagaaactgaggagcagagtagttgatggtgatcttgatggtgattctatcatgtttgatcgcttaaaaggtggtggacaggaaggaaagggtcccgagatgggctcaagtgccagcatgaaaagctccttggcgaagcctttcttgaggaaacatttttcatttggatccaaagggagtagatcctccacggagactcactcaactagaaagaaagggttcttctggacaaaatctttgaggggatga

SEQ ID NO: 2511 - protein, 413 aa, Populus balsamifera subsp. trichocarpa
  misc_feature (1)..(413): Ceres ANNOT ID no. 1514052
  misc_feature (248)..(306): Pfam Name: zf-C3HC4 Pfam Description: Zinc finger, C3HC4 type (RING finger)
  misc_feature 282638:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(413): Functional Homolog of  Ceres CLONE ID no. 125922 at SEQ ID NO. 2551 with e-value of 5.70E-102 and BLAST sequence identity of 55.8
MGGACCVAARDKNIVSGPGGDILHRNIRYSPSWSFRWDNRGRVAGEDASISWFSGGISRNYGSDIKHESTYASEDGSPTESFQRRTWQKSPTSEGTAVEESTESTAVLKLSPAKSSLSLPSSSSSSTSPLPSQGHLHPASSTPRWLQHSSRNQLTKPVSDALIPGLKSSKSIPVSDERPPIPSWSNGSTRGCHGESSDGWSMHAFSELTATSNRERWSFDNECLGFNHKKTRSSGRNSSFPSVDLQTCGICLKLLTEKSLWSSQKLIASNELSVVAVLTCGHAYHAECLEALTPEIDKYDPACPFCTLGEKQAFQLSQKALKTETDLKARNKKLRSRVVDGDLDGDSIMFDRLKGGGQEGKGPEMGSSASMKSSLAKPFLRKHFSFGSKGSRSSTETHSTRKKGFFWTKSLRG

SEQ ID NO: 2512 - protein, 305 aa, Arabidopsis thaliana
  misc_feature (1)..(305): Ceres CLONE ID no. 126592
  misc_feature (201)..(263): Pfam Name: Sod_Fe_C Pfam Description: Iron/manganese superoxide dismutases C-terminal domain
  misc_feature (52)..(137): Pfam Name: Sod_Fe_N Pfam Description: Iron/manganese superoxide dismutases alpha-hairpin domain
  misc_feature: Utility: pH (high) Useful for making plants tolerant to high pH or low phosphate
  misc_feature: Phenotype: WHOLE PLANT - pH (high) Useful for making plants tolerant to high pH or low phosphate
  misc_feature: Phenotype: INFLORESCENCE - Other Useful for making ornamental plants with modified flowers
MMNVAVTATPSSLLYSPLLLPSQGPNRRMQWKRNGKRRLGTKVAVSGVITAGFELKPPPYPLDALEPHMSRETLDYHWGKHHKTYVENLNKQILGTDLDALSLEEVVLLSYNKGNMLPAFNNAAQAWNHEFFWESIQPGGGGKPTGELLRLIERDFGSFEEFLERFKSAAASNFGSGWTWLAYKANRLDVANAVNPLPKEEDKKLVIVKTPNAVNPLVWDYSPLLTIDTWEHAYYLDFENRRAEYINTFMEKLVSWETVSTRLESAIARAVQREQEGTETEDEENPDDEVPEVYLDSDIDVSEVD

SEQ ID NO: 2513 - DNA, 900 bp, Populus balsamifera subsp. trichocarpa
  misc_feature (1)..(900): Ceres ANNOT ID no. 1474017
  misc_feature: Utility: pH (high) Useful for making plants tolerant to high pH or low phosphate
  misc_feature 282864:<222: Transcription Factor
  misc_feature: Phenotype: WHOLE PLANT - pH (high) Useful for making plants tolerant to high pH or low phosphate
  misc_feature: Phenotype: INFLORESCENCE - Other Useful for making ornamental plants with modified flowers
atggttgcagcagcagcaacagctactgcagctaatccactaacatgctcactatttccaagccaaggtcttagaggaacaactagtgggctgcaatggacaaagaggcaatgtaccagaaaggcaagtgctttgacagttacagctaaatttgagctgaaacctcctccatatcccatgaatgcattggagccgcatatgagcaaagacacatttgagtatcactggggaaagcatcacagggcttatgtgaataacttgaacaagcaaattgaaggaacagagctagatgacatgtcgttagatgatgttgtgcttattacatacaacaagggtgatccacttcctgctttcaacaacgctgcacaggcctggaaccacgaattcttttgggaatccatgaaaccgggagggggaggaaagccatcaggggaacttcttcaattaatggaaagagattttggttcttttgataaatttgttgaagagttcaagtcggctgcagctactcagtttggttctggatgggcttggctcgtatacaaagcaaatagacttgatgttggaaatgctgtaaatccttgtccatcagaggaggataaaaagcttgtagtggtcaagagtcccaatgccgtgaatccccttgtttgggattatcatccactccttacaattgatgtttgggagaatcgacgacctgattatacatcaaattttatggaaaggctggtgtcatgggatgcagttagtgcgagacttgaagttgcaagggctcgagctgctgagagagaaatagaagaagcaagaaagagaaaagaggaagaggaggggaactttacagacaaagaacctgcagagattttcatagatggggttgctgacgattctgagactgattga

SEQ ID NO: 2514 - protein, 299 aa, Populus balsamifera subsp. trichocarpa
  misc_feature (1)..(299): Ceres ANNOT ID no. 1474017
  misc_feature (139)..(253): Pfam Name: Sod_Fe_C Pfam Description: Iron/manganese superoxide dismutases C-terminal domain
  misc_feature (50)..(135): Pfam Name: Sod_Fe_N Pfam Description: Iron/manganese superoxide dismutases alpha-hairpin domain
  misc_feature: SWISSPROT Homolog: SODF_SOYBN Superoxide dismutase [Fe], (EC 1.15.1.1) with e-value of 3.1e-88 and BLAST sequence identity of 69.2
  misc_feature: SWISSPROT Homolog: SODF_ARATH Superoxide dismutase [Fe], (EC 1.15.1.1) with e-value of 3.0e-81 and BLAST sequence identity of 63.3
  misc_feature: SWISSPROT Homolog: SODF_NICPL Superoxide dismutase [Fe], chloroplast (EC 1.15.1.1) (Fragment) with e-value of 5.1e-79 and BLAST sequence identity of 66.2
  misc_feature: SWISSPROT Homolog: SODF_RICCN Superoxide dismutase [Mn/Fe] (EC 1.15.1.1) with e-value of 4.0e-53 and BLAST sequence identity of 51.7
  misc_feature: SWISSPROT Homolog: SODF_PLEBO Superoxide dismutase [Fe] (EC 1.15.1.1) with e-value of 7.7e-53 and BLAST sequence identity of 49.5
  misc_feature: Utility: pH (high) Useful for making plants tolerant to high pH or low phosphate
  misc_feature 282988:<222: Transcription Factor
  misc_feature: Phenotype: WHOLE PLANT - pH (high) Useful for making plants tolerant to high pH or low phosphate
  misc_feature: Phenotype: INFLORESCENCE - Other Useful for making ornamental plants with modified flowers
  misc_feature (1)..(299): Functional Homolog of  Ceres CLONE ID no. 126592 at SEQ ID NO. 2556 with e-value of 4.20E-99 and BLAST sequence identity of 65.7
MVAAAATATAANPLTCSLFPSQGLRGTTSGLQWTKRQCTRKASALTVTAKFELKPPPYPMNALEPHMSKDTFEYHWGKHHRAYVNNLNKQIEGTELDDMSLDDVVLITYNKGDPLPAFNNAAQAWNHEFFWESMKPGGGGKPSGELLQLMERDFGSFDKFVEEFKSAAATQFGSGWAWLVYKANRLDVGNAVNPCPSEEDKKLVVVKSPNAVNPLVWDYHPLLTIDVWENRRPDYTSNFMERLVSWDAVSARLEVARARAAEREIEEARKRKEEEEGNFTDKEPAEIFIDGVADDSETD

SEQ ID NO: 2515 - DNA, 948 bp, Populus balsamifera subsp. trichocarpa
  misc_feature (1)..(948): Ceres ANNOT ID no. 1468796
  misc_feature: Utility: pH (high) Useful for making plants tolerant to high pH or low phosphate
  misc_feature 283091:<222: Transcription Factor
  misc_feature: Phenotype: WHOLE PLANT - pH (high) Useful for making plants tolerant to high pH or low phosphate
  misc_feature: Phenotype: INFLORESCENCE - Other Useful for making ornamental plants with modified flowers
gttctaggctggagactcctggatgaagaaggtggactgaaactgcaatgcttgtggaagttgagagattttaaatgtggggttgagcttgtcaatagaatttacaaagctacagaatcatgtggccatttcccaaatgtgcacttggaacagcccaatcaagttagagctgaactatggactgcatcccttggtcttacagcaactggtgtgctgcgatggacagagaggcaatgtaccagaaaggctgatgctttgacagttacagctaaatttgagctgaaacctcctccatatcccatggatgatttagagccgcatatgagcaaggacacatttgagtatcaccggggaaagcatcacagggcttatgtggataacttaaacaagcaaattgacggaacagaacgagatgacatgtccttagatgatgttgtgctcgttacatacaacaagggtggtccacttcctgctttcaacaatgctgcacaggcatggaaccatgaattctttttggaatccatgaaaccgggaggtggaggaaaggcatcaggggaacttcttcacttgattgaaagagattttggttcttttgatagatttgtgcaagagttcaagtcggctgcagctactcagtttggttctggatgggcttggcttacaaggaaaatagacttagatgctggaaatgttgtaaatcctcgtccaccggaggaggataaaaagcttgtagtggtcaagagtcccagtgcaccactccatacaattgatgcttgggagaatcgacgacctgattacacatcaacttccatggagaagcttgtgtttagtgcgagacttgaagttgcaaaggctcgagctgccgagagagaaatagaagaagcgagaaagaaaaaggaggaactttatagacaaaaaaacctgccgaggttttcgtggatgggatag

SEQ ID NO: 2516 - protein, 315 aa, Populus balsamifera subsp. trichocarpa
  misc_feature (1)..(315): Ceres ANNOT ID no. 1468796
  misc_feature (180)..(280): Pfam Name: Sod_Fe_C Pfam Description: Iron/manganese superoxide dismutases C-terminal domain
  misc_feature (91)..(176): Pfam Name: Sod_Fe_N Pfam Description: Iron/manganese superoxide dismutases alpha-hairpin domain
  misc_feature: SWISSPROT Homolog: SODF_SOYBN Superoxide dismutase [Fe], (EC 1.15.1.1) with e-value of 3.1e-88 and BLAST sequence identity of 69.2
  misc_feature: SWISSPROT Homolog: SODF_ARATH Superoxide dismutase [Fe], (EC 1.15.1.1) with e-value of 3.0e-81 and BLAST sequence identity of 63.3
  misc_feature: SWISSPROT Homolog: SODF_NICPL Superoxide dismutase [Fe], chloroplast (EC 1.15.1.1) (Fragment) with e-value of 5.1e-79 and BLAST sequence identity of 66.2
  misc_feature: SWISSPROT Homolog: SODF_RICCN Superoxide dismutase [Mn/Fe] (EC 1.15.1.1) with e-value of 4.0e-53 and BLAST sequence identity of 51.7
  misc_feature: SWISSPROT Homolog: SODF_PLEBO Superoxide dismutase [Fe] (EC 1.15.1.1) with e-value of 7.7e-53 and BLAST sequence identity of 49.5
  misc_feature: Utility: pH (high) Useful for making plants tolerant to high pH or low phosphate
  misc_feature 283215:<222: Transcription Factor
  misc_feature: Phenotype: WHOLE PLANT - pH (high) Useful for making plants tolerant to high pH or low phosphate
  misc_feature: Phenotype: INFLORESCENCE - Other Useful for making ornamental plants with modified flowers
  misc_feature (1)..(315): Functional Homolog of  Ceres CLONE ID no. 126592 at SEQ ID NO. 2556 with e-value of 3.10E-71 and BLAST sequence identity of 66.2
VLGWRLLDEEGGLKLQCLWKLRDFKCGVELVNRIYKATESCGHFPNVHLEQPNQVRAELWTASLGLTATGVLRWTERQCTRKADALTVTAKFELKPPPYPMDDLEPHMSKDTFEYHRGKHHRAYVDNLNKQIDGTERDDMSLDDVVLVTYNKGGPLPAFNNAAQAWNHEFFLESMKPGGGGKASGELLHLIERDFGSFDRFVQEFKSAAATQFGSGWAWLTRKIDLDAGNVVNPRPPEEDKKLVVVKSPSAPLHTIDAWENRRPDYTSTSMEKLVFSARLEVAKARAAEREIEEARKKKEELYRQKNLPRFSWMG

SEQ ID NO: 2517 - protein, 428 aa, Arabidopsis thaliana
  misc_feature (1)..(428): Ceres CLONE ID no. 141805
  misc_feature (89)..(393): Pfam Name: E1_dh Pfam Description: Dehydrogenase E1 component
  misc_feature: Phenotype: INFLORESCENCE - Late Flowering Useful for modulating flowering time
MATAFAPTKLTATVPLHGSHENRLLLPIRLAPPSSFLGSTRSLSLRRLNHSNATRRSPVVSVQEVVKEKQSTNNTSLLITKEEGLELYEDMILGRSFEDMCAQMYYRGKMFGFVHLYNGQEAVSTGFIKLLTKSDSVVSTYRDHVHALSKGVSARAVMSELFGKVTGCCRGQGGSMHMFSKEHNMLGGFAFIGEGIPVATGAAFSSKYRREVLKQDCDDVTVAFFGDGTCNNGQFFECLNMAALYKLPIIFVVENNLWAIGMSHLRATSDPEIWKKGPAFGMPGVHVDGMDVLKVREVAKEAVTRARRGEGPTLVECETYRFRGHSLADPDELRDAAEKAKYAARDPIAALKKYLIENKLAKEAELKSIEKKIDELVEEAVEFADASPQPGRSQLLENVFADPKGFGIGPDGRYRCEDPKFTEGTAQV

SEQ ID NO: 2518 - DNA, 1329 bp, Populus balsamifera subsp. trichocarpa; identical to SEQ ID NO: 1655
  misc_feature (1)..(1329): Ceres ANNOT ID no. 1497485
  misc_feature 283424:<222: Transcription Factor
  misc_feature: Phenotype: INFLORESCENCE - Late Flowering Useful for modulating flowering time

SEQ ID NO: 2519 - protein, 442 aa, Populus balsamifera subsp. trichocarpa; identical to SEQ ID NO: 1656
  misc_feature (1)..(442): Ceres ANNOT ID no. 1497485
  misc_feature (178)..(331): Pfam Name: TPP_enzyme_C Pfam Description: Thiamine pyrophosphate enzyme C-terminal TPP binding domain
  misc_feature: SWISSPROT Homolog: ODPA_PORPU Pyruvate dehydrogenase E1 component alpha subunit (EC 1.2.4.1) with e-value of 8.4e-118 and BLAST sequence identity of 67.2
  misc_feature: SWISSPROT Homolog: ODPA_RHIME Pyruvate dehydrogenase E1 component, alpha subunit (EC 1.2.4.1) with e-value of 2.4e-72 and BLAST sequence identity of 42.7
  misc_feature: SWISSPROT Homolog: ODPA_RICCN Pyruvate dehydrogenase E1 component, alpha subunit (EC 1.2.4.1) with e-value of 1.7e-71 and BLAST sequence identity of 40.8
  misc_feature: SWISSPROT Homolog: ODPA_RICPR Pyruvate dehydrogenase E1 component, alpha subunit (EC 1.2.4.1) with e-value of 7.6e-69 and BLAST sequence identity of 39.4
  misc_feature: SWISSPROT Homolog: ODPA_ZYMMO Pyruvate dehydrogenase E1 component, alpha subunit (EC 1.2.4.1) with e-value of 7.9e-67 and BLAST sequence identity of 43.9
  misc_feature 283542:<222: Transcription Factor
  misc_feature: Phenotype: INFLORESCENCE - Late Flowering Useful for modulating flowering time
  misc_feature (1)..(442): Functional Homolog of  Ceres CLONE ID no. 141805 at SEQ ID NO. 2561 with e-value of 1.59E-191 and BLAST sequence identity of 85.0

SEQ ID NO: 2520 - protein, 460 aa, Arabidopsis thaliana
  misc_feature (1)..(460): Ceres CLONE ID no. 141830
  misc_feature (49)..(203): Pfam Name: PGAM Pfam Description: Phosphoglycerate mutase family
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: WHOLE PLANT - Other Useful for making bigger plants
  misc_feature: Phenotype: ROSETTE LEAVES - Serrate Margins Useful for making plants with increased biomass and foliage
MISLPLTTPILPSRCLLHKTRRQNSTRRRLLIRSSSSLQDQFTVETTKRVVLVRHGQSTWNEEGRIQGSSDFSVLTKKGESQAEISRQMLIDDSFDVCFTSPLKRSKKTAEIIWGSRESEMIFDYDLREIDLYSFQGLLKKEGKEKFGEAFKQWQEDPANFIIDGHYPVRELWSRARSCWPGILAHESKSVLVVAHNAVNQALLATAIGLGTEYFRSLLQSNCGVSVLDFIPRADGGSPHVCLNRLNQTPNSPLAGGSSGGRKASKQIILVCHGQGNNESQKTAELLLDLRVSSIVCSPKTASIESSGVISRVQEAAGCLGVDNVPHYVKTKQMNELDVESVLRKSNKDNDVIASQLDEEAFSALWNRSEKAWESLLDELSDEKSNPGEIMVVVGPAMTHISLIAQCLNLTKEALGLFHLDAGSISVIDFPDGPSSKGVIRCTNYTAHLGRWSIPITKPA

SEQ ID NO: 2521 - DNA, 1950 bp, Populus balsamifera subsp. trichocarpa
  misc_feature (1)..(1950): Ceres ANNOT ID no. 1488335
  misc_feature 283795:<222: Transcription Factor
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: WHOLE PLANT - Other Useful for making bigger plants
  misc_feature: Phenotype: ROSETTE LEAVES - Serrate Margins Useful for making plants with increased biomass and foliage
atgctttcagtttcacctcctccgtctcttcccctcctccaccaccacaaccgcagcctcatccaccacggaaaccaccgtcttctcttcacagtccgttcatcttcatcctcaagcatccaagaagctgtagaggaaaaaacatcgaatgaaaagaacttattgagctccgagctctactccacgacaccgtttccttcaatcaaagcagcaaagagagtaattcttgtgcgtcacgggcaaagcacgtggaatgaagaaggacggatccaaggcagctctgatttctccgttttgactaagaaaggcgaggctcaagccgagacctctcgtcaaatgctcatcgatgattccttcgatgtttgcttctccagtcctttgattcggtcgaaaagaacggcggagatcatatggggatcgcgaaaggtgaacatgattacggattctgatctgagagaaattgatctttattcatttcaagggttattgaagcatgaggggaaggagaagttcggagcagcgtttaggcaatggcaagttgatgcttcgaattttaatattgatggccattttcctgtgagggagttgtgggggcgggcgaggaattgctggaataaaattcttgcacatgaaagtaggtctgttcttgtggttgctcataacgctgttaatcaggctcttgttgctacagctattggattagggacggagtattttaggattttgcttcagagtaattgtggtgtgagtgtgctggatttcgccccacgagttgatgggggagatggatctccttatatttgtcttaatcgtttaaatcagacacccaattcacctgttgctgctggaagttctgcaggcagaaaaaccagtaagcggatcatactcgtttctcatggaactacacagggtggtacagaggctaccttttcaaattctgggaatcagccaatgagcatgcttggaattatacagtcccagaaaactgcagaactgcttcttgatctgaatgtgagcaccatagtcagcagtcctaagaatgctagtgttgagatggcaacgactatctccagagtgcaagaagctgcagattgcttgggtgctgactgtgtgccgcggtgtgtagagatgaaacagatccaggaacttgatgatgcaactgaggttccaccacttcagcctggattcttaaatagatttgaggatgaagcactatcagcactgtgggaacagtctgggaaagcctggcaatctctgttaaatgaattgtctgatgaatccaagtccgaaaagattgtggttgcagttggtgatcctgccattcacattgcattaatggggcactgcctaaatctgaccgaagactggatgggattattccatctcgacgccgggagcattagtgtcctggactttcctgatggacctactggtagagggactatccgaggaaagagacatagggcttctttgcttgtgaggttagtttgcacctgcgtccactccatcatggtagagctggagaaatccaaaaacaagctacaggaggatgcaaatgctaggggaagtgcgtgcaacatgttgctgcgtgtggacgactcctgtgttattcagatagtgcatgcgaggttgtctaacaatcaaacaccgcttttcagggtggcatttagaagatttcaacgcccttcacgtgatgagcctattttagactataaagtcatcgataaaattgttactgacagacttaccgacagaccacaaattatcgaagagagtttttttaacgaatcatttctacccgtgagcctggcaggaaaattcatactgacggattgcaagtgtccgggtcagcttgcacgcacctcgactaatcccactgctcctgaagttaacgaccatgtcaataatttgaagtcaccaacttcatgcgactcgttaagtaagagttag

SEQ ID NO: 2522 - protein, 649 aa, Populus balsamifera subsp. trichocarpa
  misc_feature (1)..(649): Ceres ANNOT ID no. 1488335
  misc_feature (293)..(345): Pfam Name: PGAM Pfam Description: Phosphoglycerate mutase family
  misc_feature: SWISSPROT Homolog: GPMB_SALTI Probable phosphoglycerate mutase gpmB (EC 5.4.2.1) (Phosphoglyceromutase) (PGAM) with e-value of 4.8e-18 and BLAST sequence identity of 34.2
  misc_feature: SWISSPROT Homolog: GPMB_SALTY Probable phosphoglycerate mutase gpmB (EC 5.4.2.1) (Phosphoglyceromutase) (PGAM) with e-value of 1.7e-17 and BLAST sequence identity of 34.2
  misc_feature: SWISSPROT Homolog: GPMB_ECO57 Probable phosphoglycerate mutase gpmB (EC 5.4.2.1) (Phosphoglyceromutase) (PGAM) with e-value of 2.2e-17 and BLAST sequence identity of 34.0
  misc_feature: SWISSPROT Homolog: GPMB_ECOLI Probable phosphoglycerate mutase gpmB (EC 5.4.2.1) (Phosphoglyceromutase) (PGAM) with e-value of 2.2e-17 and BLAST sequence identity of 34.0
  misc_feature: SWISSPROT Homolog: GPMB_SHIFL Probable phosphoglycerate mutase gpmB (EC 5.4.2.1) (Phosphoglyceromutase) (PGAM) with e-value of 2.2e-17 and BLAST sequence identity of 34.0
  misc_feature 283953:<222: Transcription Factor
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: WHOLE PLANT - Other Useful for making bigger plants
  misc_feature: Phenotype: ROSETTE LEAVES - Serrate Margins Useful for making plants with increased biomass and foliage
  misc_feature (1)..(649): Functional Homolog of  Ceres CLONE ID no. 141830 at SEQ ID NO. 2564 with e-value of 3.00E-144 and BLAST sequence identity of 67.8
MLSVSPPPSLPLLHHHNRSLIHHGNHRLLFTVRSSSSSSIQEAVEEKTSNEKNLLSSELYSTTPFPSIKAAKRVILVRHGQSTWNEEGRIQGSSDFSVLTKKGEAQAETSRQMLIDDSFDVCFSSPLIRSKRTAEIIWGSRKVNMITDSDLREIDLYSFQGLLKHEGKEKFGAAFRQWQVDASNFNIDGHFPVRELWGRARNCWNKILAHESRSVLVVAHNAVNQALVATAIGLGTEYFRILLQSNCGVSVLDFAPRVDGGDGSPYICLNRLNQTPNSPVAAGSSAGRKTSKRIILVSHGTTQGGTEATFSNSGNQPMSMLGIIQSQKTAELLLDLNVSTIVSSPKNASVEMATTISRVQEAADCLGADCVPRCVEMKQIQELDDATEVPPLQPGFLNRFEDEALSALWEQSGKAWQSLLNELSDESKSEKIVVAVGDPAIHIALMGHCLNLTEDWMGLFHLDAGSISVLDFPDGPTGRGTIRGKRHRASLLVRLVCTCVHSIMVELEKSKNKLQEDANARGSACNMLLRVDDSCVIQIVHARLSNNQTPLFRVAFRRFQRPSRDEPILDYKVIDKIVTDRLTDRPQIIEESFFNESFLPVSLAGKFILTDCKCPGQLARTSTNPTAPEVNDHVNNLKSPTSCDSLSKS

SEQ ID NO: 2523 - protein, 343 aa, Arabidopsis thaliana
  misc_feature (1)..(343): Ceres CLONE ID no. 141890
  misc_feature (297)..(337): Pfam Name: zf-C3HC4 Pfam Description: Zinc finger, C3HC4 type (RING finger)
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
MNTRYSNQPELSSSNITITISSSALLSSSPRGDNSHVAAANGQERSPSSFYIRLAMKVSRARWFIFLRRVFHYQNGSRSDLGSNPFNSSTWMMSELIALLVQLTVITFTLAISKEERPIWPVRLWITGYDVGCLLNLMLLYGRYRQLDINQGNGFVLGDVEQQQRGREETRSSHLMNKCRTSLELFFAIWFVIGNVWVFDSRFGSFHHAPKLHVLCVSLLAWNAICYSFPFLLFLFLCCLVPLISSLLGYNMNMGSSDRAASDDQISSLPSWKFKRIDDSASDSDSDSATVTDDPECCICLAKYKDKEEVRKLPCSHKFHSKCVDQWLRIISCCPLCKQDLPR

SEQ ID NO: 2524 - DNA, 1017 bp, Populus balsamifera subsp. trichocarpa
  misc_feature (1)..(1017): Ceres ANNOT ID no. 1494533
  misc_feature 284238:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
atgaatacgcggtacccctttccaatgaattcattctgtggttcaagtcctgtagcatctccagcaggagaagagcatggaactgtgtctctcagaaacaggtctgctcgcactcccacttcgtcattattggtaagaacagcgatgagaatatctagagcaagatggttcaccttcttgagaagagtattccactaccagaatggctcaaggtctaatcttgggtctaatcctttcaactccagcccttggatgatgctggagtttgtagctttggtcattcaaataagtattacgatgttcaccctggctatttccaaggcagagaagccagtttggcctgtgagaatatggattattggctataatattggttgtgtccttagtctgctgctgctctatgggcgataccggcaaattaacacgactcaagccgatggttttggcctacctgatttggaacaacagaggggcagtgaggaatccaggtgctcaattttgatgcacaagtgccggacttcactcgagctcttctttgcaatatggtttgtgatgggtaatgtttgggtctttgattctcgctttggatcctaccaccgtgctccaaaactccatgtgctatgcatctctctacttgcctggaatgctctcagttactccttcccatttctcttgtttctactcttatgttgttgtgtgccactcattagcactgtccttggttacaacatgaacatggggtctgccgagagaggggcatccgacgatcaaatctccagtctaccaagttggaggtacaaagcagctgacactaactcggagtttcgcaataatgctgattgcaattcaaccattgcaagtgaagatctggaatgttgtatctgcctagccaagtataaagacaaagaagaagttaggaaattgccatgttcccatatgttccacctcaagtgtgtagatcaatggcttcgaattatatcctgctgccctctctgtaaacaaggattggagagatag

SEQ ID NO: 2525 - protein, 330 aa, Populus balsamifera subsp. trichocarpa
  misc_feature (1)..(330): Ceres ANNOT ID no. 1494533
  misc_feature (284)..(324): Pfam Name: zf-C3HC4 Pfam Description: Zinc finger, C3HC4 type (RING finger)
  misc_feature: SWISSPROT Homolog: ATL2M_ARATH RING-H2 finger protein ATL2M with e-value of 1.4e-11 and BLAST sequence identity of 37.5
  misc_feature: SWISSPROT Homolog: RNF13_MOUSE RING finger protein 13 with e-value of 2.5e-11 and BLAST sequence identity of 33.3
  misc_feature: SWISSPROT Homolog: ATL2A_ARATH RING-H2 finger protein ATL2A (RING-H2 zinc finger protein RHA3a) with e-value of 6.4e-11 and BLAST sequence identity of 38.6
  misc_feature: SWISSPROT Homolog: RNF13_CHICK RING finger protein 13 (C-RZF) with e-value of 1.2e-10 and BLAST sequence identity of 32.6
  misc_feature: SWISSPROT Homolog: RNF13_HUMAN RING finger protein 13 with e-value of 1.6e-10 and BLAST sequence identity of 32.6
  misc_feature 284354:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature (1)..(330): Functional Homolog of  Ceres CLONE ID no. 141890 at SEQ ID NO. 2567 with e-value of 6.40E-126 and BLAST sequence identity of 71.1
MNSFCGSSPVASPAGEEHGTVSLRNRSARTPTSSLLVRTAMRISRARWFTFLRRVFHYQNGSRSNLGSNPFNSSPWMMLEFVALVIQISITMFTLAISKAEKPVWPVRIWIIGYNIGCVLSLLLLYGRYRQINTTQADGFGLPDLEQQRGSEESRCSILMHKCRTSLELFFAIWFVMGNVWVFDSRFGSYHRAPKLHVLCISLLAWNALSYSFPFLLFLLLCCCVPLISTVLGYNMNMGSAERGASDDQISSLPSWRYKAADTNSEFRNNADCNSTIASEDLECCICLAKYKDKEEVRKLPCSHMFHLKCVDQWLRIISCCPLCKQGLER

SEQ ID NO: 2526 - DNA, 1032 bp, Populus balsamifera subsp. trichocarpa
  misc_feature (1)..(1032): Ceres ANNOT ID no. 1466313
  misc_feature 284464:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
atgaatacgcggtactcctttccaacagattcattccgtagttcaagtcctgcagtatcactttcatcaaattctccagtaggagaagagcatggaactgcgtttctcagaaacaggtctcctcgccttgccccgtcatcattattcgtaagagcagcgatgagaatatctagagcaagatggttcaccttcttgaggagagtattccactaccagaatggctcaagctctaatcttgggtctaatcctttcaattctagctcttggatgatgctggagttcgtagctttgctccttcaaatatgcattaccacgttcaccctggctatttcgaaggcagagaaccctgtttggcctgtgagaatatggattattggttataatataggttgtgtccttagtctgctgctgctctatggtcgttaccggcaacttaacgcaactcaaggcgatggttttggcctacccgatttggagcaacaggggggcagtgaggaatccaggtactcacatttgatgaacaagtgccggacctcactggaactcttctttgcgatatggtttgtgatgggtaatgtttgggtcttcgattctcgttttggatcttacttccgtgctccaaaactccatgtgctctgcatctctctgcttgcctggaatgctctcagttactcgtttccatttctgttgtttctactgctatgctgttgtgtgccgctcattagcactgtcattggctacaacatgagcatggggtctgccgagagaggggcgtccgatgaccaaatatccagactaccaagccggaggtacaaagctgtggacaccgattcggagtttcgcaacagtgttgattgtgattcaaccgttgcaagtgaagatctggaatgctgtatatgcctagccaagtataaagacatagaagaagttaggcaattgccatgctcccatatgtttcacctcaagtgtgtagatcaatggcttcgaattatatcctgctgccctctctgtaaacaagaactggaaaaatag

SEQ ID NO: 2527 - protein, 343 aa, Populus balsamifera subsp. trichocarpa
  misc_feature (1)..(343): Ceres ANNOT ID no. 1466313
  misc_feature (297)..(337): Pfam Name: zf-C3HC4 Pfam Description: Zinc finger, C3HC4 type (RING finger)
  misc_feature: SWISSPROT Homolog: ATL2M_ARATH RING-H2 finger protein ATL2M with e-value of 1.4e-11 and BLAST sequence identity of 37.5
  misc_feature: SWISSPROT Homolog: RNF13_MOUSE RING finger protein 13 with e-value of 2.5e-11 and BLAST sequence identity of 33.3
  misc_feature: SWISSPROT Homolog: ATL2A_ARATH RING-H2 finger protein ATL2A (RING-H2 zinc finger protein RHA3a) with e-value of 6.4e-11 and BLAST sequence identity of 38.6
  misc_feature: SWISSPROT Homolog: RNF13_CHICK RING finger protein 13 (C-RZF) with e-value of 1.2e-10 and BLAST sequence identity of 32.6
  misc_feature: SWISSPROT Homolog: RNF13_HUMAN RING finger protein 13 with e-value of 1.6e-10 and BLAST sequence identity of 32.6
  misc_feature 284582:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature (1)..(343): Functional Homolog of  Ceres CLONE ID no. 141890 at SEQ ID NO. 2567 with e-value of 1.69E-125 and BLAST sequence identity of 69.1
MNTRYSFPTDSFRSSSPAVSLSSNSPVGEEHGTAFLRNRSPRLAPSSLFVRAAMRISRARWFTFLRRVFHYQNGSSSNLGSNPFNSSSWMMLEFVALLLQICITTFTLAISKAENPVWPVRIWIIGYNIGCVLSLLLLYGRYRQLNATQGDGFGLPDLEQQGGSEESRYSHLMNKCRTSLELFFAIWFVMGNVWVFDSRFGSYFRAPKLHVLCISLLAWNALSYSFPFLLFLLLCCCVPLISTVIGYNMSMGSAERGASDDQISRLPSRRYKAVDTDSEFRNSVDCDSTVASEDLECCICLAKYKDIEEVRQLPCSHMFHLKCVDQWLRIISCCPLCKQELEK

SEQ ID NO: 2528 - protein, 99 aa, Arabidopsis thaliana
  misc_feature (1)..(99): Ceres CLONE ID no. 147358
  misc_feature (9)..(82): Pfam Name: LSM Pfam Description: LSM domain
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: ROSETTE LEAVES - Trident Shaped Useful for making plants with increased biomass and foliage
MSGRKETVLDLAKFVDKGVQVKLTGGRQVTGTLKGYDQLLNLVLDEAVEFVRDHDDPLKTTDQTRRLGLIVCRGTAVMLVSPTDGTEEIANPFVTAEAV

SEQ ID NO: 2529 - DNA, 300 bp, Populus balsamifera subsp. trichocarpa; identical to SEQ ID NO: 2109
  misc_feature (1)..(300): Ceres ANNOT ID no. 1493111
  misc_feature 284821:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: ROSETTE LEAVES - Trident Shaped Useful for making plants with increased biomass and foliage

SEQ ID NO: 2530 - protein, 99 aa, Populus balsamifera subsp. trichocarpa; identical to SEQ ID NO: 2110
  misc_feature (1)..(99): Ceres ANNOT ID no. 1493111
  misc_feature (9)..(82): Pfam Name: LSM Pfam Description: LSM domain
  misc_feature: SWISSPROT Homolog: LSM7_HUMAN U6 snRNA-associated Sm-like protein LSm7 with e-value of 1.1e-26 and BLAST sequence identity of 57.1
  misc_feature: SWISSPROT Homolog: LSM7_MOUSE U6 snRNA-associated Sm-like protein LSm7 with e-value of 1.5e-26 and BLAST sequence identity of 58.2
  misc_feature: SWISSPROT Homolog: LSM7_YEAST U6 snRNA-associated Sm-like protein LSm3 with e-value of 6.4e-17 and BLAST sequence identity of 47.1
  misc_feature: SWISSPROT Homolog: RUXG_ARATH Probable small nuclear ribonucleoprotein G (snRNP-G) Sm protein G (Sm-G) (SmG) with e-value of 2.4e-10 and BLAST sequence identity of 45.1
  misc_feature: SWISSPROT Homolog: RUXG_HUMAN Small nuclear ribonucleoprotein G (snRNP-G) (Sm protein G) (Sm-G) (SmG) with e-value of 3.9e-10 and BLAST sequence identity of 39.4
  misc_feature 284978:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: ROSETTE LEAVES - Trident Shaped Useful for making plants with increased biomass and foliage
  misc_feature (1)..(99): Functional Homolog of  Ceres CLONE ID no. 147358 at SEQ ID NO. 2572 with e-value of 6.69E-44 and BLAST sequence identity of 96.8

SEQ ID NO: 2531 - DNA, 285 bp, Populus balsamifera subsp. trichocarpa
  misc_feature (1)..(285): Ceres ANNOT ID no. 1461452
  misc_feature 285109:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: ROSETTE LEAVES - Trident Shaped Useful for making plants with increased biomass and foliage
atgggtgtgaaacagatatatgagaatgagattgtggatatcgaattaatggcaaatttttggtcaacaatgactgggactttgaagggatacgatcaattgctaaaccttgtcctggatgaagcagtagaatttctaagagatgctgatgatccactaaagaccactgaccagacaaggcgccttggcctgattgtttgcaggggaactgcagtgatgctggtgtcaccaactgatggtacggatgagattgccaacccttttgtccagccagatggggcctag

SEQ ID NO: 2532 - protein, 71 aa, Populus balsamifera subsp. trichocarpa
  misc_feature (1)..(71): Ceres ANNOT ID no. 1461452
  misc_feature (1)..(54): Pfam Name: LSM Pfam Description: LSM domain
  misc_feature: SWISSPROT Homolog: LSM7_HUMAN U6 snRNA-associated Sm-like protein LSm7 with e-value of 1.1e-26 and BLAST sequence identity of 57.1
  misc_feature: SWISSPROT Homolog: LSM7_MOUSE U6 snRNA-associated Sm-like protein LSm7 with e-value of 1.5e-26 and BLAST sequence identity of 58.2
  misc_feature: SWISSPROT Homolog: LSM7_YEAST U6 snRNA-associated Sm-like protein LSm3 with e-value of 6.4e-17 and BLAST sequence identity of 47.1
  misc_feature: SWISSPROT Homolog: RUXG_ARATH Probable small nuclear ribonucleoprotein G (snRNP-G) Sm protein G (Sm-G) (SmG) with e-value of 2.4e-10 and BLAST sequence identity of 45.1
  misc_feature: SWISSPROT Homolog: RUXG_HUMAN Small nuclear ribonucleoprotein G (snRNP-G) (Sm protein G) (Sm-G) (SmG) with e-value of 3.9e-10 and BLAST sequence identity of 39.4
  misc_feature 285264:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
  misc_feature: Phenotype: INFLORESCENCE - Weak Useful for making stronger plants
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: ROSETTE LEAVES - Trident Shaped Useful for making plants with increased biomass and foliage
  misc_feature (1)..(71): Functional Homolog of  Ceres CLONE ID no. 147358 at SEQ ID NO. 2572 with e-value of 5.89E-29 and BLAST sequence identity of 93.9
MTGTLKGYDQLLNLVLDEAVEFLRDADDPLKTTDQTRRLGLIVCRGTAVMLVSPTDGTDEIANPFVQPDGA

SEQ ID NO: 2533 - protein, 72 aa, Arabidopsis thaliana
  misc_feature (1)..(72): Ceres CLONE ID no. 147593
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: WHOLE PLANT - Other Useful for making bigger plants
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
MEVVERKTEMAEEGCTTPRSTMYRIPVASVCPPPPRKKLMVVRKRDPPRNGYFQPPDLETLFYAQPRREASA

SEQ ID NO: 2534 - DNA, 180 bp, Populus balsamifera subsp. trichocarpa
  misc_feature (1)..(180): Ceres ANNOT ID no. 1475653
  misc_feature 285468:<222: Transcription Factor
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: WHOLE PLANT - Other Useful for making bigger plants
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
atgaaggtggaagaagagtgtacgactccgaagagcgtgggatgtcggattccgactgcccttgtttgtccaccacctcccaagaagaagtcggtggttggaaagaaacgagacccaccaaaagacgggtattttcaaccgcctgagcttgatgctctgctttctattttcacgtcatag

SEQ ID NO: 2535 - protein, 59 aa, Populus balsamifera subsp. trichocarpa
  misc_feature (1)..(59): Ceres ANNOT ID no. 1475653
  misc_feature 285543:<222: Transcription Factor
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: WHOLE PLANT - Other Useful for making bigger plants
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
  misc_feature (1)..(59): Functional Homolog of  Ceres CLONE ID no. 147593 at SEQ ID NO. 2577 with e-value of 2.20E-15 and BLAST sequence identity of 66.0
MKVEEECTTPKSVGCRIPTALVCPPPPKKKSVVGKKRDPPKDGYFQPPELDALLSIFTS

SEQ ID NO: 2536 - DNA, 201 bp, Populus balsamifera subsp. trichocarpa
  misc_feature (1)..(201): Ceres ANNOT ID no. 1458131
  misc_feature 285630:<222: Transcription Factor
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: WHOLE PLANT - Other Useful for making bigger plants
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
atggaagttgatgaaggatgcaggacgccaagacgcagcgaatatcagataccggcacctttggtgtgcccgccaccaccaaagaagaaacccttttatgttaagcaaagaagggtccctccaaaggaaggatactttcagcctcctgatcttgagggagtcttaatggatattgcaccaagaagggaagcttgtgcttga

SEQ ID NO: 2537 - protein, 66 aa, Populus balsamifera subsp. trichocarpa
  misc_feature (1)..(66): Ceres ANNOT ID no. 1458131
  misc_feature 285705:<222: Transcription Factor
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: WHOLE PLANT - Other Useful for making bigger plants
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
  misc_feature (1)..(66): Functional Homolog of  Ceres CLONE ID no. 147593 at SEQ ID NO. 2577 with e-value of 2.70E-15 and BLAST sequence identity of 60.6
MEVDEGCRTPRRSEYQIPAPLVCPPPPKKKPFYVKQRRVPPKEGYFQPPDLEGVLMDIAPRREACA

SEQ ID NO: 2538 - DNA, 201 bp, Populus balsamifera subsp. trichocarpa
  misc_feature (1)..(201): Ceres ANNOT ID no. 1461780
  misc_feature 285795:<222: Transcription Factor
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: WHOLE PLANT - Other Useful for making bigger plants
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
atgaagagagaagggtcatttgaaaggatggtggtggtggtggaggagaatgacgggtgttctacaccaaaacaccggcggataccagagccagtggtgtgtccaccgccaccaaagaagaagccctttaagttttggaaaaagagggacccacccaaggacggctatttcaaccctcctgaacttgagcagcttctttaa

SEQ ID NO: 2539 - protein, 66 aa, Populus balsamifera subsp. trichocarpa
  misc_feature (1)..(66): Ceres ANNOT ID no. 1461780
  misc_feature 285870:<222: Transcription Factor
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Short Useful for modulating plant height
  misc_feature: Phenotype: WHOLE PLANT - Other Useful for making bigger plants
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
  misc_feature (1)..(66): Functional Homolog of  Ceres CLONE ID no. 147593 at SEQ ID NO. 2577 with e-value of 1.09E-11 and BLAST sequence identity of 58.1
MKREGSFERMVVVVEENDGCSTPKHRRIPEPVVCPPPPKKKPFKFWKKRDPPKDGYFNPPELEQLL

SEQ ID NO: 2540 - protein, 190 aa, Arabidopsis thaliana
  misc_feature (1)..(190): Ceres CLONE ID no. 148680
  misc_feature (15)..(172): Pfam Name: Peptidase_C15 Pfam Description: Pyroglutamyl peptidase
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: INFLORESCENCE - Strong Useful for making stronger plants
  misc_feature: Phenotype: INFLORESCENCE - Short Useful for modulating plant height
MANNLKEYLAKNCVSKDVNLGSCTVLETAGQGALASLYQLLQSAVNTKESESLTGKTIWVHFGVNSGATKFAIEQQAVNEATFRCPDELGWKPQNLPIVPSDGPISTVRKTNLPVEEITKALEKNGFEVITSDDAGRFVCNYVYYHSLRFAEQNKTRSLFVHVPLFVAVDEETQMRFTVSLLEVLASICK

SEQ ID NO: 2541 - DNA, 660 bp, Populus balsamifera subsp. trichocarpa
  misc_feature (1)..(660): Ceres ANNOT ID no. 1522509
  misc_feature 286045:<222: Transcription Factor
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: INFLORESCENCE - Strong Useful for making stronger plants
  misc_feature: Phenotype: INFLORESCENCE - Short Useful for modulating plant height
atggggtctgaaggacttccagctgtaacaatccatgtgacaggattcaagaaattccatggagtagctgaaaacccaactgagacaattgttagtaatctaaaagagtacatgaagaagaagggcatgccaaaaggtgtggtcctgggtagttgcaatgttcttgaggctgcaggacaaggcggagtttctccactttaccagacatttcaatctgccataaactcaaaggattatgaatcttcaagtcctggaagaattatttggctacacttcggggtcaatagtggggcaacaagatttgccattgagcatcaagctgtcaatgaagctacttttcgctgtccggatgagatgggatggaaaccacagaaagtacccatcattccttcagatggtggaatttcacgagttcgagagactactcttcctgttgaggagatcacaaagtccttggcaaagaaaggttatgaggtgatgacatccgatgatgcaggccgatttgtgtgcaactatgtttactaccattcccttcggtttgcagagcaaaatgggacaaagtctctctttgtgcatgtacctcttttcttgaccatagacgaggagactcagatgcaatttgctgcttccttgttggaggtacttgcttctttgtattag

SEQ ID NO: 2542 - protein, 219 aa, Populus balsamifera subsp. trichocarpa
  misc_feature (1)..(219): Ceres ANNOT ID no. 1522509
  misc_feature (11)..(220): Pfam Name: Peptidase_C15 Pfam Description: Pyroglutamyl peptidase
  misc_feature: SWISSPROT Homolog: PCP_PYRFU (Pyroglutamyl-peptidase I) (PGP-I) (Pyrase) with e-value of 2.3e-12 and BLAST sequence identity of 37.6
  misc_feature: SWISSPROT Homolog: PCP1_THETN Pyrrolidone-carboxylate peptidase 1 with e-value of 7.8e-12 and BLAST sequence identity of 31.7
  misc_feature: SWISSPROT Homolog: PCP1_THETN EC 3.4.19.3 (5-oxoprolyl-peptidase 1) ( Pyroglutamyl-peptidase I 1) (PGP-I 1) (Pyrase 1)
  misc_feature: SWISSPROT Homolog: PCP_PSEFL (Pyroglutamyl-peptidase I) (PGP-I) (Pyrase) with e-value of 7.8e-12 and BLAST sequence identity of 31.7
  misc_feature: SWISSPROT Homolog: PCP_VIBVU (Pyroglutamyl-peptidase I) (PGP-I) (Pyrase) with e-value of 3.4e-11 and BLAST sequence identity of 30.5
  misc_feature: SWISSPROT Homolog: PCP_VIBVY (Pyroglutamyl-peptidase I) (PGP-I) (Pyrase) with e-value of 3.4e-11 and BLAST sequence identity of 30.5
  misc_feature 286168:<222: Transcription Factor
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: INFLORESCENCE - Strong Useful for making stronger plants
  misc_feature: Phenotype: INFLORESCENCE - Short Useful for modulating plant height
  misc_feature (1)..(219): Functional Homolog of  Ceres CLONE ID no. 148680 at SEQ ID NO. 2584 with e-value of 7.10E-72 and BLAST sequence identity of 72.3
MGSEGLPAVTIHVTGFKKFHGVAENPTETIVSNLKEYMKKKGMPKGVVLGSCNVLEAAGQGGVSPLYQTFQSAINSKDYESSSPGRIIWLHFGVNSGATRFAIEHQAVNEATFRCPDEMGWKPQKVPIIPSDGGISRVRETTLPVEEITKSLAKKGYEVMTSDDAGRFVCNYVYYHSLRFAEQNGTKSLFVHVPLFLTIDEETQMQFAASLLEVLASLY

SEQ ID NO: 2543 - protein, 286 aa, Arabidopsis thaliana
  misc_feature (1)..(286): Ceres CLONE ID no. 148943
  misc_feature (2)..(284): Pfam Name: Aldo_ket_red Pfam Description: Aldo/keto reductase family
  misc_feature: Phenotype: ROSETTE LEAVES - Curled 1 Useful for making ornamental plants with altered leaf shape
  misc_feature: Phenotype: ROSETTE LEAVES - Curled 5 Useful for making ornamental plants with altered leaf shape
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MGPLSVSPMGFGTWAWGNQLLWGYQTSMDDQLQQAFELALENGINLFDTADSYGTGRLNGQSERLLGKFIKESQGLKGKQNEVVVATKFAAYPWRLTSGQFVNACRASLDRLQIDQLGIGQLHWSTANYAPLQELVLWDGLVQMYEKGLVRAVGVSNYGPQQLVKIHDYLKTRGVPLCSAQVQFSLLSMGKEQLEIKSICDELGIRLISYSPLGLGMLTGKYSSSKLPTGPRSLLFRQILPGLEPLLLALSEIAKKRGKTMPQVAINWCICKGTVPIPGIKSVRHV

SEQ ID NO: 2544 - DNA, 1101 bp, Populus balsamifera subsp. trichocarpa
  misc_feature (1)..(1101): Ceres ANNOT ID no. 1472949
  misc_feature 286381:<222: Transcription Factor
  misc_feature: Phenotype: ROSETTE LEAVES - Curled 1 Useful for making ornamental plants with altered leaf shape
  misc_feature: Phenotype: ROSETTE LEAVES - Curled 5 Useful for making ornamental plants with altered leaf shape
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atggcaatctcaatttccacaccaacagcctatttcagctgttttaactcttcaaaccaaccttcccttccatctttgcctttcaagccactcaaactccctccattctggccttggcagaaggtgaagatgggcccacttactgtctctccaatgggttttggaacatgggcttggggcaaccagcttttatgggggtaccaagaatcaatggacactgatcttcaacaaacttttaacttggctgttgagaatggcatcaatctttttgacactgctgattcttatgggactggcaggttaaatggccaaagtgaaaagcttcttggcaagtttatacaagaatttccaggaaaacagatgcgaaatgacattgtgattgctacaaagtttgcagcatacccgtggcgtctgacaccggggctgtttgtgaaagcttgcaaggcgtcgttggaaaggctgcaagttgagcagataggcataggtcaattacactggtctactgcaaactatgctcctccacaagagttagctctctgggatggtttagttgcaatgtatgagcagggtttagttcgtgctgttggagtgagcaattatggcccaaagcagctcataaagatccatgattaccttaaagcccgtggagtgcccctttgctcagcacaggtacaattttctttgctaagcatgggagaagatcagatggagatcaagaaggtttgtgattctctgggaatccggttgattgcttatagtcctttaggactcggaatgcttaccgggaaatatacatcgtccagacttccacttgggcctcgggccttcttattcaggcaaattcttccaggactggaacctttgttgaattccctaggagaaattgcacagagaaggggtaaaactctgtcacaggttgctataaactggtgcatctgcaaaggtgctattccaattcctggaatcaagacagtaaaacaagctgaggaaaacttgggtgcccttggttggcgcttgagttcagacgagttgcttcaattggaatatgcagcaagtgagtctcctcagaaaatgatccaaaacatttttcagacaaggtaa

SEQ ID NO: 2545 - protein, 366 aa, Populus balsamifera subsp. trichocarpa
  misc_feature (1)..(366): Ceres ANNOT ID no. 1472949
  misc_feature (42)..(352): Pfam Name: Aldo_ket_red Pfam Description: Aldo/keto reductase family
  misc_feature: SWISSPROT Homolog: KCAB2_BOVIN Voltage-gated potassium channel beta-2 subunit (K (+) channel beta-2 subunit) (Kv-beta-2) with e-value of 7.5e-23 and BLAST sequence identity of 28.4
  misc_feature: SWISSPROT Homolog: KCAB2_HUMAN Voltage-gated potassium channel beta-2 subunit (K (+) channel beta-2 subunit) (Kv-beta-2) (HKvbeta2) with e-value of 7.5e-23 and BLAST sequence identity of 28.4
  misc_feature: SWISSPROT Homolog: KCAB2_XENLA Voltage-gated potassium channel beta-2 subunit (K (+) channel beta-2 subunit) (Kv-beta-2) with e-value of 2.0e-22 and BLAST sequence identity of 28.1
  misc_feature: SWISSPROT Homolog: KCAB1_CHICK Voltage-gated potassium channel beta-1 subunit (K (+) channel beta-1 subunit) (Kv-beta-1) with e-value of 2.3e-22 and BLAST sequence identity of 27.0
  misc_feature: SWISSPROT Homolog: KCAB2_MOUSE Voltage-gated potassium channel beta-2 subunit (K (+) channel beta-2 subunit) (Kv-beta-2) (Neuroimmune protein F5) with e-value of 2.5e-22 and BLAST sequence identity of 28.4
  misc_feature 286525:<222: Transcription Factor
  misc_feature: Phenotype: ROSETTE LEAVES - Curled 1 Useful for making ornamental plants with altered leaf shape
  misc_feature: Phenotype: ROSETTE LEAVES - Curled 5 Useful for making ornamental plants with altered leaf shape
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(366): Functional Homolog of  Ceres CLONE ID no. 148943 at SEQ ID NO. 2587 with e-value of 5.59E-127 and BLAST sequence identity of 80.5
MAISISTPTAYFSCFNSSNQPSLPSLPFKPLKLPPFWPWQKVKMGPLTVSPMGFGTWAWGNQLLWGYQESMDTDLQQTFNLAVENGINLFDTADSYGTGRLNGQSEKLLGKFIQEFPGKQMRNDIVIATKFAAYPWRLTPGLFVKACKASLERLQVEQIGIGQLHWSTANYAPPQELALWDGLVAMYEQGLVRAVGVSNYGPKQLIKIHDYLKARGVPLCSAQVQFSLLSMGEDQMEIKKVCDSLGIRLIAYSPLGLGMLTGKYTSSRLPLGPRAFLFRQILPGLEPLLNSLGEIAQRRGKTLSQVAINWCICKGAIPIPGIKTVKQAEENLGALGWRLSSDELLQLEYAASESPQKMIQNIFQTR

SEQ ID NO: 2546 - protein, 513 aa, Arabidopsis thaliana
  misc_feature (1)..(513): Ceres CLONE ID no. 149380
  misc_feature (42)..(503): Pfam Name: p450 Pfam Description: Cytochrome P450
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: INFLORESCENCE - Weak Useful for making stronger plants
MTTTEFQSCFIFLLLCLFSLVCYSLFFRKPSSRRDAHGCDLPPSPPSLPVIGHLHLILSSLVHKSFQKISSNYGPLLHLRIFNVPIVLVSSASVAYDIFRVHDLNVSSRGSPPFEESLLFGSTGFISAPYGDYFKFMKKHLVTKLLGPQALERSRLIRTNELERFYINLLDKATKKESVEIGKEAMKLSNNSICKMIMGTSCLEEKGEAERVRGLIIESFYLTKKFFLAFTLRGLLEKLGISLFKKEIMGVSRRFDDLLERYLREHEEKPDNEHQDTDMIDALLAAYRDEKAEYKITRNQIKAFLVDIFIAGTDISALTTQGTMAEIINNPNIFVRIREEIDSVVGKSRLIQETDLPKLPYLQAVVKEGLRLHPPTPLMVREFQEGCKVKGFYIPASTTLVVNGYAVMRDPNVWEDPEEFKPERFLASSRLMQEDEIREQALKYIAFGSGRRGCPGANVAYIFVGTAIGMIVQCFDWRINGEKVDMKEAIGGLNLTLAHPLKCTPVARFPKPF

SEQ ID NO: 2547 - DNA, 1539 bp, Populus balsamifera subsp. trichocarpa
  misc_feature (1)..(1539): Ceres ANNOT ID no. 1461440
  misc_feature 286817:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: INFLORESCENCE - Weak Useful for making stronger plants
atgactgtcattcaatattttcttgccttctttgtcctctggtttatcacaatcttccttcaatacatcttcaagagaaccggcaagaaacctgccggctattgcccccctccaagcccccccacacttcctttgatcggccacctccatttactaacccctgtagcatacaaaggattccatgctctcaacaataaatatggccctctcctctatctccgtttggtcacatatcctgctgttcttgtctcatcagctccggtggctacagaaatcttcagagcacaagatgtccattttgcctctagaataaaatccccctttgaggataatttactatttggaagctcaacaagctttttcaatgccccgtatggggattactggaaattcatgaagaaaatttgcatgacagaattgttggggaccagccagatgaagaagttaaagaatcttagacgcgaagaagttgtgaggtttttgagtaaaatgttggagatgggtaaaaaaaatgagggtgcagatttgagtgctgaggtattaacactagcaaacaatagtacttgcaggatgattatgagtgctaggtgttcaggggaagataatcaggctgataagtgtagagagctggtgagtgaatccttcgatctggctgcaaagcttgctgtatgtaacttgttcggtcccttgaaaaggataggtatctggttcttgagaaagaaaattgctgacgtgcctagaaggtatgatgaattgtttgaaaacgtcatggtagagcatgaggagaaagcaaagagagaaggtcctcacttggagaataaagacctgatggatattcttttggaggtgtatcatgataaaaatgctgaaatgaggataaccaggaagcaaatgaagactttctttctggatctcttcaccggaggtaccagtactacagcagatgccatactatggattttaggggagcttgtcaaccatcctgcagcgttcaagaagctgagagaggagatagattcagttgttgggacagagagacttgtggacgaagcagatatcccaaacctgccttatttccaagcgtgcgtgaaggaagcaatgagactacatccaccagtgcctttattcgatagagtatgccgtgaagactgcaaacttgcaggatatgatatacccaaaggaatcacaatgataatgaacgcatactctatcatgagggatccaaagatatgggacaacccaaatgatttcattccagagaggttcttgaaagaagaagaaaacactaagggccaaaacctacaggtttacgtcccttttggcgggggaaggagaatgtgccctgggaccaacatgtcctcaagtttgatcaatggtagtgttacagctatggttcaatgttttgattggaaggttgttggtggagatggcccagatggatcaaaagttaacatggacactaaagctggtgtgactatgagcttggataaaccattcttgtccaaccctgttctccaccgcaacctgttttctgcttaa

SEQ ID NO: 2548 - protein, 512 aa, Populus balsamifera subsp. trichocarpa
  misc_feature (1)..(512): Ceres ANNOT ID no. 1461440
  misc_feature (37)..(478): Pfam Name: p450 Pfam Description: Cytochrome P450
  misc_feature: SWISSPROT Homolog: C93A3_SOYBN Cytochrome P450 93A3 (EC 1.14.-.-) (P450 CP5) with e-value of 7.0e-98 and BLAST sequence identity of 40.3
  misc_feature: SWISSPROT Homolog: C93A1_SOYBN Cytochrome P450 93A1 (EC 1.14.-.-) with e-value of 1.7e-96 and BLAST sequence identity of 40.0
  misc_feature: SWISSPROT Homolog: C93A2_SOYBN Cytochrome P450 93A2 (EC 1.14.-.-) with e-value of 3.6e-94 and BLAST sequence identity of 40.2
  misc_feature: SWISSPROT Homolog: C93B1_GLYEC Cytochrome P450 93B1 (EC 1.14.13.87) (Licodione synthase) ( (2S)-flavanone 2-hydroxylase) (Flavone synthase II) (CYP GE-5) with e-value of 4.1e-77 and BLAST sequence identity of 35.7
  misc_feature: SWISSPROT Homolog: C71A9_SOYBN Cytochrome P450 71A9 (EC 1.14.-.-) (P450 CP1) with e-value of 2.6e-75 and BLAST sequence identity of 37.6
  misc_feature 286968:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: INFLORESCENCE - Weak Useful for making stronger plants
  misc_feature (1)..(512): Functional Homolog of  Ceres CLONE ID no. 149380 at SEQ ID NO. 2590 with e-value of 1.30E-109 and BLAST sequence identity of 44.5
MTVIQYFLAFFVLWFITIFLQYIFKRTGKKPAGYCPPPSPPTLPLIGHLHLLTPVAYKGFHALNNKYGPLLYLRLVTYPAVLVSSAPVATEIFRAQDVHFASRIKSPFEDNLLFGSSTSFFNAPYGDYWKFMKKICMTELLGTSQMKKLKNLRREEVVRFLSKMLEMGKKNEGADLSAEVLTLANNSTCRMIMSARCSGEDNQADKCRELVSESFDLAAKLAVCNLFGPLKRIGIWFLRKKIADVPRRYDELFENVMVEHEEKAKREGPHLENKDLMDILLEVYHDKNAEMRITRKQMKTFFLDLFTGGTSTTADAILWILGELVNHPAAFKKLREEIDSVVGTERLVDEADIPNLPYFQACVKEAMRLHPPVPLFDRVCREDCKLAGYDIPKGITMIMNAYSIMRDPKIWDNPNDFIPERFLKEEENTKGQNLQVYVPFGGGRRMCPGTNMSSSLINGSVTAMVQCFDWKVVGGDGPDGSKVNMDTKAGVTMSLDKPFLSNPVLHRNLFSA

SEQ ID NO: 2549 - DNA, 1539 bp, Populus balsamifera subsp. trichocarpa
  misc_feature (1)..(1539): Ceres ANNOT ID no. 1461430
  misc_feature 287128:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: INFLORESCENCE - Weak Useful for making stronger plants
atgactgccattcaatatgttcttgccatctttatcctcttgtttatcacagtcttccttcaattcatcttcaagaggcccggcaagaaacctgccggttattgcccccctccaagcccacccacacttcctttgatcggccacctccatttattaaccccagttgcatacaaaggattccatgctctcaacaataaatatggccctctcctctatctccgcttggccacttatcctgctgttcttgtctcatccgctccactggccacagaaatcttcaaagcactagatgtccattttacctctagaataaaatccccttttgaggataatttactatttggaagctcaacaagctttttcaatgccccgtatggggattactggaaattcatgaagaaaatttgtaccacagaattgttggggactagacagatgaagaagttaaagaatgttagacgcgaagaagttgtgaggtttttgagtaaaatgttggagataggtcagaaacatgaggttgcaaatgtgagtgctgaggtattaacactagcaaacaatagtacttgcaggatgattatgagtgctaggtgttcaggggaagataatcaggctgagaagtgtagagggctggtgggtgaatcctttgatctggcagcaaagcttgctttatttagcgtgtttggtcccttgaaaaggataggtatatggtacttaagaaagaaaattgccgacgtgccccgaaggtatgatgaattgtttgagaacgtcttggtagagcatgaggagaaagcgaagagagaaggtcctcacatggagaataaagacttgatggatattcttttggaagtgtatcacgataaaaatgctgaaataaggataaccaggaagcaaatgaagactttctttctggatcttttcacaggaggtaccaatactacatcagatgccatactgtggatcttagcagagcttgtcaaccatcctgccgcgttcaagaagctgagagaggagatagattcagctgttgggacagagagacttgtggatgaagaagatatcccaaacctgccttattttcaagcatgtgttaaggaagcaatgcgactaaatccaccagtgcctttatttgatagaatatgcggtgaaaattgcaaacttggaggatatgatatacccaaaggaatcacaatgataatgaacgcatactctattatgagggatccaaagatatttgaaaaccccaacgattttattccagagaggttcttgactgaacaggacaacgccaaggagcaaaacttacaggtttacgtcccttttggtggaggaaggagaatgtgccctgggaccaacatgacctcaagtttgattaactgtagtgttacagctatggttcagtgttttgattggaaagttctcagtggagatggaccagatggatcgaaggttaacatggactctaaatcaggcgtggtaaagagcatggataaaccatttgtggccattcctgttctccacagtaacctgttttctgcttaa

SEQ ID NO: 2550 - protein, 512 aa, Populus balsamifera subsp. trichocarpa
  misc_feature (1)..(512): Ceres ANNOT ID no. 1461430
  misc_feature (37)..(478): Pfam Name: p450 Pfam Description: Cytochrome P450
  misc_feature: SWISSPROT Homolog: C93A3_SOYBN Cytochrome P450 93A3 (EC 1.14.-.-) (P450 CP5) with e-value of 7.0e-98 and BLAST sequence identity of 40.3
  misc_feature: SWISSPROT Homolog: C93A1_SOYBN Cytochrome P450 93A1 (EC 1.14.-.-) with e-value of 1.7e-96 and BLAST sequence identity of 40.0
  misc_feature: SWISSPROT Homolog: C93A2_SOYBN Cytochrome P450 93A2 (EC 1.14.-.-) with e-value of 3.6e-94 and BLAST sequence identity of 40.2
  misc_feature: SWISSPROT Homolog: C93B1_GLYEC Cytochrome P450 93B1 (EC 1.14.13.87) (Licodione synthase) ( (2S)-flavanone 2-hydroxylase) (Flavone synthase II) (CYP GE-5) with e-value of 4.1e-77 and BLAST sequence identity of 35.7
  misc_feature: SWISSPROT Homolog: C71A9_SOYBN Cytochrome P450 71A9 (EC 1.14.-.-) (P450 CP1) with e-value of 2.6e-75 and BLAST sequence identity of 37.6
  misc_feature 287279:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: INFLORESCENCE - Weak Useful for making stronger plants
  misc_feature (1)..(512): Functional Homolog of  Ceres CLONE ID no. 149380 at SEQ ID NO. 2590 with e-value of 7.39E-109 and BLAST sequence identity of 45.2
MTAIQYVLAIFILLFITVFLQFIFKRPGKKPAGYCPPPSPPTLPLIGHLHLLTPVAYKGFHALNNKYGPLLYLRLATYPAVLVSSAPLATEIFKALDVHFTSRIKSPFEDNLLFGSSTSFFNAPYGDYWKFMKKICTTELLGTRQMKKLKNVRREEVVRFLSKMLEIGQKHEVANVSAEVLTLANNSTCRMIMSARCSGEDNQAEKCRGLVGESFDLAAKLALFSVFGPLKRIGIWYLRKKIADVPRRYDELFENVLVEHEEKAKREGPHMENKDLMDILLEVYHDKNAEIRITRKQMKTFFLDLFTGGTNTTSDAILWILAELVNHPAAFKKLREEIDSAVGTERLVDEEDIPNLPYFQACVKEAMRLNPPVPLFDRICGENCKLGGYDIPKGITMIMNAYSIMRDPKIFENPNDFIPERFLTEQDNAKEQNLQVYVPFGGGRRMCPGTNMTSSLINCSVTAMVQCFDWKVLSGDGPDGSKVNMDSKSGVVKSMDKPFVAIPVLHSNLFSA

SEQ ID NO: 2551 - DNA, 1539 bp, Populus balsamifera subsp. trichocarpa
  misc_feature (1)..(1539): Ceres ANNOT ID no. 1461427
  misc_feature 287439:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: INFLORESCENCE - Weak Useful for making stronger plants
atgatcgccatccaatatgtcctagccatctttgtactatgggttatcacagtcttccttcaattcatcttcaagaggcccggcaagaaacctgccggttattgcccccctccaagcccacccacacttcctttgatcggccacctccatttattaaccccagttgcatacaaaggattccatgctctcaacaataaatatggccctctcctctatctccgcttggccacttatcctgctgttcttgtctcatccgctccactggccacagaaatcttcaaagcactagatgtccattttacctctagaataaaatccccttttgaggataatttactatttggaagctcaacaagctttttcaatgccccgtatggggattactggaaattcatgaagaaaatttgtaccacagaattgttggggactagacagatgaagaagttaaagaatgttagacgcgaagaagttgtgaggtttttgagtaaaatgttggagataggtcagaaacatgaggttgcaaatgtgagtgctgaggtattaacactagcaaacaatagtacttgcaggatgattatgagtgctaggtgttcaggggaagataatcaggctgagaagtgtagagggctggtgagtgaatcctttgatctggctgcaaagcttgctttatttagcgtgtttggtcccttgaaaaggataggtacttggtacttaagaaagaaaattgccgacgtgccccgaaggtatgatgaattgtttgagaacgtcctggtagagcatgaggagaaagcgaagagagaaggtcctcacatggagaataaagacttgatggatattcttttggaagtgtatcatgacaaaaatgctgaaataaggataaccaggaagcaaatgaagactttctttctggatcttttcacaggaggtaccaatactacatcagatgccatactgtggatcttagcagagcttgtcaaccatcctgcagcgttcaagaagctgagagaggagatagattcagctgttgggacagagagacttgtggatgaagaagatatcccaaacctgccttattttcaagcatgtgttaaggaagcaatgaggctaaatccaccagtgcctttatttgatagaatatgcggtgaaaattgcaaacttggaggatatgatatacccaaaggaatcacaatgataatgaacgcatactctattatgagggatccaaagatatgggaaaaccccaacgattttattccagagaggttcttgactgaacaggacaacgccgaggggcaaaacttacaggtttacgtcccttttggtggaggaaggagaatgtgccctgggaccaacatgacctcaagtttgattaactgtagtgttacagctatggttcagtgttttgattggaaagttctcggtggagatggaccagatggatcgaaggttaacatggactccaaatcaggcgtggtaaagagcatggataaaccatttgtggccattcctgttctccgcagaaacctgttttctgcttaa

SEQ ID NO: 2552 - protein, 512 aa, Populus balsamifera subsp. trichocarpa
  misc_feature (1)..(512): Ceres ANNOT ID no. 1461427
  misc_feature (37)..(503): Pfam Name: p450 Pfam Description: Cytochrome P450
  misc_feature: SWISSPROT Homolog: C93A3_SOYBN Cytochrome P450 93A3 (EC 1.14.-.-) (P450 CP5) with e-value of 7.0e-98 and BLAST sequence identity of 40.3
  misc_feature: SWISSPROT Homolog: C93A1_SOYBN Cytochrome P450 93A1 (EC 1.14.-.-) with e-value of 1.7e-96 and BLAST sequence identity of 40.0
  misc_feature: SWISSPROT Homolog: C93A2_SOYBN Cytochrome P450 93A2 (EC 1.14.-.-) with e-value of 3.6e-94 and BLAST sequence identity of 40.2
  misc_feature: SWISSPROT Homolog: C93B1_GLYEC Cytochrome P450 93B1 (EC 1.14.13.87) (Licodione synthase) ( (2S)-flavanone 2-hydroxylase) (Flavone synthase II) (CYP GE-5) with e-value of 4.1e-77 and BLAST sequence identity of 35.7
  misc_feature: SWISSPROT Homolog: C71A9_SOYBN Cytochrome P450 71A9 (EC 1.14.-.-) (P450 CP1) with e-value of 2.6e-75 and BLAST sequence identity of 37.6
  misc_feature 287590:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: INFLORESCENCE - Weak Useful for making stronger plants
  misc_feature (1)..(512): Functional Homolog of  Ceres CLONE ID no. 149380 at SEQ ID NO. 2590 with e-value of 3.20E-108 and BLAST sequence identity of 44.0
MIAIQYVLAIFVLWVITVFLQFIFKRPGKKPAGYCPPPSPPTLPLIGHLHLLTPVAYKGFHALNNKYGPLLYLRLATYPAVLVSSAPLATEIFKALDVHFTSRIKSPFEDNLLFGSSTSFFNAPYGDYWKFMKKICTTELLGTRQMKKLKNVRREEVVRFLSKMLEIGQKHEVANVSAEVLTLANNSTCRMIMSARCSGEDNQAEKCRGLVSESFDLAAKLALFSVFGPLKRIGTWYLRKKIADVPRRYDELFENVLVEHEEKAKREGPHMENKDLMDILLEVYHDKNAEIRITRKQMKTFFLDLFTGGTNTTSDAILWILAELVNHPAAFKKLREEIDSAVGTERLVDEEDIPNLPYFQACVKEAMRLNPPVPLFDRICGENCKLGGYDIPKGITMIMNAYSIMRDPKIWENPNDFIPERFLTEQDNAEGQNLQVYVPFGGGRRMCPGTNMTSSLINCSVTAMVQCFDWKVLGGDGPDGSKVNMDSKSGVVKSMDKPFVAIPVLRRNLFSA

SEQ ID NO: 2553 - DNA, 1551 bp, Populus balsamifera subsp. trichocarpa
  misc_feature (1)..(1551): Ceres ANNOT ID no. 1440253
  misc_feature 287750:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: INFLORESCENCE - Weak Useful for making stronger plants
atggctgccatgactgccattcaatatgtcattgccctctttgtcctctggtttatcaccgtctttcttcaatacattttcaagagacccggcaagaaacctgccggttattgcccccctccaagcccaccaacacttcctttgatcggtcacctccatttactaaccccagtagcatacaaaggcttccatgctctcaacaacaaatatggccctctcctctatctccgtttggccacgtatcctgctgttcttgtctcatcagctccagtggccactgagatcttcaaggcacaagatgtccattttgcctctagaataaaatccccctttgaggataatttactatttggaagctcaacaagctttttcaatgccccatatggggattactggaaattcatgaagaagatttgcatgacagaattgttggggagcagccagatgaagaagttaaagaatgttaggcatgaagaagttgtgagatttttgtctaaaatgttggagataggtcaaaaaaatgatgttgcagatttgagtgctgaggtattaacactagcaaacaatgctacttgcaggatgatcatgagtgctaggtgttcgggggaagataatcaggctgatcagtgtagagggctggtgagtgaatcctttgatctggctgcaaagcttgctgtatgtaacttgtttggtcccttgaaaaggataggtacttggtacttaagaaagaaaattgctgctgtgcccaaaaggtatgatgaattgtttgagaacatcttggtagagcatgaggaaaaagcaaagagaggaggtccacacatggagaataaagacttgatggatattctcttggaagtttatcatgataaaaatgctgaaatgaggataaccaggaagcaaatgaagactttctttctggatcttttcactggaggtacgagtactacagcagatgccgtactatggatcttaggggagcttgtcaaccatcctgcatcattcaagaagctgagagaggagatagattcagttgtcgggacagagagacttgcagatgaagcagatatcccaaatatgccttattttcaagcatgtgtgaaggaggcaatgagactacatccaccagtgcctttatttgatagagtatgccgtgaagattgcaaacttgcaggacatgacatccccaaaggaattacaatgataatgaatgcatactctatcatgagggatccaaagatatgggataaccccaacgacttcattccagagaggttcttgacagaacatgacagcaccaaggggccgcaaaacctacagatttacgtcccttttggcgggggaaggagaatgtgccctgggactaacatgtcctcaagtttgatcaattgcagtgtttcagctatggttcaatgttttgattggaaggtggtcggaggagatggcccagatggatcaaaagttaacatggacactaaagcaggtgtgactatgagcctggataaaccattcatgtccactcctgttctccaccgcaatttattttctgcctga

SEQ ID NO: 2554 - protein, 513 aa, Populus balsamifera subsp. trichocarpa
  misc_feature (1)..(513): Ceres ANNOT ID no. 1440253
  misc_feature (37)..(504): Pfam Name: p450 Pfam Description: Cytochrome P450
  misc_feature: SWISSPROT Homolog: C93A3_SOYBN Cytochrome P450 93A3 (EC 1.14.-.-) (P450 CP5) with e-value of 7.0e-98 and BLAST sequence identity of 40.3
  misc_feature: SWISSPROT Homolog: C93A1_SOYBN Cytochrome P450 93A1 (EC 1.14.-.-) with e-value of 1.7e-96 and BLAST sequence identity of 40.0
  misc_feature: SWISSPROT Homolog: C93A2_SOYBN Cytochrome P450 93A2 (EC 1.14.-.-) with e-value of 3.6e-94 and BLAST sequence identity of 40.2
  misc_feature: SWISSPROT Homolog: C93B1_GLYEC Cytochrome P450 93B1 (EC 1.14.13.87) (Licodione synthase) ( (2S)-flavanone 2-hydroxylase) (Flavone synthase II) (CYP GE-5) with e-value of 4.1e-77 and BLAST sequence identity of 35.7
  misc_feature: SWISSPROT Homolog: C71A9_SOYBN Cytochrome P450 71A9 (EC 1.14.-.-) (P450 CP1) with e-value of 2.6e-75 and BLAST sequence identity of 37.6
  misc_feature 287901:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature: Phenotype: INFLORESCENCE - Weak Useful for making stronger plants
  misc_feature (1)..(513): Functional Homolog of  Ceres CLONE ID no. 149380 at SEQ ID NO. 2590 with e-value of 4.69E-107 and BLAST sequence identity of 44.2
MTAIQYVIALFVLWFITVFLQYIFKRPGKKPAGYCPPPSPPTLPLIGHLHLLTPVAYKGFHALNNKYGPLLYLRLATYPAVLVSSAPVATEIFKAQDVHFASRIKSPFEDNLLFGSSTSFFNAPYGDYWKFMKKICMTELLGSSQMKKLKNVRHEEVVRFLSKMLEIGQKNDVADLSAEVLTLANNATCRMIMSARCSGEDNQADQCRGLVSESFDLAAKLAVCNLFGPLKRIGTWYLRKKIAAVPKRYDELFENILVEHEEKAKRGGPHMENKDLMDILLEVYHDKNAEMRITRKQMKTFFLDLFTGGTSTTADAVLWILGELVNHPASFKKLREEIDSVVGTERLADEADIPNMPYFQACVKEAMRLHPPVPLFDRVCREDCKLAGHDIPKGITMIMNAYSIMRDPKIWDNPNDFIPERFLTEHDSTKGPQNLQIYVPFGGGRRMCPGTNMSSSLINCSVSAMVQCFDWKVVGGDGPDGSKVNMDTKAGVTMSLDKPFMSTPVLHRNLFSA

SEQ ID NO: 2555 - protein, 317 aa, Arabidopsis thaliana
  misc_feature (1)..(317): Ceres CLONE ID no. 150912
  misc_feature (6)..(136): Pfam Name: Mov34 Pfam Description: Mov34/MPN/PAD-1 family
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Other Useful for making ornamental plants with modified leaves
MAPSSSSGLTFKLHPLVIVNISDHYTRVKTQLNPPASICASGHGSNNGEAMFQQNPRVYGCVIGVQRGRTVEIFNSFELLYDPSTQTLDRSFLEKKQELYKKVFPDFYILGWYSTGSDAEESDMHIHKALMDINESPVYVLLNPAINHTQKDLPVTIYESELHVIDGIPQLIFAHTSYTIETVEAERISVDHVAHLKPSDGGSAATQLAAHLTGIHSAIKMLNSRIRVLYQNLAAMQKGDKSCDNSVLRQVSSLLRRLPAMESERFQDNFLMEYNDKLLITYLAMITNCSSNMNEMVDKFNTAYDRNTRRGGRTAFM

SEQ ID NO: 2556 - DNA, 954 bp, Populus balsamifera subsp. trichocarpa
  misc_feature (1)..(954): Ceres ANNOT ID no. 1533910
  misc_feature 288192:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Other Useful for making ornamental plants with modified leaves
atggcgtcttcgtctagcagcggactgactttcaagctacacccgctcgtaatagtcaacatatccgatcactacactcgtgtcaagtctcagaccaacggctgcagcgatggaggctctgcttccccccctcccagagtatacggttgcgtgattggagtacagagaggacgcaccgtcgagatcttcaacagcttcgagcttctttacgatcccgtcactcactccctcgaccgcgctttcatcgaaaagaagcaagaactctataagaaggtattcccacacttttacatattgggatggtactctactggaagcgatgctgaggaatctgatatgcatattcataaagctctgatggatattaatgaaagccctgtttatgttctgctcaatccctctatcaatcctgctcaaaaggatttgcctgttactatttacgagagtgagctgcatgtcatcgatggaattccacagcttatttttgtttgttcaagttacaccattgagacggtggaagctgaacggatctcagttgatcatgttgctcatcttaagccatccgatggaggttctgcagctacacaattggctgctcaccttacaggcatacatagtgctataaagatgttgaatagcagaatcagggtgcttcatcactaccttgtcgcaatgcagaaaggtgaaattccttgtgagaactcattgctgagacaagtatcaagtcttttaaggagattgccagccattgaatcagaaaaatttcaagatgatttcttgatgaatggtttttcagttgatttgttctggttgtatctttcatccttgatttttaacacagcattttccctcttttcctcccctttctccagcacgatgaatgagctagtggacaaattcaacactgcctatgacaggcacagtcgaaggggtggacgaactgctttcatctga

SEQ ID NO: 2557 - protein, 317 aa, Populus balsamifera subsp. trichocarpa
  misc_feature (1)..(317): Ceres ANNOT ID no. 1533910
  misc_feature (6)..(125): Pfam Name: Mov34 Pfam Description: Mov34/MPN/PAD-1 family
  misc_feature: SWISSPROT Homolog: CSN6A_ARATH COP9 signalosome complex subunit 6a (Signalosome subunit 6a) (AtCSN6a) with e-value of 7.1e-169 and BLAST sequence identity of 100.0
  misc_feature: SWISSPROT Homolog: CSN6B_ARATH COP9 signalosome complex subunit 6b (Signalosome subunit 6b) (AtCSN6b) with e-value of 7.3e-151 and BLAST sequence identity of 87.4
  misc_feature: SWISSPROT Homolog: CSN6_MOUSE COP9 signalosome complex subunit 6 (Signalosome subunit 6) (SGN6) (JAB1-containing signalosome subunit 6) with e-value of 1.7e-58 and BLAST sequence identity of 40.5
  misc_feature: SWISSPROT Homolog: CSN6_HUMAN COP9 signalosome complex subunit 6 (Signalosome subunit 6) (SGN6) with e-value of 2.2e-58 and BLAST sequence identity of 40.5
  misc_feature: SWISSPROT Homolog: CSN6_HUMAN JAB1-containing signalosome subunit 6 Vpr-interacting protein (hVIP) (MOV34 homolog)
  misc_feature: SWISSPROT Homolog: CSN6_XENLA COP9 signalosome complex subunit 6 (Signalosome subunit 6) with e-value of 1.6e-52 and BLAST sequence identity of 37.9
  misc_feature 288344:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Other Useful for making ornamental plants with modified leaves
  misc_feature (1)..(317): Functional Homolog of  Ceres CLONE ID no. 150912 at SEQ ID NO. 2602 with e-value of 7.39E-125 and BLAST sequence identity of 83.3
MASSSSSGLTFKLHPLVIVNISDHYTRVKSQTNGCSDGGSASPPPRVYGCVIGVQRGRTVEIFNSFELLYDPVTHSLDRAFIEKKQELYKKVFPHFYILGWYSTGSDAEESDMHIHKALMDINESPVYVLLNPSINPAQKDLPVTIYESELHVIDGIPQLIFVCSSYTIETVEAERISVDHVAHLKPSDGGSAATQLAAHLTGIHSAIKMLNSRIRVLHHYLVAMQKGEIPCENSLLRQVSSLLRRLPAIESEKFQDDFLMNGFSVDLFWLYLSSLIFNTAFSLFSSPFSSTMNELVDKFNTAYDRHSRRGGRTAFI

SEQ ID NO: 2558 - DNA, 873 bp, Populus balsamifera subsp. trichocarpa
  misc_feature (1)..(873): Ceres ANNOT ID no. 1480439
  misc_feature 288479:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Other Useful for making ornamental plants with modified leaves
atggcgtcttcgtctagcagcggactgactttcaagctacacccgctcgtaatagtcaacatatccgatcactacactcgtgtcaagtctcagaccaacggctgcagcgatggaggctctgcttccccccctcccagagtatacggttgcgtgattggagtacagagaggacgcaccgtcgagatcttcaacagcttcgagcttctttacgatcccgtcactcactccctcgaccgcgctttcatcgaaaagaagcaagaactctataagaaggtattcccacacttttacatattgggatggtactctactggaagcgatgctgaggaatctgatatgcatattcataaagctctgatggatattaatgaaagccctgtttatgttctgctcaatccctctatcaatcctgctcaaaaggatttgcctgttactatttacgagagtgagctgcatgtcatcgatggaattccacagcttatttttgtttgttcaagttacaccattgagacggtggaagctgaacggatctcagttgatcatgttgctcatcttaagccatccgatggaggttctgcagctacacaattggctgctcaccttacaggcatacatagtgctataaagatgttgaatagcagaatcagggtgcttcatcactaccttgtcgcaatgcagaaaggtgaaattccttgtgagaactcattgctgagacaagtatcaagtcttttaaggagattgccagccattgaatcagaaaaatttcaagatgatttcttgatggaatacaatgacacgctattgatcgcctacttagccatgttcaccaactgctcaaggtatgatatatgggtgttcttttgtgtgatataa

SEQ ID NO: 2559 - protein, 290 aa, Populus balsamifera subsp. trichocarpa
  misc_feature (1)..(290): Ceres ANNOT ID no. 1480439
  misc_feature (6)..(125): Pfam Name: Mov34 Pfam Description: Mov34/MPN/PAD-1 family
  misc_feature: SWISSPROT Homolog: CSN6A_ARATH COP9 signalosome complex subunit 6a (Signalosome subunit 6a) (AtCSN6a) with e-value of 7.1e-169 and BLAST sequence identity of 100.0
  misc_feature: SWISSPROT Homolog: CSN6B_ARATH COP9 signalosome complex subunit 6b (Signalosome subunit 6b) (AtCSN6b) with e-value of 7.3e-151 and BLAST sequence identity of 87.4
  misc_feature: SWISSPROT Homolog: CSN6_MOUSE COP9 signalosome complex subunit 6 (Signalosome subunit 6) (SGN6) (JAB1-containing signalosome subunit 6) with e-value of 1.7e-58 and BLAST sequence identity of 40.5
  misc_feature: SWISSPROT Homolog: CSN6_HUMAN COP9 signalosome complex subunit 6 (Signalosome subunit 6) (SGN6) with e-value of 2.2e-58 and BLAST sequence identity of 40.5
  misc_feature: SWISSPROT Homolog: CSN6_HUMAN JAB1-containing signalosome subunit 6 Vpr-interacting protein (hVIP) (MOV34 homolog)
  misc_feature: SWISSPROT Homolog: CSN6_XENLA COP9 signalosome complex subunit 6 (Signalosome subunit 6) with e-value of 1.6e-52 and BLAST sequence identity of 37.9
  misc_feature 288629:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Other Useful for making ornamental plants with modified leaves
  misc_feature (1)..(290): Functional Homolog of  Ceres CLONE ID no. 150912 at SEQ ID NO. 2602 with e-value of 2.60E-122 and BLAST sequence identity of 86.7
MASSSSSGLTFKLHPLVIVNISDHYTRVKSQTNGCSDGGSASPPPRVYGCVIGVQRGRTVEIFNSFELLYDPVTHSLDRAFIEKKQELYKKVFPHFYILGWYSTGSDAEESDMHIHKALMDINESPVYVLLNPSINPAQKDLPVTIYESELHVIDGIPQLIFVCSSYTIETVEAERISVDHVAHLKPSDGGSAATQLAAHLTGIHSAIKMLNSRIRVLHHYLVAMQKGEIPCENSLLRQVSSLLRRLPAIESEKFQDDFLMEYNDTLLIAYLAMFTNCSRYDIWVFFCVI

SEQ ID NO: 2560 - protein, 399 aa, Arabidopsis thaliana
  misc_feature (1)..(399): Ceres CLONE ID no. 151087
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: ROSETTE LEAVES - Long Petioles Useful for making plants that grow better in shade
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MATLFNKFQQAVGVLAKSTTFAKNPRQLQFEADVNKLFMYTSYNRLGREAEETDAEEIIEMAGKATLSEQQKQVQENIHYQVEKFCSLMDGILLPDVRRNESGSQSTSPRPPRRSGLTFAIGSNNAFPHADQPLVPETKPLKLADVSQRLMDQMGYTLEIKPSVIPHKDAGQGCFIKGEADVGTVLAFYPGVIYSPAFYRYIPGYPKVDSQNSYLITRYDGTVINAQPWGLGGESREAWNGSYTPAVKTNTKTAENGSDRLWKALSKPLEGSGKGKEVLERRNPLAFGHLANHPAKEMTPNVMICPYDFPLMAKDLRPYIPNISFGDSGEIKMKRFGSFWFKTGSKDGLEAPVLKTLVLVATRSLCNEELLLNYRLSNSKRRPDWYTPVNEEEDRRRWS

SEQ ID NO: 2561 - DNA, 1224 bp, Populus balsamifera subsp. trichocarpa
  misc_feature (1)..(1224): Ceres ANNOT ID no. 1504145
  misc_feature 288886:<222: Transcription Factor
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: ROSETTE LEAVES - Long Petioles Useful for making plants that grow better in shade
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atggcttctctttttaacaaatttcaagagtttgtgaaaactctagccaaaagtcccacatttgctagaaatccaagggagtttcaatttgaaacggacatgaatcgtctctttctttttaccagctacaatcgtttggggaaaaatgctgaggaggcagacgcggaggagatcattgaaatggccagtaaagcttctgttgctgatcagcagaaacaggttcaagaaaatatccactttcaaattacaaacttctgctcagctatgaatgaaattcttcttcccgatttggaaaaaagaagcaagaaggatgaagctcctgcacaatcaaatgctgctcctcggcgtagtggccttagttttgctgttggcaagagtggtccacctattgaccgtcctggtgagtttataacagctatacctgagacgaagcagttaagtcgtagcaaagtatcacagagtttaagggatgaaattggttacacacttgatctcaagccatctctgataccccacaaggaagctggagaaggtttgtttttaagtggtgaggctgatgtgggcactgtgattgccatataccctggtgtcatatacagccctgcttattaccggtatatcccagggtacccaagagttgatgcccagaacccatatttgatcactagatatgatgggactgtgatcaatgccctgccttggggttctgggggtgaaagtcgcgaagtgtgggatggcttaactgtgccagaaatcaggtctaatgtgcaaagtgttgagaaaggtcaagaccgggtctggagaatgctgagtaaacctttggaaggtacacgagttggttctattggtgatgtcttggagcggagaaacccattagcattggctcattttgctaaccacccagcgaagggtatggatccaaatgttatgatttgcccctatgacttcccactgactgagaaggatatgaggacctttataccaaacgtatcttttggaaatcatgaagaagtgaatatgagaagatttggcagtttttggttcaaatctagtgccaaaaatagcgtatctgatgttcctgttctcaagactctggttttagttgccactagggcgctttgtaatgaagaggtgctcctgaactacaggttgagcaacacaaaacgtcgaccagcatggtatagtccggtggatgaagaggaagaccggaggagatggagctaa

SEQ ID NO: 2562 - protein, 407 aa, Populus balsamifera subsp. trichocarpa
  misc_feature (1)..(407): Ceres ANNOT ID no. 1504145
  misc_feature 288981:<222: Transcription Factor
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: ROSETTE LEAVES - Long Petioles Useful for making plants that grow better in shade
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(407): Functional Homolog of  Ceres CLONE ID no. 151087 at SEQ ID NO. 2607 with e-value of 3.20E-147 and BLAST sequence identity of 67.5
MASLFNKFQEFVKTLAKSPTFARNPREFQFETDMNRLFLFTSYNRLGKNAEEADAEEIIEMASKASVADQQKQVQENIHFQITNFCSAMNEILLPDLEKRSKKDEAPAQSNAAPRRSGLSFAVGKSGPPIDRPGEFITAIPETKQLSRSKVSQSLRDEIGYTLDLKPSLIPHKEAGEGLFLSGEADVGTVIAIYPGVIYSPAYYRYIPGYPRVDAQNPYLITRYDGTVINALPWGSGGESREVWDGLTVPEIRSNVQSVEKGQDRVWRMLSKPLEGTRVGSIGDVLERRNPLALAHFANHPAKGMDPNVMICPYDFPLTEKDMRTFIPNVSFGNHEEVNMRRFGSFWFKSSAKNSVSDVPVLKTLVLVATRALCNEEVLLNYRLSNTKRRPAWYSPVDEEEDRRRWS

SEQ ID NO: 2563 - DNA, 1488 bp, Populus balsamifera subsp. trichocarpa
  misc_feature (1)..(1488): Ceres ANNOT ID no. 1451079
  misc_feature 289120:<222: Transcription Factor
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: ROSETTE LEAVES - Long Petioles Useful for making plants that grow better in shade
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atggaggagaaggggatgactaatgtcgaacaaacataccaaacaaacaaaagacagaaagaaaggaaagcccaagctgaaaagcctactcattggggttccggttaccaaagaaatttggcccagcatgtatggacacaacttcggcctgagattttttcattcaacaaggcagaaggcaagagtgcgagtgttcctcagttgctgctgcagtttcttcaatggcttctctttttaacaaatttcaagagatattgggtagattcagggtcatgtttattgacaaggatggagtttgtgaaaactctagccaaaagtcccacatttgctagaaatccaagggagtttcaatttgaaacggacatgaatcgtctctttctttttaccagctacaatcgtttggggaaaaatgctgaggaggcagacgcggaggagatcattgaaatggccagtaaagcttctgttgctgatcagcagaaacaggttcaagaaaatatccactttcaaattacaaacttctgctcagctatgaatgaaattcttcttcccgatttggaaaaaagaagcaagaaggatgaagctcctgcacaatcaaatgctgctcctcggcgtagtggccttagttttgctgttggcaagagtggtccacctattgaccgtcctggtgagtttataacagctatacctgagacgaagcagttaagtcgtagcaaagtatcacagagtttaagggatgaaattggttacacacttgatctcaagccatctctgataccccacaaggaagctggagaaggtttgtttttaagtggtgaggctgatgtgggcactgtgattgccatataccctggtgtcatatacagccctgcttattaccggtatatcccagggtacccaagagttgatgcccagaacccatatttgatcactagatatgatgggactgtgatcaatgccctgccttggggttctgggggtgaaagtcgcgaagtgtgggatggcttaactgtgccagaaatcaggtctaatgtgcaaagtgttgagaaaggtcaagaccgggtctggagaatgctgagtaaacctttggaaggtacacgagttggttctattggtgatgtcttggagcggagaaacccattagcattggctcattttgctaaccacccagcgaagggtatggatccaaatgttatgatttgcccctatgacttcccactgactgagaaggatatgaggacctttataccaaacgtatcttttggaaatcatgaagaagtgaatatgagaagatttggcagtttttggttcaaatctagtgccaaaaatagcgtatctgatgttcctgttctcaagactctggttttagttgccactagggcgctttgtaatgaagaggtgctcctgaactacaggttgagcaacacaaaacgtcgaccagcatggtatagtccggtggatgaagaggaagaccggaggagatggagctaa

SEQ ID NO: 2564 - protein, 399 aa, Populus balsamifera subsp. trichocarpa
  misc_feature (1)..(399): Ceres ANNOT ID no. 1451079
  misc_feature 289223:<222: Transcription Factor
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: ROSETTE LEAVES - Long Petioles Useful for making plants that grow better in shade
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(399): Functional Homolog of  Ceres CLONE ID no. 151087 at SEQ ID NO. 2607 with e-value of 9.09E-143 and BLAST sequence identity of 67.4
MEFVKTLAKSPTFARNPREFQFETDMNRLFLFTSYNRLGKNAEEADAEEIIEMASKASVADQQKQVQENIHFQITNFCSAMNEILLPDLEKRSKKDEAPAQSNAAPRRSGLSFAVGKSGPPIDRPGEFITAIPETKQLSRSKVSQSLRDEIGYTLDLKPSLIPHKEAGEGLFLSGEADVGTVIAIYPGVIYSPAYYRYIPGYPRVDAQNPYLITRYDGTVINALPWGSGGESREVWDGLTVPEIRSNVQSVEKGQDRVWRMLSKPLEGTRVGSIGDVLERRNPLALAHFANHPAKGMDPNVMICPYDFPLTEKDMRTFIPNVSFGNHEEVNMRRFGSFWFKSSAKNSVSDVPVLKTLVLVATRALCNEEVLLNYRLSNTKRRPAWYSPVDEEEDRRRWS

SEQ ID NO: 2565 - protein, 196 aa, Arabidopsis thaliana
  misc_feature (1)..(196): Ceres CLONE ID no. 152076
  misc_feature (57)..(137): Pfam Name: Ribosomal_L27 Pfam Description: Ribosomal L27 protein
  misc_feature: Phenotype: WHOLE PLANT - Small Useful for modulating plant size
  misc_feature: Phenotype: WHOLE PLANT - Other Useful for making bigger plants
MATSMSLNLIGAFKGLSLSSTSSFLRGELSFSPKTTFTVTLPLENLQAPVPLTIESAHKKGAGSTKNGRDSPGQRLGVKIYGDQVAKPGAIIVRQRGTKFHAGKNVGIGKDHTIFSLIDGLVKFEKFGPDRKKISVYPREIVPENPNSYRARKRENFRLQREKKKARRENYTYTLPTPELVLASASIDDAEANPEC

SEQ ID NO: 2566 - DNA, 567 bp, Populus balsamifera subsp. trichocarpa
  misc_feature (1)..(567): Ceres ANNOT ID no. 1493664
  misc_feature 289433:<222: Transcription Factor
  misc_feature: Phenotype: WHOLE PLANT - Small Useful for modulating plant size
  misc_feature: Phenotype: WHOLE PLANT - Other Useful for making bigger plants
atggcagtcagcttcaatctaattggttcattcaaaggcctttctttatcttcaagctcttcatcttccttcttcaaaggagatgttgggtcccttaaatttggtttgaaaagctctgctttgttgccgtttaaggctccggtgaaggctccattacccttgacgattcaaatggctcacaagaagggagctgggagtaccaagaacggccgtgattctaaaggcaaacggcttggtgtcaagatttatggtgaccaagcagctaaacctggcgcaattattgtaaggcagcgtgggaagaatgtggggattggcaaggatcacaccatcttttctttgattgatggattggtgaaatttgagaaatttgggcctgacagaaaaaagattagtgtgtacccaagagaaatccagcccgagaatcccaacagctatcgagcaagaaagagagagaacttcaggttgcagcgtgaacgcaaaaaggcaagaaaggaaggtatcgttgctcagccacagctagtacttgcctccaatgttgatgctgcagatagcaacccagtttgctga

SEQ ID NO: 2567 - protein, 188 aa, Populus balsamifera subsp. trichocarpa
  misc_feature (1)..(188): Ceres ANNOT ID no. 1493664
  misc_feature (59)..(133): Pfam Name: Ribosomal_L27 Pfam Description: Ribosomal L27 protein
  misc_feature: SWISSPROT Homolog: RK27_ARATH 50S ribosomal protein L27, with e-value of 8.7e-100 and BLAST sequence identity of 97.4
  misc_feature: SWISSPROT Homolog: RK27_TOBAC 50S ribosomal protein L27, (CL27) with e-value of 1.5e-65 and BLAST sequence identity of 77.4
  misc_feature: SWISSPROT Homolog: RK27_ORYSA 50S ribosomal protein L27, with e-value of 8.0e-58 and BLAST sequence identity of 63.2
  misc_feature: SWISSPROT Homolog: RL27_ANASP 50S ribosomal protein L27 with e-value of 4.3e-27 and BLAST sequence identity of 69.5
  misc_feature: SWISSPROT Homolog: RL27_CAMJE 50S ribosomal protein L27 with e-value of 1.9e-26 and BLAST sequence identity of 68.3
  misc_feature 289527:<222: Transcription Factor
  misc_feature: Phenotype: WHOLE PLANT - Small Useful for modulating plant size
  misc_feature: Phenotype: WHOLE PLANT - Other Useful for making bigger plants
  misc_feature (1)..(188): Functional Homolog of  Ceres CLONE ID no. 152076 at SEQ ID NO. 2612 with e-value of 3.90E-64 and BLAST sequence identity of 77.3
MAVSFNLIGSFKGLSLSSSSSSSFFKGDVGSLKFGLKSSALLPFKAPVKAPLPLTIQMAHKKGAGSTKNGRDSKGKRLGVKIYGDQAAKPGAIIVRQRGKNVGIGKDHTIFSLIDGLVKFEKFGPDRKKISVYPREIQPENPNSYRARKRENFRLQRERKKARKEGIVAQPQLVLASNVDAADSNPVC

SEQ ID NO: 2568 - protein, 404 aa, Arabidopsis thaliana
  misc_feature (1)..(404): Ceres CLONE ID no. 152141
  misc_feature (44)..(392): Pfam Name: Iso_dh Pfam Description: Isocitrate/isopropylmalate dehydrogenase
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
MAAALQTNIRTVKVPATFRAVSKQSLAPFRVRCAVASPGKKRYTITLLPGDGIGPEVVSIAKNVLQQAGSLEGVEFNFREMPIGGAALDLVGVPLPEETISAAKESDAVLLGAIGGYKWDNNEKHLRPEKGLLQIRAALKVFANLRPATVLPQLVDASTLKREVAEGVDLMVVRELTGGIYFGEPRGIKTNENGEEVGFNTEVYAHEIDRIARVAFETARKRRGKLCSVDKANVLEASILWRKRVTALASEYPDVELSHMYVDNAAMQLVRDPKQFDTIVTNNIFGDILSDEASMITGSIGMLPSASLSDSGPGLFEPIHGSAPDIAGQDKANPLATILSAAMLLKYGLGEEKAAKRIEDAVLVALNNGFRTGDIYSAGTKLVGCKEMGEEVLKSVDSQVPASV

SEQ ID NO: 2569 - DNA, 1224 bp, Populus balsamifera subsp. trichocarpa
  misc_feature (1)..(1224): Ceres ANNOT ID no. 1439403
  misc_feature 289723:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
atgattgcttctgcttcctctatgcagattaatgcgctgcatccaatcaaacccattttccttcttaaacctgcctccctgagaccaagcagaatcaggtgcgccgctgccaccaccaagcaatccaaacgctactccatcactcttctccctggcgatggcattggtcccgaagtcatctctgtcgctaaaaacgtactcaaccttgctgggtctcttgaagggattgaatttaactttcaagaaatgcctatgggtggatctgctttggatatggctggagttccattgccggacgaaacccttttggcagcgaagaaatctgacgcggttcttcttggagccattggagggtacaaatgggataaaaatgaaaaacatctgaagccagagactggattgcttcagcttagagaaggtcttgaggtctttgcgaatttgaggccagcaactgttttgccacagctagtggatgcttcaactttaaagaaagaggttgctgaaggtgttgatgtaatggttgtaagagagcttactggaggtatttattttgggaagccaaggggttttggcaccaatgaagatggtgaagagataggcttcaataccgaggtgtatgctacatacgaggttgatcgtattgcacgtgttgcatttgagactgctagaaagcgacatggaaaactttgctcagttgacaaagcaaatgtcttggaggcatcaatgttttggagaaaacgagtgatctctatagcggcagaatatcctgatgttgagctttcacacatgtatgttgataatgccgcaatgcagcttgtccgcaatccaaaacagtttgacacaatagtgacgaacaacatatttggcgatatactatctgatgaggcttcaatgattactggaagtattgggatgcttccatctgctagtcttggttcatcaggacctggactttttgaaccaatacatggttctgctcctgacattgctaaccaggataaggccaacccattggcaactgtcctgagtgctgcaatgcttttgaagtatggtctgggggaagaaaatgctgccaagagaattgagaatgcagtcttggataccctgaataagggttttcgaacgggtgatatttactcagctggaaataaattagtaggatgcaaggaaatgggtgaagaggtgctgaaatcagtagactcccaagttgctgctgctgtttga

SEQ ID NO: 2570 - protein, 407 aa, Populus balsamifera subsp. trichocarpa
  misc_feature (1)..(407): Ceres ANNOT ID no. 1439403
  misc_feature (46)..(395): Pfam Name: Iso_dh Pfam Description: Isocitrate/isopropylmalate dehydrogenase
  misc_feature: SWISSPROT Homolog: LEU32_ARATH A 3-isopropylmalate dehydrogenase 2, EC 1.1.1.85 (Beta-IPM dehydrogenase 2) (IMDH 2) (3-IPM-DH 2) with e-value of 1.0e-208 and BLAST sequence identity of 99.8
  misc_feature: SWISSPROT Homolog: LEU3_BRANA A 3-isopropylmalate dehydrogenase, EC 1.1.1.85 (Beta-IPM dehydrogenase) Beta-IPM dehydrogenase with e-value of 3.7e-195 and BLAST sequence identity of 92.6
  misc_feature: SWISSPROT Homolog: LEU33_ARATH A 3-isopropylmalate dehydrogenase 3, EC 1.1.1.85 (Beta-IPM dehydrogenase 3) (IMDH 3) (3-IPM-DH 3) with e-value of 1.2e-180 and BLAST sequence identity of 84.6
  misc_feature: SWISSPROT Homolog: LEU31_ARATH A 3-isopropylmalate dehydrogenase 1, EC 1.1.1.85 (Beta-IPM dehydrogenase 1) (IMDH 1) (3-IPM-DH 1) with e-value of 1.1e-179 and BLAST sequence identity of 84.9
  misc_feature: SWISSPROT Homolog: LEU3_SYNY3 3-isopropylmalate dehydrogenase (EC 1.1.1.85) Beta-IPM dehydrogenase (IMDH) (3-IPM-DH) with e-value of 1.1e-129 and BLAST sequence identity of 69.1
  misc_feature 289850:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature (1)..(407): Functional Homolog of  Ceres CLONE ID no. 152141 at SEQ ID NO. 2615 with e-value of 6.79E-170 and BLAST sequence identity of 81.5
MIASASSMQINALHPIKPIFLLKPASLRPSRIRCAAATTKQSKRYSITLLPGDGIGPEVISVAKNVLNLAGSLEGIEFNFQEMPMGGSALDMAGVPLPDETLLAAKKSDAVLLGAIGGYKWDKNEKHLKPETGLLQLREGLEVFANLRPATVLPQLVDASTLKKEVAEGVDVMVVRELTGGIYFGKPRGFGTNEDGEEIGFNTEVYATYEVDRIARVAFETARKRHGKLCSVDKANVLEASMFWRKRVISIAAEYPDVELSHMYVDNAAMQLVRNPKQFDTIVTNNIFGDILSDEASMITGSIGMLPSASLGSSGPGLFEPIHGSAPDIANQDKANPLATVLSAAMLLKYGLGEENAAKRIENAVLDTLNKGFRTGDIYSAGNKLVGCKEMGEEVLKSVDSQVAAAV

SEQ ID NO: 2571 - protein, 356 aa, Arabidopsis thaliana
  misc_feature (1)..(356): Ceres CLONE ID no. 152633
  misc_feature (1)..(356): Also Known As Ceres CDNA ID no. 23416843
  misc_feature (1)..(356): Also Known As Ceres GEMINI ID 554A10
  misc_feature (159)..(200): Pfam Name: zf-C3HC4 Pfam Description: Zinc finger, C3HC4 type (RING finger)
  misc_feature 289995:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MGSTGNPNPWGTTYDSYRDCSQGVCSVYCPQWCYVIFPPPPSFYLDDEDDSSSSDFSPLLIALIGILASAFILVSYYTLISKYCHRRRHNSSSTSAAAINRISSDYTWQGTNNNNNNGATNPNQTIGGGGGDGLDESLIKSITVYKYRKMDGFVESSDCSVCLSEFQENESLRLLPKCNHAFHVPCIDTWLKSHSNCPLCRAFIVTSSAVEIVDLTNQQIVTENNSISTGDDSVVVVNLDLENSRSRNETVNEGSTPKPPEMQDSRDGEERRSASLNSGGGVVSIADILREIEDDEESAGVGTSRWVEEGEGEKTPPPSGSAANQTNGISNFLVRSSMAAMKRSGYDRAKNYRLPK

SEQ ID NO: 2572 - DNA, 1050 bp, Populus balsamifera subsp. trichocarpa
  misc_feature (1)..(1050): Ceres ANNOT ID no. 1469954
  misc_feature 290090:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atgggttctactactggcaaccaaaatccttgggctccatatagtacctatagagattgttcacagggaatctgtagcatttattgtccacaacggtgttacatcattttcccacctccacctccttttactcttggtgatgatgattctaatactgatttgtctcctcttattatagcagttatcggtatcctggcaagtgctttcatcttggtaacatactatactctcatatccaagtattgtaggcggcggggccagggcgatggagccactgatttgaatgaaaaccatgatcagatggctagtgaagcatggcaaggtatccctgctggtggattagatgaggcacttgtaaagtctatcacagtatgcaagtacaagaaaggtgatggtttcgttgaaggcacagagtgctcagtttgtctgagtgagtttcaagaaaatgagagcttaaggctcttgccgaagtgtagccatgcatttcatctcccttgcattgatacatggctcaaatctcatgcaagttgtcctctatgccgtgccaatattgctcccgctaatatcttgcccagtgaagcaccagctgtacctgagccagtccaagaaaatctgccaagaactaatgtttcaacacttcaataccagcatgggactaatgatgctgttttagtgattcaagatttagaagggagtacttttcggcaagagggcgtcgttagtcttgttatcggtgatgatactcccaagactccggttaatcaagatcttgaaagttcgcagactggtacggaattacaaattagcgatccgatccaaccgcttagaaggtctgtttcatcgagtttttctcaaaaccacacatctattgctgatatattacgcactagtgaagatgatgatgagggtagtgatgattaccggaagaatggaggaggtgggatcttgggtttagttagaagtccatttggaatgaagagatccatttctacaggaagatttacgttcacaagctatgagaaaggtaggagttctatgattcccaattga

SEQ ID NO: 2573 - protein, 349 aa, Populus balsamifera subsp. trichocarpa
  misc_feature (1)..(349): Ceres ANNOT ID no. 1469954
  misc_feature (139)..(180): Pfam Name: zf-C3HC4 Pfam Description: Zinc finger, C3HC4 type (RING finger)
  misc_feature: SWISSPROT Homolog: ATL3A_ARATH RING-H2 finger protein ATL3A with e-value of 3.7e-195 and BLAST sequence identity of 100.0
  misc_feature: SWISSPROT Homolog: ATL5G_ARATH Probable RING-H2 finger protein ATL5G with e-value of 1.1e-74 and BLAST sequence identity of 52.1
  misc_feature: SWISSPROT Homolog: ATL4H_ARATH Putative RING-H2 finger protein ATL4H with e-value of 1.0e-48 and BLAST sequence identity of 40.9
  misc_feature: SWISSPROT Homolog: ATL1O_ARATH RING-H2 finger protein ATL1O (RING-H2 finger protein ATL11) with e-value of 5.3e-34 and BLAST sequence identity of 40.5
  misc_feature: SWISSPROT Homolog: ATL5K_ARATH RING-H2 finger protein ATL5K (RING-H2 finger protein ATL16) with e-value of 5.5e-27 and BLAST sequence identity of 34.1
  misc_feature 290195:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(349): Functional Homolog of  Ceres CLONE ID no. 152633 at SEQ ID NO. 2618 with e-value of 7.10E-72 and BLAST sequence identity of 61.1
MGSTTGNQNPWAPYSTYRDCSQGICSIYCPQRCYIIFPPPPPFTLGDDDSNTDLSPLIIAVIGILASAFILVTYYTLISKYCRRRGQGDGATDLNENHDQMASEAWQGIPAGGLDEALVKSITVCKYKKGDGFVEGTECSVCLSEFQENESLRLLPKCSHAFHLPCIDTWLKSHASCPLCRANIAPANILPSEAPAVPEPVQENLPRTNVSTLQYQHGTNDAVLVIQDLEGSTFRQEGVVSLVIGDDTPKTPVNQDLESSQTGTELQISDPIQPLRRSVSSSFSQNHTSIADILRTSEDDDEGSDDYRKNGGGGILGLVRSPFGMKRSISTGRFTFTSYEKGRSSMIPN

SEQ ID NO: 2574 - protein, 258 aa, Arabidopsis thaliana
  misc_feature (1)..(258): Ceres CLONE ID no. 153053
  misc_feature: Phenotype: WHOLE PLANT - Yellow-Green Viable 1 Useful for making lethal plants for genetic confinement systems
MSISMALFSPPISSSLQNPNLIPKISTSLLSTKRFSLISVPRASSDNGTTSPVVKIPKPASVAVEEVPVKSPAESSSASENGAVGGEATDSSTETVIKYQNAKWVNGTWDLKQFEKDGKTDWDSVIVSEAKRRKWLEDNPETTSNDELVVFDTSIIPWWAWMKRYHLPEAELLNGRAAMIGFFMAYFVDSLTGVGLVDQMGNFFCKTLLFVAVAGVLFIRKNEDLDKLKDLFDETTLYDKQWQAAWKEPDSSTVSSKK

SEQ ID NO: 2575 - DNA, 957 bp, Populus balsamifera subsp. trichocarpa; identical to SEQ ID NO: 1132
  misc_feature (1)..(957): Ceres ANNOT ID no. 1485362
  misc_feature 290368:<222: Transcription Factor
  misc_feature: Phenotype: WHOLE PLANT - Yellow-Green Viable 1 Useful for making lethal plants for genetic confinement systems

SEQ ID NO: 2576 - protein, 318 aa, Populus balsamifera subsp. trichocarpa; identical to SEQ ID NO: 1133
  misc_feature (1)..(318): Ceres ANNOT ID no. 1485362
  misc_feature 290425:<222: Transcription Factor
  misc_feature: Phenotype: WHOLE PLANT - Yellow-Green Viable 1 Useful for making lethal plants for genetic confinement systems
  misc_feature (1)..(318): Functional Homolog of  Ceres CLONE ID no. 153053 at SEQ ID NO. 2621 with e-value of 1.59E-60 and BLAST sequence identity of 61.2

SEQ ID NO: 2577 - protein, 310 aa, Arabidopsis thaliana
  misc_feature (1)..(310): Ceres CLONE ID no. 154718
  misc_feature (1)..(310): Also Known As Ceres CDNA ID no. 23376572
  misc_feature (1)..(310): Also Known As Ceres GEMINI ID 554B10
  misc_feature (68)..(113): Pfam Name: Myb_DNA-binding Pfam Description: Myb-like DNA-binding domain
  misc_feature 290538:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
MGRAPCCDKANVKKGPWSPEEDAKLKSYIENSGTGGNWIALPQKIGLKRCGKSCRLRWLNYLRPNIKHGGFSEEEENIICSLYLTIGSRWSIIAAQLPGRTDNDIKNYWNTRLKKKLINKQRKELQEACMEQQEMMVMMKRQHQQQQIQTSFMMRQDQTMFTWPLHHHNVQVPALFMNQTNSFCDQEDVKPVLIKNMVKIEDQELEKTNPHHHQDSMTNAFDHLSFSQLLLDPNHNHLGSGEGFSMNSILSANTNSPLLNTSNDNQWFGNFQAETVNLFSGASTSTSADQSTISWEDISSLVYSDSKQFF

SEQ ID NO: 2578 - DNA, 1032 bp, Populus balsamifera subsp. trichocarpa
  misc_feature (1)..(1032): Ceres ANNOT ID no. 1457453
  misc_feature 290651:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
atggggagagctccttgctgtgacaaagccaacgtgaagaaaggtccatggtctcccgaggaagatgccatactcaaggcctatattgagcagcatggaacgggtggcaattggattgccttgccacagaagataggcctgaaaaggtgtggcaagagctgtcgacttagatggttgaattatctccgtccaaacattaaacatggagggttttcagaggaagaagataacattatttgcagtctctatataagtattggaagcaggtggtctatcattgctgctcagttacctggaagaaccgataatgatataaaaaactactggaacacaaggcttaagaagaagctcttaggaaaacagcgcaaggaacaagcagcccggcgagctagtctcaagcaagaaatcatgacaaagagagaaataaatgagagcttcatggttcctggggctatccctcatcaacaaagcccttactggccagaggtaccagctctagtcatgaatcaaaaccaagattctcatttgatggatcaagaatccattaggaacttactgatcaaacttggtggaagattttctgacaataatcaagagtcagccctattcactacaatcaacaattaccctcttgacggttcaagcagacaagatcaagtaccatacacaaactccatagatgtgctttcttcttcggcacccatgcgatcaatggatagtacctgttgttctcaatttcctaatagcaactacaacggtccaaatatgtgtcaagctggacttgaaaacttgttggtcgagctaggtggattggtctgtagcaacccacaacgtgtagaaggtttggatagtttctatgggatggacatggctgccagtggcagcacgggggctagctctgcagaaagtaacagctggggacatataagctctcttggttatcctcagcttgtttctgactatgaaacttgcttgcaaagcatgccacaagattcatcttttgaagattcaagcttctttgggccacattaa

SEQ ID NO: 2579 - protein, 343 aa, Populus balsamifera subsp. trichocarpa
  misc_feature (1)..(343): Ceres ANNOT ID no. 1457453
  misc_feature (14)..(62): Pfam Name: Myb_DNA-binding Pfam Description: Myb-like DNA-binding domain
  misc_feature: SWISSPROT Homolog: ODO1_PETHY ODORANT1 protein (MYB-like protein ODO1) with e-value of 3.9e-41 and BLAST sequence identity of 61.9
  misc_feature: SWISSPROT Homolog: MYB2_PHYPA Myb-related protein Pp2 with e-value of 5.7e-41 and BLAST sequence identity of 65.8
  misc_feature: SWISSPROT Homolog: MYB4_ORYSA Myb-related protein Myb4 (OsMyb4) (Transcription factor RLTR1) with e-value of 1.5e-40 and BLAST sequence identity of 65.0
  misc_feature: SWISSPROT Homolog: MYB4_ARATH Transcription repressor MYB4 (Myb-related protein 4) (AtMYB4) with e-value of 1.7e-39 and BLAST sequence identity of 58.3
  misc_feature: SWISSPROT Homolog: MYB1_HORVU Myb-related protein Hv1 with e-value of 3.2e-38 and BLAST sequence identity of 56.7
  misc_feature 290784:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature (1)..(343): Functional Homolog of  Ceres CLONE ID no. 154718 at SEQ ID NO. 2624 with e-value of 2.19E-70 and BLAST sequence identity of 57.7
MGRAPCCDKANVKKGPWSPEEDAILKAYIEQHGTGGNWIALPQKIGLKRCGKSCRLRWLNYLRPNIKHGGFSEEEDNIICSLYISIGSRWSIIAAQLPGRTDNDIKNYWNTRLKKKLLGKQRKEQAARRASLKQEIMTKREINESFMVPGAIPHQQSPYWPEVPALVMNQNQDSHLMDQESIRNLLIKLGGRFSDNNQESALFTTINNYPLDGSSRQDQVPYTNSIDVLSSSAPMRSMDSTCCSQFPNSNYNGPNMCQAGLENLLVELGGLVCSNPQRVEGLDSFYGMDMAASGSTGASSAESNSWGHISSLGYPQLVSDYETCLQSMPQDSSFEDSSFFGPH

SEQ ID NO: 2580 - protein, 344 aa, Arabidopsis thaliana
  misc_feature (1)..(344): Ceres CLONE ID no. 156655
  misc_feature (14)..(102): Pfam Name: DUF827 Pfam Description: Plant protein of unknown function (DUF827)
  misc_feature: Phenotype: WHOLE PLANT - Large Useful for making bigger plants
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
  misc_feature: Phenotype: CAULINE LEAVES - Other Useful for making ornamental plants with modified leaves
  misc_feature: Phenotype: ROSETTE LEAVES - Other Useful for making ornamental plants with modified leaves
MPRPRVSELSQRQAPRLRSSSSTSDSNHSNRLITTDQSFKPGVDRKSPRSGGPNSDPLGQKKLGGRISDLESQLGQAQEELRLLKEQLANAEAVKKQAQDELHKKSKKPNPLARVEESATEAERIDRDEIPGDVQKETDVFEVPVEKIAVEEEELRSGNDEAEKLVAKEDEIKMLKARLYDMEKEHESLGKENESLKNQLSDSASEISNVKANEDEMVSKVSRIGEELEESRAKTAHLKEKLESMEEAKDALEAEMKKLRVQTEQWRKAADAAAAVLSGEFEMNGRDRSGSTEKYYAGGFFDPSAGFMDPPGMADDYDDGLGSGKRKSSGMKMFGELWRKKGQK

SEQ ID NO: 2581 - DNA, 1095 bp, Populus balsamifera subsp. trichocarpa
  misc_feature (1)..(1095): Ceres ANNOT ID no. 1441740
  misc_feature 291047:<222: Transcription Factor
  misc_feature: Phenotype: WHOLE PLANT - Large Useful for making bigger plants
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
  misc_feature: Phenotype: CAULINE LEAVES - Other Useful for making ornamental plants with modified leaves
  misc_feature: Phenotype: ROSETTE LEAVES - Other Useful for making ornamental plants with modified leaves
atgcctcaaaggcagtctcctcgaggctcacatccacttaggacatctaactctgattccgacccactgcatcatagacctataactgatcgaagagaaaagctaggagaccgttgctccccaagaggctcccagcctgactcattaaaccaaaagaagcttggaacccgcattgcagatttagaatctcagcttggccaagcacaagtagagctgaagactctaaaagagcagttggcttcagctgaagctgcaaagaaagaagctcaaaaagaattggagaaaaaagccaggaaaggtgctgttccagagccagaggtggattccaaaaaagcagatagcaactcagcagatgaagtttctgaagacaaccagctggaaactgatgtttttgaagttccagtggagaaaaagactgttgagcccaaggatgatcctggcgacctgcttgatcaggtagaaaaagaaaacaacccaactgatataccggctgaaccgctagtgatttcagagccagaaaagctgtcttttcatgacctggcattgaaggatgatgagataaatatgctaaaaaccaagctagaagagaaacaaaaggacctagaggtgtttggtatggaaaatgagaacttgaagaatcaactgaatgaagcaaatttgtacatctcatctgccaaatccaaggaagaggaagtgtccttgaagctgggccaattgggagaagagctggaagcaagtaaagcaaatgctgcccagttaaaggggaaactggaagctgccgaaggagcgaacgaagcattggagacagaaatgaagaaaatgagagtgcagacagagcagtggagaaaagcagcagatgctgctgctgcagtactcgctgggggagtggagatgagtggaaggattccagagaggtgtggctccatggataagcactttggtggtgtattcgagccaccagcaggagggtatgctggttttgtcggatcacctggaatggctgatgatttggacgatggttttggtagcgtgaagcgaaagagctctgggatcaagaagtttggagacttgtggaaaaagaagggccagaaataa

SEQ ID NO: 2582 - protein, 364 aa, Populus balsamifera subsp. trichocarpa
  misc_feature (1)..(364): Ceres ANNOT ID no. 1441740
  misc_feature: SWISSPROT Homolog: Y1714_ARATH Hypothetical protein At1g17140 with e-value of 1.6e-178 and BLAST sequence identity of 100.0
  misc_feature: SWISSPROT Homolog: Y1843_ARATH Hypothetical protein At1g78430 with e-value of 3.9e-97 and BLAST sequence identity of 63.0
  misc_feature: SWISSPROT Homolog: TPM1_YEAST Tropomyosin 1 with e-value of 8.4e-11 and BLAST sequence identity of 28.3
  misc_feature: SWISSPROT Homolog: RAD50_METKA DNA double-strand break repair rad50 ATPase with e-value of 5.4e-10 and BLAST sequence identity of 26.0
  misc_feature: SWISSPROT Homolog: NMCP_ARATH Putative nuclear matrix constituent protein 1-like protein (NMCP1-like) with e-value of 4.2e-09 and BLAST sequence identity of 29.6
  misc_feature 291188:<222: Transcription Factor
  misc_feature: Phenotype: WHOLE PLANT - Large Useful for making bigger plants
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
  misc_feature: Phenotype: CAULINE LEAVES - Other Useful for making ornamental plants with modified leaves
  misc_feature: Phenotype: ROSETTE LEAVES - Other Useful for making ornamental plants with modified leaves
  misc_feature (1)..(364): Functional Homolog of  Ceres CLONE ID no. 156655 at SEQ ID NO. 2627 with e-value of 9.99E-80 and BLAST sequence identity of 59.2
MPQRQSPRGSHPLRTSNSDSDPLHHRPITDRREKLGDRCSPRGSQPDSLNQKKLGTRIADLESQLGQAQVELKTLKEQLASAEAAKKEAQKELEKKARKGAVPEPEVDSKKADSNSADEVSEDNQLETDVFEVPVEKKTVEPKDDPGDLLDQVEKENNPTDIPAEPLVISEPEKLSFHDLALKDDEINMLKTKLEEKQKDLEVFGMENENLKNQLNEANLYISSAKSKEEEVSLKLGQLGEELEASKANAAQLKGKLEAAEGANEALETEMKKMRVQTEQWRKAADAAAAVLAGGVEMSGRIPERCGSMDKHFGGVFEPPAGGYAGFVGSPGMADDLDDGFGSVKRKSSGIKKFGDLWKKKGQK

SEQ ID NO: 2583 - protein, 214 aa, Arabidopsis thaliana
  misc_feature (1)..(214): Ceres CLONE ID no. 156807
  misc_feature (9)..(109): Pfam Name: DUF260 Pfam Description: Protein of unknown function DUF260
  misc_feature: Phenotype: CAULINE LEAVES - Curled 3 Useful for making ornamental plants with altered leaf shape
  misc_feature: Phenotype: ROSETTE LEAVES - Curled 3 Useful for making ornamental plants with altered leaf shape
MASSSTNSPCAACKFLRRKCQPECVFAPYFPPDQPQKFANVHKVFGASNVTKLLNELHPSQREDAVNSLAYEADMRLRDPVYGCVGVISLLQHQLRQLQIDLSCAKSELSKYQSLGILAATHQSLGINLLAGAADGTATAVRDHYHHHQFFPREQMFGGLDVPAGNNYDGGILAIGQITQFQQPRAAAGDDGRRTVDPLEILGFWWCSSSSIAW

SEQ ID NO: 2584 - DNA, 663 bp, Populus balsamifera subsp. trichocarpa; identical to SEQ ID NO: 532
  misc_feature (1)..(663): Ceres ANNOT ID no. 1464566
  misc_feature 291409:<222: Transcription Factor
  misc_feature: Phenotype: CAULINE LEAVES - Curled 3 Useful for making ornamental plants with altered leaf shape
  misc_feature: Phenotype: ROSETTE LEAVES - Curled 3 Useful for making ornamental plants with altered leaf shape

SEQ ID NO: 2585 - protein, 220 aa, Populus balsamifera subsp. trichocarpa; identical to SEQ ID NO: 533
  misc_feature (1)..(220): Ceres ANNOT ID no. 1464566
  misc_feature (8)..(108): Pfam Name: DUF260 Pfam Description: Protein of unknown function DUF260
  misc_feature: SWISSPROT Homolog: LBD6_ARATH LOB domain protein 6 (ASYMMETRIC LEAVES2) with e-value of 6.2e-106 and BLAST sequence identity of 100.0
  misc_feature: SWISSPROT Homolog: ASL2_ARATH Protein ASYMMETRIC LEAVES2 (LOB domain protein 36) with e-value of 3.4e-43 and BLAST sequence identity of 62.8
  misc_feature: SWISSPROT Homolog: LOB_ARATH Protein LATERAL ORGAN BOUNDARIES with e-value of 1.5e-42 and BLAST sequence identity of 73.7
  misc_feature: SWISSPROT Homolog: LBD25_ARATH LOB domain protein 25 with e-value of 2.2e-39 and BLAST sequence identity of 68.2
  misc_feature: SWISSPROT Homolog: LBD10_ARATH Putative LOB domain protein 10 with e-value of 3.7e-37 and BLAST sequence identity of 68.9
  misc_feature 291508:<222: Transcription Factor
  misc_feature: Phenotype: CAULINE LEAVES - Curled 3 Useful for making ornamental plants with altered leaf shape
  misc_feature: Phenotype: ROSETTE LEAVES - Curled 3 Useful for making ornamental plants with altered leaf shape
  misc_feature (1)..(220): Functional Homolog of  Ceres CLONE ID no. 156807 at SEQ ID NO. 2630 with e-value of 1.10E-75 and BLAST sequence identity of 85.3

SEQ ID NO: 2586 - DNA, 669 bp, Populus balsamifera subsp. trichocarpa; identical to SEQ ID NO: 534
  misc_feature (1)..(669): Ceres ANNOT ID no. 1458408
  misc_feature 291590:<222: Transcription Factor
  misc_feature: Phenotype: CAULINE LEAVES - Curled 3 Useful for making ornamental plants with altered leaf shape
  misc_feature: Phenotype: ROSETTE LEAVES - Curled 3 Useful for making ornamental plants with altered leaf shape

SEQ ID NO: 2587 - protein, 222 aa, Populus balsamifera subsp. trichocarpa; identical to SEQ ID NO: 535
  misc_feature (1)..(222): Ceres ANNOT ID no. 1458408
  misc_feature (8)..(108): Pfam Name: DUF260 Pfam Description: Protein of unknown function DUF260
  misc_feature: SWISSPROT Homolog: LBD6_ARATH LOB domain protein 6 (ASYMMETRIC LEAVES2) with e-value of 6.2e-106 and BLAST sequence identity of 100.0
  misc_feature: SWISSPROT Homolog: ASL2_ARATH Protein ASYMMETRIC LEAVES2 (LOB domain protein 36) with e-value of 3.4e-43 and BLAST sequence identity of 62.8
  misc_feature: SWISSPROT Homolog: LOB_ARATH Protein LATERAL ORGAN BOUNDARIES with e-value of 1.5e-42 and BLAST sequence identity of 73.7
  misc_feature: SWISSPROT Homolog: LBD25_ARATH LOB domain protein 25 with e-value of 2.2e-39 and BLAST sequence identity of 68.2
  misc_feature: SWISSPROT Homolog: LBD10_ARATH Putative LOB domain protein 10 with e-value of 3.7e-37 and BLAST sequence identity of 68.9
  misc_feature: Transcription Factor
  misc_feature: Phenotype: CAULINE LEAVES - Curled 3 Useful for making ornamental plants with altered leaf shape
  misc_feature: Phenotype: ROSETTE LEAVES - Curled 3 Useful for making ornamental plants with altered leaf shape
  misc_feature (1)..(222): Functional Homolog of  Ceres CLONE ID no. 156807 at SEQ ID NO. 2630 with e-value of 2.90E-75 and BLAST sequence identity of 84.8

SEQ ID NO: 2588 - protein, 320 aa, Arabidopsis thaliana
  misc_feature (1)..(320): Ceres CLONE ID no. 157058
  misc_feature (8)..(81): Pfam Name: ENT Pfam Description: ENT domain
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
MVGLHINMEAQIHILEQEAYSAVLRAFQAQADEFSWDKATVMTNLRKELRISDDENRQLLNNVHNDDLIKRIRDSRPRGGNQVVRHQSLDVHPSPTFSASRKKQKTFQSYPSIGSTRSKSFNNRVVSANEPAEALIGRKVWTKWPEDNSFYEAVVTQYNANEGRHALVYDINTVNETWEWVDLNEIPTKDIRWDGEEDGVTLNVGHGGGTTRGNRRTLSHGGRGRGPRTQPRREHLATENGGGRKFFGEIELFNTDSLVKEVERVFDSNLPDPHELDKAKKLLKEHEQALIAAIARLTDASDYESDGEEPYSHELPMLLG

SEQ ID NO: 2589 - DNA, 1332 bp, Populus balsamifera subsp. trichocarpa
  misc_feature (1)..(1332): Ceres ANNOT ID no. 1528285
  misc_feature 291869:<222: Transcription Factor
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
atggaatatgaagtttcagacagtagtggtactgatgatgatatcccgccatcagatcaaaatagagttgtaagagcagtaagaatctcaggaagtggacaatctgctgtaatttctgcaacatattctagagtgcaagctgacatggaggctcaaattcatcaccttgaacaagaagcttatagggctgtacttcgtgcttttaaggctcaatctgatcaacttagttgggataaggagggtttaattacagaacttaggaaagagctcagggtgtcagatgatgaacacagagagatcttaacattggttaatagagatgatatcattcaaaagataagggagtggagagaggcaggcggccaacgagctcccaggctcaatgcatctcagtctgttcatgatgtttttcctagtcccactgtttcagcatcccgtaaaaaacagaagacattcctaatgtatccgacaggtcctcccagaaatcagcatttcaccaaccatggttccgcctatgatgacaaagaaattggaaaagaagtgtggacaagatggcctgaggacaacaacttctataaggctgtcataactcgatataaccctaccgagggcaggcatgctttggtctatgatatgaatacagaaaatgagacgtgggaatgggttgatctcaatgagatggctccagaggacattcgttgggaaggtgatgatcctggaatttctcgtggtgggccaaggcacatgataaaaaaatccatgagccatggaggttttaattcaagttctgtaagaaggagggcatccactaatgatcaatcaaaaagagaatttcttctaacacagaatggtattgcaaggaaactttctgacaacatcgaattgctcaacacagagtccctagttaaggaggtggagagggtttttggtgtcagttatcctgatcctcttgaccttgagaaggcaaaaaggatgttaaaagagcatgaacaagcacttgttgatgcaattgcaaggcttgcagatgcatctgatggagaaagcgtttctctaaaattcttacactttttcccctcaaatcagatgccgacccaagattcttgcaggggcaagcaatggagcaggaatgagcggtacaatagcatagctgtgcctgacgagttggagttgcccttgtggtttcttggtttggctggaagattcttgcatgaaaagctatgccatctatgtgtgttcagagcaattactgtcttggcttcagctgattgtaatgaagccttgactcctgatcagaatacaacccagatgccagacctttgcagcacaacatga

SEQ ID NO: 2590 - protein, 443 aa, Populus balsamifera subsp. trichocarpa
  misc_feature (1)..(443): Ceres ANNOT ID no. 1528285
  misc_feature (49)..(122): Pfam Name: ENT Pfam Description: ENT domain
  misc_feature 291953:<222: Transcription Factor
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature (1)..(443): Functional Homolog of  Ceres CLONE ID no. 157058 at SEQ ID NO. 2635 with e-value of 1.90E-85 and BLAST sequence identity of 61.0
MEYEVSDSSGTDDDIPPSDQNRVVRAVRISGSGQSAVISATYSRVQADMEAQIHHLEQEAYRAVLRAFKAQSDQLSWDKEGLITELRKELRVSDDEHREILTLVNRDDIIQKIREWREAGGQRAPRLNASQSVHDVFPSPTVSASRKKQKTFLMYPTGPPRNQHFTNHGSAYDDKEIGKEVWTRWPEDNNFYKAVITRYNPTEGRHALVYDMNTENETWEWVDLNEMAPEDIRWEGDDPGISRGGPRHMIKKSMSHGGFNSSSVRRRASTNDQSKREFLLTQNGIARKLSDNIELLNTESLVKEVERVFGVSYPDPLDLEKAKRMLKEHEQALVDAIARLADASDGESVSLKFLHFFPSNQMPTQDSCRGKQWSRNERYNSIAVPDELELPLWFLGLAGRFLHEKLCHLCVFRAITVLASADCNEALTPDQNTTQMPDLCSTT

SEQ ID NO: 2591 - DNA, 972 bp, Populus balsamifera subsp. trichocarpa
  misc_feature (1)..(972): Ceres ANNOT ID no. 1454671
  misc_feature 292077:<222: Transcription Factor
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
atggaatatgaagtttcagacagtagtggtactgatgatgatctcccgccctcaaatcaaaatagacttgtaagacgaggaagagctccaggaagtgggcaatctgctgtaatttctgcaacatattctagagtgcaagctgacatggaggcccaaattcatcacctcgaacaagaagcatatagggctgtacttcgtgcttttaaggctcagtctgatcaactttcttgggataaggagggtttgattacagaacttaggaaagagctcagggtgtcagatgatgaacacagagagatcttaacattggtcaatagagacgatatcattcaaaggataagggagtggagagaggcaggtggccagcaagttcccaggttgattgcttcacagtctgttcatgatgttttgtccagtcccactgtttctgcatcccgtaaaaaacagaagacttccctggtgtaccccactggtcctcccagaaatcaacatttcaacaaccatggttccgcctatgatgataaggaaattggaaaagaagtgtggacaagatggcctgaggacaacaacttctacaaggctgttataactagatataaccctgctgaggctcgacatgctctggtctatgatatgaatactgaaaatgagacatgggaatgggttgatctcaatgagatggctccagaggaccttcgttgggaagttgaagatcctggaatttctcatggcaggccaggccatgtaatgaaaaaatctatgagccatggtggtcttatttcaagttctgtaagagggaggggatccactaaggatcaatcaaaaagggaattttttcgaacacagaatggtattgcaaggaaactttctgacaatattgaattactcaacacagagtccctagttaaggaggtggagagggtttttggtgtcagctatcctgatcctcttgagcttgagaaggcaaaaaaa

SEQ ID NO: 2592 - protein, 324 aa, Populus balsamifera subsp. trichocarpa
  misc_feature (1)..(324): Ceres ANNOT ID no. 1454671
  misc_feature (49)..(122): Pfam Name: ENT Pfam Description: ENT domain
  misc_feature 292149:<222: Transcription Factor
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature (1)..(324): Functional Homolog of  Ceres CLONE ID no. 157058 at SEQ ID NO. 2635 with e-value of 2.90E-75 and BLAST sequence identity of 60.9
MEYEVSDSSGTDDDLPPSNQNRLVRRGRAPGSGQSAVISATYSRVQADMEAQIHHLEQEAYRAVLRAFKAQSDQLSWDKEGLITELRKELRVSDDEHREILTLVNRDDIIQRIREWREAGGQQVPRLIASQSVHDVLSSPTVSASRKKQKTSLVYPTGPPRNQHFNNHGSAYDDKEIGKEVWTRWPEDNNFYKAVITRYNPAEARHALVYDMNTENETWEWVDLNEMAPEDLRWEVEDPGISHGRPGHVMKKSMSHGGLISSSVRGRGSTKDQSKREFFRTQNGIARKLSDNIELLNTESLVKEVERVFGVSYPDPLELEKAKK

SEQ ID NO: 2593 - protein, 269 aa, Arabidopsis thaliana
  misc_feature (1)..(269): Ceres CLONE ID no. 157547
  misc_feature (1)..(227): Pfam Name: Transferase Pfam Description: Transferase family
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - No Branching Useful for modifying plant architecture, ie amount of  branching
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
MNHNMFDGIAAMEFLNSWAETARGLPLSVPPFLDRTLLRPRTPPKIEFPHNEFEDLEDISGTGKLYSDEKLVYKSFLFGPEKLERLKIMAETRSTTFQTLTGFLWRARCQALGLKPDQRIKLLFAADGRSRFVPELPKGYSGNGIVFTYCVTTAGEVTLNPLSHSVCLVKRAVEMVNDGFMRSAIDYFEVTRARPSLTATLLITSWAKLSFHTKDFGWGEPVVSGPVGLPEKEVILFLPCGSDTNYQCAAWTSWLGYESVPRDYGYMNH

SEQ ID NO: 2594 - DNA, 1299 bp, Populus balsamifera subsp. trichocarpa
  misc_feature (1)..(1299): Ceres ANNOT ID no. 1473898
  misc_feature 292401:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - No Branching Useful for modifying plant architecture, ie amount of  branching
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atggcagatggtagtaacgatgctttaaaacttactgttaagcaaggagaaccgactctggttcctccagcagaggagacaaagaagggcctgtactttctctcaaaccttgatcaaaatatcgcagtcatagttcgtacaatttactgctttaagtctgacgtgaaaggaaatgaggatgctgtggaagtcattaagaatgccttgtcaaaaattcttgtgcactactatccaatagctgggcggctaacaattagctcaaaaggaaagctgatagtggattgcaccggggaaggtgctgtttttgttgaggctgaaacggattgtgaaatagccgagcttggagacataacaaagcctgatcctgtgactcttgggaagttggtttatgaaattcctggtgcacaaaacatacttcagatgcctcctgtaacggctcaggtgactaaattcaaatgtggaggatttgttcttgggctatgcacgaaccattgtatgttcgatggaattggtgctatggagtttgtgaattcatggggagctactgctaggggtttggctcttgatgtacctccatttctagatagaagcatactcaaagctcgaatcccgcctaagatagagtttccacaccatgaatttgatgacattgaagatgtgtcaaataccagcaagctttatgaagaggaaatgctctatagatctttctgttttgaccccgagaaacttgatcaactcaaggaaaaagctatggaagacggagttatagccaagtgcacaacatttcaagttctctcagcctttgtgtggagagctcgatgccaggcattgaggatggtgcctgatcaacagataaagctcctgtttgctgcagatggacggtctagatttgagccaccaattcctgaaggatactttggcaatgcgatcgtgttaacaaattctctgtgcacagcaggagagataatggaaaaccagttgtcctttgctgtaaggctagttcaggaggcagttaaaatggttgatgacagttatatgagatcagcgatagattattttgaagttacaagagccaggccctctctgactgcaactcttctaatcacaacttggtctaggctatctttccacacaacagacttcggatggggggtgcctattttatcagggcctgtggctctaccagagaaggaagtaattctcttcctttctcatgggattgagaggaaaaacataaacgttctcgtaggcctgccagcttcttccatgaagatatttgaagaactaatgcagatttga

SEQ ID NO: 2595 - protein, 292 aa, Populus balsamifera subsp. trichocarpa
  misc_feature (1)..(292): Ceres ANNOT ID no. 1473898
  misc_feature (2)..(293): Pfam Name: Transferase Pfam Description: Transferase family
  misc_feature: SWISSPROT Homolog: HCBT1_DIACA Anthranilate N-benzoyltransferase protein 1 (EC 2.3.1.144) (Anthranilate N-hydroxycinnamoyl/benzoyltransferase 1) with e-value of 2.1e-34 and BLAST sequence identity of 34.6
  misc_feature: SWISSPROT Homolog: HCBT2_DIACA Anthranilate N-benzoyltransferase protein 2 (EC 2.3.1.144) (Anthranilate N-hydroxycinnamoyl/benzoyltransferase 2) with e-value of 2.4e-33 and BLAST sequence identity of 35.5
  misc_feature: SWISSPROT Homolog: HCBT3_DIACA Anthranilate N-benzoyltransferase protein 3 (EC 2.3.1.144) (Anthranilate N-hydroxycinnamoyl/benzoyltransferase 3) with e-value of 6.4e-33 and BLAST sequence identity of 34.7
  misc_feature: SWISSPROT Homolog: DBNBT_TAXCA 3'-N-debenzoyl-2'-deoxytaxol N-benzoyltransferase (EC 2.3.1.-) (DBTNBT) with e-value of 6.7e-23 and BLAST sequence identity of 30.8
  misc_feature: SWISSPROT Homolog: T5AT_TAXCH Taxadien-5-alpha-ol O-acetyltransferase with e-value of 1.5e-21 and BLAST sequence identity of 29.5
  misc_feature: SWISSPROT Homolog: T5AT_TAXCH EC 2.3.1.162 (Taxa-4(20),11(12)- dien-5alpha-ol-O-acetyltransferase) ( Taxadienol acetyltransferase)
  misc_feature 292594:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - No Branching Useful for modifying plant architecture, ie amount of  branching
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(292): Functional Homolog of  Ceres CLONE ID no. 157547 at SEQ ID NO. 2640 with e-value of 9.29E-86 and BLAST sequence identity of 68.6
MPPVTAQVTKFKCGGFVLGLCTNHCMFDGIGAMEFVNSWGATARGLALDVPPFLDRSILKARIPPKIEFPHHEFDDIEDVSNTSKLYEEEMLYRSFCFDPEKLDQLKEKAMEDGVIAKCTTFQVLSAFVWRARCQALRMVPDQQIKLLFAADGRSRFEPPIPEGYFGNAIVLTNSLCTAGEIMENQLSFAVRLVQEAVKMVDDSYMRSAIDYFEVTRARPSLTATLLITTWSRLSFHTTDFGWGVPILSGPVALPEKEVILFLSHGIERKNINVLVGLPASSMKIFEELMQI

SEQ ID NO: 2596 - protein, 144 aa, Arabidopsis thaliana
  misc_feature (1)..(144): Ceres CLONE ID no. 157709
  misc_feature (118)..(136): Pfam Name: DVL Pfam Description: DVL family
  misc_feature: Phenotype: CAULINE LEAVES - Oval Shaped Useful for making plants with increased biomass and foliage
  misc_feature: Phenotype: ROSETTE LEAVES - Oval Shaped Useful for making plants with increased biomass and foliage
MDDENLWKVVKKDSIFETTHFSSKPVFTRSFSTKTSSSSSKPVFTRSFSTKPTSYSSSEPIFRRSFSAKPTSSKSPFLSRSGSTKCPVDTSSTSKCSISRSLSQKGASVTRKCRNMAKEHKSRFYIMKRCVLMLVCWHKHACDS

SEQ ID NO: 2597 - DNA, 276 bp, Populus balsamifera subsp. trichocarpa
  misc_feature (1)..(276): Ceres ANNOT ID no. 1515067
  misc_feature 292819:<222: Transcription Factor
  misc_feature: Phenotype: CAULINE LEAVES - Oval Shaped Useful for making plants with increased biomass and foliage
  misc_feature: Phenotype: ROSETTE LEAVES - Oval Shaped Useful for making plants with increased biomass and foliage
atggctgagaagtggaagctatcgaagaaagaaggttcatcttctttcacaagaagtttctcaacaaagagttcgtcatccaaggctcctctcttgaggagctcatcccttaaaatctcttctccaaagtgtcctcttccaaggagttgctctcaaaaaagctcttccatttcacgtaaatgtagtagcttagccaaggaacagaaggcaaggttttatatcatgaggcgctgtgttgccatgcttgtttgttggcacaaacacggtgattcttga

SEQ ID NO: 2598 - protein, 91 aa, Populus balsamifera subsp. trichocarpa
  misc_feature (1)..(91): Ceres ANNOT ID no. 1515067
  misc_feature (66)..(84): Pfam Name: DVL Pfam Description: DVL family
  misc_feature: SWISSPROT Homolog: CHI3_CANAL Chitinase 3 precursor (EC 3.2.1.14) with e-value of 1.0e-06 and BLAST sequence identity of 37.6
  misc_feature: SWISSPROT Homolog: YB95_SCHPO Hypothetical serine-rich protein C1E8.05 precursor with e-value of 6.2e-06 and BLAST sequence identity of 32.2
  misc_feature 292882:<222: Transcription Factor
  misc_feature: Phenotype: CAULINE LEAVES - Oval Shaped Useful for making plants with increased biomass and foliage
  misc_feature: Phenotype: ROSETTE LEAVES - Oval Shaped Useful for making plants with increased biomass and foliage
  misc_feature (1)..(91): Functional Homolog of  Ceres CLONE ID no. 157709 at SEQ ID NO. 2643 with e-value of 4.69E-20 and BLAST sequence identity of 64.4
MAEKWKLSKKEGSSSFTRSFSTKSSSSKAPLLRSSSLKISSPKCPLPRSCSQKSSSISRKCSSLAKEQKARFYIMRRCVAMLVCWHKHGDS

SEQ ID NO: 2599 - DNA, 276 bp, Populus balsamifera subsp. trichocarpa
  misc_feature (1)..(276): Ceres ANNOT ID no. 1492780
  misc_feature 292940:<222: Transcription Factor
  misc_feature: Phenotype: CAULINE LEAVES - Oval Shaped Useful for making plants with increased biomass and foliage
  misc_feature: Phenotype: ROSETTE LEAVES - Oval Shaped Useful for making plants with increased biomass and foliage
atggatgagaagtggaagttatcaaagaaagaaggttcatcttctttcacaagaagtttctcgactaagagttcatcttccaaggctcctctcttgaggacctcgtcccttaagagctcttctccaaagtgccctcttccaaggagtttctctcaaaaaaactcttctatttcacataaatgtagtagcttagccaaggaacagaaggcaaggttttatatcatgaggcgctgtgttgccatgcttgtttgttggcacaaacatggtgattcttga

SEQ ID NO: 2600 - protein, 91 aa, Populus balsamifera subsp. trichocarpa
  misc_feature (1)..(91): Ceres ANNOT ID no. 1492780
  misc_feature (66)..(84): Pfam Name: DVL Pfam Description: DVL family
  misc_feature: SWISSPROT Homolog: CHI3_CANAL Chitinase 3 precursor (EC 3.2.1.14) with e-value of 1.0e-06 and BLAST sequence identity of 37.6
  misc_feature: SWISSPROT Homolog: YB95_SCHPO Hypothetical serine-rich protein C1E8.05 precursor with e-value of 6.2e-06 and BLAST sequence identity of 32.2
  misc_feature 293003:<222: Transcription Factor
  misc_feature: Phenotype: CAULINE LEAVES - Oval Shaped Useful for making plants with increased biomass and foliage
  misc_feature: Phenotype: ROSETTE LEAVES - Oval Shaped Useful for making plants with increased biomass and foliage
  misc_feature (1)..(91): Functional Homolog of  Ceres CLONE ID no. 157709 at SEQ ID NO. 2643 with e-value of 7.60E-20 and BLAST sequence identity of 63.1
MDEKWKLSKKEGSSSFTRSFSTKSSSSKAPLLRTSSLKSSSPKCPLPRSFSQKNSSISHKCSSLAKEQKARFYIMRRCVAMLVCWHKHGDS

SEQ ID NO: 2601 - protein, 149 aa, Arabidopsis thaliana
  misc_feature (1)..(149): Ceres CLONE ID no. 157730
  misc_feature (127)..(143): Pfam Name: PHD Pfam Description: PHD-finger
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
MRKEIESSQENALSLCTEKVLLARQAYDLIDSHVKRLDEDLNNFAEDLKQEGKIPPDEPSVLPPLPIVPKAEKRKSFYGTPQPKKIDYRDRDWDRDRDFELMPPPGSNRKDLMPIEEQPIDPNEPTYCVCHQVSFGDMIACDNEQLPRR

SEQ ID NO: 2602 - DNA, 816 bp, Populus balsamifera subsp. trichocarpa
  misc_feature (1)..(816): Ceres ANNOT ID no. 1532681
  misc_feature 293147:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
atggcaattgctcgaactggagtatacgttgatgattaccttgagtatgcaaatacattaccagctgagcttcaacggcttcttaatactattagggaacttgatgaccgatcccaatcaatgataaatcaaacaaggcaacagacaaactactgtctaggattggcatctcaaagctcgaaaaaagggaatggtagtatttataattgctacaacactaataatagggaagaggatgacgcagtcgagaaaatgaggaaggatattgaggcaaatcaggataatgcattgattttgtgcacggagaaggttttgttggcacggcaagcttatgagcttatagacagccatataaaacgacttgatgaggatctgaacaactttgcagaagatttgaagcatgagggaaaactatcaccagatgagccggcaattcttcctccactgcctttaatagtccctaaaattgagaaacgcaggaacttttatggaacacctcaatcaaaaaggattgatttcagggatcggtattgggacagagaacgtgatagggattttgagctcatgcctcctccaggaagccataaaaaggatttcactgttcctgttgaagctgagcaacccattgatccgaatgaacctacctactgtgtctgccatcaggtgtcctttggagatatgattgcttgtgataacgagaattgccaaggaggtgaatggttccattattcatgtgttgggctgacaccagagacaagattcaaggggaagtggtactgtccaacctgcaggaatctaccccaatttcaatggtag

SEQ ID NO: 2603 - protein, 187 aa, Populus balsamifera subsp. trichocarpa
  misc_feature (1)..(187): Ceres ANNOT ID no. 1532681
  misc_feature (132)..(182): Pfam Name: PHD Pfam Description: PHD-finger
  misc_feature: SWISSPROT Homolog: ING5_MOUSE Inhibitor of growth protein 5 with e-value of 8.2e-17 and BLAST sequence identity of 33.6
  misc_feature: SWISSPROT Homolog: ING5_HUMAN Inhibitor of growth protein 5 (p28ING5) with e-value of 1.7e-16 and BLAST sequence identity of 36.2
  misc_feature: SWISSPROT Homolog: ING4_CHICK Inhibitor of growth protein 4 (p29ING4) with e-value of 2.8e-16 and BLAST sequence identity of 32.2
  misc_feature: SWISSPROT Homolog: ING4_HUMAN Inhibitor of growth protein 4 (p29ING4) with e-value of 5.8e-16 and BLAST sequence identity of 32.2
  misc_feature: SWISSPROT Homolog: ING4_MOUSE Inhibitor of growth protein 4 (p29ING4) with e-value of 1.5e-15 and BLAST sequence identity of 31.5
  misc_feature 293273:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
  misc_feature (1)..(187): Functional Homolog of  Ceres CLONE ID no. 157730 at SEQ ID NO. 2648 with e-value of 1.30E-63 and BLAST sequence identity of 83.3
MRKDIEANQDNALILCTEKVLLARQAYELIDSHIKRLDEDLNNFAEDLKHEGKLSPDEPAILPPLPLIVPKIEKRRNFYGTPQSKRIDFRDRYWDRERDRDFELMPPPGSHKKDFTVPVEAEQPIDPNEPTYCVCHQVSFGDMIACDNENCQGGEWFHYSCVGLTPETRFKGKWYCPTCRNLPQFQW

SEQ ID NO: 2604 - DNA, 549 bp, Populus balsamifera subsp. trichocarpa
  misc_feature (1)..(549): Ceres ANNOT ID no. 1469739
  misc_feature 293370:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
atgcaagcaaagccatctagcagttgcgcctttcacggcatggaatatcctgctgaactcactcggatagacagccatgtaaaacgacttgatgaggatctgaacaactttgcagaagatttgaagcaagagggaaaactatcaccagatgaaccagcaatccttcctccactgcctataatagtccctaaaattgagaaacgcaggaatttttacggaacacctcaatctcaatcgaaaaggattgatttcagggatcgggattgggacagagagcgtgatagggattttgagctcatgcctcctccaggaagccatagaaaggatttccctgttcctgttgaagttgagcaacccattgatcccaatgaacctacctactgtgtctgccatcaggtgtcctttggagatatgattgcttgtgataatgagaattgccaaggaggtgaatggttccattattcatgtgttgggttgacaccggagacaagattcaagggaaaatggtactgtccaacctgcaggaatctaccccaatttcaatggtag

SEQ ID NO: 2605 - protein, 169 aa, Populus balsamifera subsp. trichocarpa
  misc_feature (1)..(169): Ceres ANNOT ID no. 1469739
  misc_feature (114)..(164): Pfam Name: PHD Pfam Description: PHD-finger
  misc_feature: SWISSPROT Homolog: ING5_MOUSE Inhibitor of growth protein 5 with e-value of 8.2e-17 and BLAST sequence identity of 33.6
  misc_feature: SWISSPROT Homolog: ING5_HUMAN Inhibitor of growth protein 5 (p28ING5) with e-value of 1.7e-16 and BLAST sequence identity of 36.2
  misc_feature: SWISSPROT Homolog: ING4_CHICK Inhibitor of growth protein 4 (p29ING4) with e-value of 2.8e-16 and BLAST sequence identity of 32.2
  misc_feature: SWISSPROT Homolog: ING4_HUMAN Inhibitor of growth protein 4 (p29ING4) with e-value of 5.8e-16 and BLAST sequence identity of 32.2
  misc_feature: SWISSPROT Homolog: ING4_MOUSE Inhibitor of growth protein 4 (p29ING4) with e-value of 1.5e-15 and BLAST sequence identity of 31.5
  misc_feature 293488:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
  misc_feature: Phenotype: INFLORESCENCE - Other Useful for making ornamental plants with modified flowers
  misc_feature (1)..(169): Functional Homolog of  Ceres CLONE ID no. 157730 at SEQ ID NO. 2648 with e-value of 7.60E-52 and BLAST sequence identity of 87.8
MEYPAELTRIDSHVKRLDEDLNNFAEDLKQEGKLSPDEPAILPPLPIIVPKIEKRRNFYGTPQSQSKRIDFRDRDWDRERDRDFELMPPPGSHRKDFPVPVEVEQPIDPNEPTYCVCHQVSFGDMIACDNENCQGGEWFHYSCVGLTPETRFKGKWYCPTCRNLPQFQW

SEQ ID NO: 2606 - protein, 435 aa, Arabidopsis thaliana
  misc_feature (1)..(435): Ceres CLONE ID no. 158155
  misc_feature (1)..(435): Also Known As Ceres CDNA ID no. 23514168
  misc_feature (1)..(435): Also Known As Ceres GEMINI ID 554G10
  misc_feature (204)..(276): Pfam Name: RRM_1 Pfam Description: RNA recognition motif. (a.k.a. RRM RBD, or RNP domain)
  misc_feature (323)..(388): Pfam Name: RRM_1 Pfam Description: RNA recognition motif. (a.k.a. RRM RBD, or RNP domain)
  misc_feature 293610:<222: Transcription Factor
  misc_feature: Phenotype: Activates expression of the gene endogenous to the AtHMGS (SEQ ID NO 4144) regalutory region Useful for modulating Terpenoid Biosynthesis
MQTTNGSDSTLATSGATPPNQQTPPPPQQWQQQQQQQQQWMAAMQYPPAAAMMMMQQQQMLMYPHQYVPYNQGPYQQHHPQLHQYGSYQQHQHQQHKAIDRGSGDDVKTLWVGDLLHWMDETYLHSCFSHTGEVSSVKVIRNKLTSQSEGYGFVEFLSRAAAEEVLQNYSGSVMPNSDQPFRINWASFSTGEKRAVENGPDLSVFVGDLSPDVTDVLLHETFSDRYPSVKSAKVVIDSNTGRSKGYGFVRFGDENERSRALTEMNGAYCSNRQMRVGIATPKRAIANQQQHSSQAVILAGGHGSNGSMGYGSQSDGESTNATIFVGGIDPDVIDEDLRQPFSQFGEVVSVKIPVGKGCGFVQFADRKSAEDAIESLNGTVIGKNTVRLSWGRSPNKQWRGDSGQQWNGGYSRGHGYNNGGGYANHHDSNNYHGEN

SEQ ID NO: 2607 - DNA, 1323 bp, Populus balsamifera subsp. trichocarpa
  misc_feature (1)..(1323): Ceres ANNOT ID no. 1460954
  misc_feature 293719:<222: Transcription Factor
  misc_feature: Phenotype: Activates expression of the gene endogenous to the AtHMGS (SEQ ID NO 4144) regalutory region Useful for modulating Terpenoid Biosynthesis
atgcagcaaagcaacggtcctgatcaaaacccatctccacaacaccaaccccatcatccccatcaacaacagtgggtcccacacatgcagcagcagcagcaacagcaacagcagcaacagcaacagtggatggcagctatgcagtatccagctgctgctatggtgatgatgcagcagcagatgatgatgtatcctcaacaacaacatcaccattacatggcttactatcatcaacaacaacagcagtatcaaaaacagcagcagcagtatcatcaaaagcagcagaaacaactacaacaacagggatctaatgaggaggctaaaactgtatgggttggtgacttgcttcattggatggacgagacctacttgcataattgcttctctcatactggagaggtttcttcagtaaagattattcgcaataagcaaactggtcagctggaagggtatggattcgttgagttttattcacatgcagcagctgagaaagtcttgcagagctatagtggctctatgatgccaaatacagatcaaccttttcgtctcaactgggcaagttttgcaggtgaaaggcgagctgatgctggttctgatctgtctatatttgtcggagatttggctgcggacgtgactgatgcaatgttacaggaaacctttgctaccaaatatgcatctgtcaagggagcaaaggttgtcgctgattctaatactggccgttcaaaaggttatggttttgttaggtttggggatgaaaatgagaagacaagggccataactgagatgaatggtgcttactgctcaagtaggcctatgcggataggtgttgccacccctaaaaagccatctgcatatcaacagcagtattcttcacaagctttagtattagctggtggacatgcatcaaatggtacaatggcacaaggatcacaatctgatggggactctaacaatacaactatatttgtgggaggaattgactctgatgtcactgatgaggatctcaggcagccgttttcccaattcggtgaagttgtttctgtgaaaatgccaactggaaaaggatgtgcatttgtacaatttgctaatagaaagaatgcggaggatgcactgcagagtttgaatggaacaacaattggcaagcaaacagttcgcctttcctggggtcgcactccagcaaacaagcagtggagaggggatcatggtaatcaatggcacggggcatattttggagggcaaggctatgccgggtatggatatgctatgccaccaaatcaggacccaggcatgtacgttgcagctgcagcttctggggcttcttaa

SEQ ID NO: 2608 - protein, 440 aa, Populus balsamifera subsp. trichocarpa
  misc_feature (1)..(440): Ceres ANNOT ID no. 1460954
  misc_feature (110)..(181): Pfam Name: RRM_1 Pfam Description: RNA recognition motif. (a.k.a. RRM RBD, or RNP domain)
  misc_feature: SWISSPROT Homolog: YG41_SCHPO Hypothetical RNA-binding protein C23E6.01c in chromosome II with e-value of 1.5e-56 and BLAST sequence identity of 41.1
  misc_feature: SWISSPROT Homolog: CSX1_SCHPO RNA-binding post-transcriptional regulator csx1 with e-value of 6.0e-53 and BLAST sequence identity of 37.5
  misc_feature: SWISSPROT Homolog: NAM8_YEAST Protein NAM8 with e-value of 1.0e-39 and BLAST sequence identity of 37.3
  misc_feature: SWISSPROT Homolog: NGR1_YEAST Negative growth regulatory protein NGR1 (RNA-binding protein RBP1) with e-value of 1.9e-39 and BLAST sequence identity of 40.5
  misc_feature: SWISSPROT Homolog: TIA1_HUMAN Nucleolysin TIA-1 isoform p40 (RNA-binding protein TIA-1) (p40-TIA-1) [Contains: Nucleolysin TIA-1 isoform p15 (p15-TIA-1)] with e-value of 1.9e-31 and BLAST sequence identity of 30.0
  misc_feature 293834:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(440): Functional Homolog of  Ceres CLONE ID no. 158155 at SEQ ID NO. 2653 with e-value of 3.29E-154 and BLAST sequence identity of 71.6
MQQSNGPDQNPSPQHQPHHPHQQQWVPHMQQQQQQQQQQQQQWMAAMQYPAAAMVMMQQQMMMYPQQQHHHYMAYYHQQQQQYQKQQQQYHQKQQKQLQQQGSNEEAKTVWVGDLLHWMDETYLHNCFSHTGEVSSVKIIRNKQTGQLEGYGFVEFYSHAAAEKVLQSYSGSMMPNTDQPFRLNWASFAGERRADAGSDLSIFVGDLAADVTDAMLQETFATKYASVKGAKVVADSNTGRSKGYGFVRFGDENEKTRAITEMNGAYCSSRPMRIGVATPKKPSAYQQQYSSQALVLAGGHASNGTMAQGSQSDGDSNNTTIFVGGIDSDVTDEDLRQPFSQFGEVVSVKMPTGKGCAFVQFANRKNAEDALQSLNGTTIGKQTVRLSWGRTPANKQWRGDHGNQWHGAYFGGQGYAGYGYAMPPNQDPGMYVAAAASGAS

SEQ ID NO: 2609 - DNA, 1215 bp, Populus balsamifera subsp. trichocarpa
  misc_feature (1)..(1215): Ceres ANNOT ID no. 1514228
  misc_feature 293951:<222: Transcription Factor
  misc_feature: Phenotype: Activates expression of the gene endogenous to the AtHMGS (SEQ ID NO 4144) regalutory region Useful for modulating Terpenoid Biosynthesis
atgcagcaaagcaacggtcctgatcaaaacccatctccacaacaccaaccccatcatccccatcaacaacagtgggtcccacacatgcagcagcagcagcaacagcaacagcagcaacagcaacagtggatggcagctatgcagtatccagctgctgctatggtgatgatgcagcagcagatgatgatgtatcctcaacaacaacatcaccattacatggcttactatcatcaacaacaacagcagtatcaaaaacagcagcagcagtatcatcaaaagcagcagaaacaactacaacaacagggatctaatgaggaggctaaaactgtatgggttggtgacttgcttcattggatggacgagacctacttgcataattgcttctctcatactggagaggtttcttcagtaaagattattcgcaataagcaaactggtcagctggaagggtatggattcgttgagttttattcacatgcagcagctgagaaagtcttgcagagctatagtggctctatgatgccaaatacagatcaaccttttcgtctcaactgggcaagttttgcaggtgaaaggcgagctgatgctggttctgatctgtctatatttgtcggagatttggctgcggacgtgactgatgcaatgttacaggaaacctttgctaccaaatatgcatctgtcaagggagcaaaggttgtcgctgattctaatactggccgttcaaaaggttatggttttgttaggtttggggatgaaaatgagaagacaagggccataactgagatgaatggtgcttactgctcaagtaggcctatgcggataggtgttgccacccctaaaaagccatctgcatatcaacagcagtattcttcacaagctttagtattagctggtggacatgcatcaaatggtacaatggcacaaggatcacaatctgatggggactctaacaatacaactatatttgtgggaggaattgactctgatgtcactgatgaggatctcaggcagccgttttcccaattcggtgaagttgtttctgtgaaaatgccaactggaaaaggatgtgcatttgtacaatttgctaatagaaagaatgcggaggatgcactgcagagtttgaatggaacaacaattggcaagcaaacagttcgcctttcctggggtcgcactccagcaaacaagcaggcgtgtgcacaagtctttactagatag

SEQ ID NO: 2610 - protein, 404 aa, Populus balsamifera subsp. trichocarpa
  misc_feature (1)..(404): Ceres ANNOT ID no. 1514228
  misc_feature (110)..(181): Pfam Name: RRM_1 Pfam Description: RNA recognition motif. (a.k.a. RRM RBD, or RNP domain)
  misc_feature: SWISSPROT Homolog: YG41_SCHPO Hypothetical RNA-binding protein C23E6.01c in chromosome II with e-value of 1.5e-56 and BLAST sequence identity of 41.1
  misc_feature: SWISSPROT Homolog: CSX1_SCHPO RNA-binding post-transcriptional regulator csx1 with e-value of 6.0e-53 and BLAST sequence identity of 37.5
  misc_feature: SWISSPROT Homolog: NAM8_YEAST Protein NAM8 with e-value of 1.0e-39 and BLAST sequence identity of 37.3
  misc_feature: SWISSPROT Homolog: NGR1_YEAST Negative growth regulatory protein NGR1 (RNA-binding protein RBP1) with e-value of 1.9e-39 and BLAST sequence identity of 40.5
  misc_feature: SWISSPROT Homolog: TIA1_HUMAN Nucleolysin TIA-1 isoform p40 (RNA-binding protein TIA-1) (p40-TIA-1) [Contains: Nucleolysin TIA-1 isoform p15 (p15-TIA-1)] with e-value of 1.9e-31 and BLAST sequence identity of 30.0
  misc_feature 294062:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(404): Functional Homolog of  Ceres CLONE ID no. 158155 at SEQ ID NO. 2653 with e-value of 5.40E-145 and BLAST sequence identity of 72.1
MQQSNGPDQNPSPQHQPHHPHQQQWVPHMQQQQQQQQQQQQQWMAAMQYPAAAMVMMQQQMMMYPQQQHHHYMAYYHQQQQQYQKQQQQYHQKQQKQLQQQGSNEEAKTVWVGDLLHWMDETYLHNCFSHTGEVSSVKIIRNKQTGQLEGYGFVEFYSHAAAEKVLQSYSGSMMPNTDQPFRLNWASFAGERRADAGSDLSIFVGDLAADVTDAMLQETFATKYASVKGAKVVADSNTGRSKGYGFVRFGDENEKTRAITEMNGAYCSSRPMRIGVATPKKPSAYQQQYSSQALVLAGGHASNGTMAQGSQSDGDSNNTTIFVGGIDSDVTDEDLRQPFSQFGEVVSVKMPTGKGCAFVQFANRKNAEDALQSLNGTTIGKQTVRLSWGRTPANKQACAQVFTR

SEQ ID NO: 2611 - protein, 175 aa, Arabidopsis thaliana
  misc_feature (1)..(175): Ceres CLONE ID no. 158333
  misc_feature (57)..(119): Pfam Name: zf-Dof Pfam Description: Dof domain, zinc finger
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Bent Useful for modifying fruit shape, composition and seed yield
  misc_feature: Phenotype: ROSETTE LEAVES - Long Petioles Useful for making plants that grow better in shade
  misc_feature: Phenotype: WHOLE PLANT - Standing Rosette Shaped Useful for making plants with increased biomass and foliage
  misc_feature: Phenotype: SILIQUES - Other Useful for increasing seed/fruit yield or modifying fruit content
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: ROSETTE LEAVES - Undulate Shaped Useful for making plants with increased biomass and foliage
MATQDSQGIKLFGKTITFNANITQTIKKEEQQQQQQPELQATTAVRSPSSDLTAEKRPDKIIPCPRCKSMETKFCYFNNYNVNQPRHFCKGCQRYWTAGGALRNVPVGAGRRKSKPPGRVGGFAELLGAATGAVDQVELDALLVEEWRAATASHGGFRHDFPVKRLRCYTDGQSC

SEQ ID NO: 2612 - DNA, 486 bp, Populus balsamifera subsp. trichocarpa
  misc_feature (1)..(486): Ceres ANNOT ID no. 1466505
  misc_feature 294332:<222: Transcription Factor
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Bent Useful for modifying fruit shape, composition and seed yield
  misc_feature: Phenotype: ROSETTE LEAVES - Long Petioles Useful for making plants that grow better in shade
  misc_feature: Phenotype: WHOLE PLANT - Standing Rosette Shaped Useful for making plants with increased biomass and foliage
  misc_feature: Phenotype: SILIQUES - Other Useful for increasing seed/fruit yield or modifying fruit content
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: ROSETTE LEAVES - Undulate Shaped Useful for making plants with increased biomass and foliage
atggctagtcaagaagagggtatcaagctcttcggagcaacaattacgctgcatgacgggcaagtaatcagtaaagaagatcaaaacaaagaaaatccaaccattgacaagaggccagagaagatcatacaatgccctagatgcaagagcatggagaccaagttttgttacttcaacaactacaatgttaaccagccaagacatttctgtaagggctgccagaggtactggactgcaggtggggcccttcgaaatgttcccgttggagccggccgccggaaaactaagccgcctggccggggtggtcctggtgggtattcagaggagtgcttgtttgatggctctggtggggtgattcaccagtttgagctagatggagttgttttggaggagttgcacttggcaaccacccatggcggtttccgtcaggtcttccccgtgaagcggcggaggagcggtggctcaggtggtcaaaactgttggtga

SEQ ID NO: 2613 - protein, 161 aa, Populus balsamifera subsp. trichocarpa
  misc_feature (1)..(161): Ceres ANNOT ID no. 1466505
  misc_feature (38)..(100): Pfam Name: zf-Dof Pfam Description: Dof domain, zinc finger
  misc_feature: SWISSPROT Homolog: DOF15_ARATH Dof zinc finger protein DOF1.5 (AtDOF1.5) with e-value of 1.1e-94 and BLAST sequence identity of 100.0
  misc_feature: SWISSPROT Homolog: DOF23_ARATH Dof zinc finger protein DOF2.3 (AtDOF2.3) with e-value of 2.3e-67 and BLAST sequence identity of 77.5
  misc_feature: SWISSPROT Homolog: DOF52_ARATH Dof zinc finger protein DOF5.2 (AtDOF5.2) with e-value of 3.7e-35 and BLAST sequence identity of 85.5
  misc_feature: SWISSPROT Homolog: DOF1A_ARATH Dof zinc finger protein DOF1.10 (AtDOF1.10) (H-protein promoter-binding factor 2b) with e-value of 2.5e-32 and BLAST sequence identity of 67.1
  misc_feature: SWISSPROT Homolog: DOF33_ARATH Dof zinc finger protein DOF3.3 (AtDOF3.3) (H-protein promoter-binding factor 2a) with e-value of 6.6e-31 and BLAST sequence identity of 61.0
  misc_feature 294519:<222: Transcription Factor
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Bent Useful for modifying fruit shape, composition and seed yield
  misc_feature: Phenotype: ROSETTE LEAVES - Long Petioles Useful for making plants that grow better in shade
  misc_feature: Phenotype: WHOLE PLANT - Standing Rosette Shaped Useful for making plants with increased biomass and foliage
  misc_feature: Phenotype: SILIQUES - Other Useful for increasing seed/fruit yield or modifying fruit content
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: ROSETTE LEAVES - Undulate Shaped Useful for making plants with increased biomass and foliage
  misc_feature (1)..(161): Functional Homolog of  Ceres CLONE ID no. 158333 at SEQ ID NO. 2658 with e-value of 3.89E-48 and BLAST sequence identity of 69.0
MASQEEGIKLFGATITLHDGQVISKEDQNKENPTIDKRPEKIIQCPRCKSMETKFCYFNNYNVNQPRHFCKGCQRYWTAGGALRNVPVGAGRRKTKPPGRGGPGGYSEECLFDGSGGVIHQFELDGVVLEELHLATTHGGFRQVFPVKRRRSGGSGGQNCW

SEQ ID NO: 2614 - DNA, 480 bp, Populus balsamifera subsp. trichocarpa
  misc_feature (1)..(480): Ceres ANNOT ID no. 1449026
  misc_feature 294683:<222: Transcription Factor
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Bent Useful for modifying fruit shape, composition and seed yield
  misc_feature: Phenotype: ROSETTE LEAVES - Long Petioles Useful for making plants that grow better in shade
  misc_feature: Phenotype: WHOLE PLANT - Standing Rosette Shaped Useful for making plants with increased biomass and foliage
  misc_feature: Phenotype: SILIQUES - Other Useful for increasing seed/fruit yield or modifying fruit content
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: ROSETTE LEAVES - Undulate Shaped Useful for making plants with increased biomass and foliage
atggctagccaagaagagggcatcaagctctttggagcaacaattacgttgcatgataaacaagaaggtaataaagaagatccaaacaaggaaaatccaaccactgacaagagaccagagaaggtcataccttgccctagatgtaagagcatggagaccaagttttgttacttcaacaactacaatgttaaccagccaagatatttctgtaagggctgccagaggtactggacggcaggtggggccctacgaaatgttcctgtgggtgccggccgccggaaaactaagccacctggccgggttggtcttgacggttactcggaggggtgcttgtatgatggctctggtggggttcaccgatttgagctagatgggatggttttggaggagtggcacttggcaacgacccatggcagttcccgtcatgttttccccgtgaagcggcggaggagcggtggctcaggtggtcacacttgttga

SEQ ID NO: 2615 - protein, 159 aa, Populus balsamifera subsp. trichocarpa
  misc_feature (1)..(159): Ceres ANNOT ID no. 1449026
  misc_feature (38)..(100): Pfam Name: zf-Dof Pfam Description: Dof domain, zinc finger
  misc_feature: SWISSPROT Homolog: DOF15_ARATH Dof zinc finger protein DOF1.5 (AtDOF1.5) with e-value of 1.1e-94 and BLAST sequence identity of 100.0
  misc_feature: SWISSPROT Homolog: DOF23_ARATH Dof zinc finger protein DOF2.3 (AtDOF2.3) with e-value of 2.3e-67 and BLAST sequence identity of 77.5
  misc_feature: SWISSPROT Homolog: DOF52_ARATH Dof zinc finger protein DOF5.2 (AtDOF5.2) with e-value of 3.7e-35 and BLAST sequence identity of 85.5
  misc_feature: SWISSPROT Homolog: DOF1A_ARATH Dof zinc finger protein DOF1.10 (AtDOF1.10) (H-protein promoter-binding factor 2b) with e-value of 2.5e-32 and BLAST sequence identity of 67.1
  misc_feature: SWISSPROT Homolog: DOF33_ARATH Dof zinc finger protein DOF3.3 (AtDOF3.3) (H-protein promoter-binding factor 2a) with e-value of 6.6e-31 and BLAST sequence identity of 61.0
  misc_feature 294870:<222: Transcription Factor
  misc_feature: Phenotype: ROSETTE LEAVES - Curled 1 Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Bent Useful for modifying fruit shape, composition and seed yield
  misc_feature: Phenotype: ROSETTE LEAVES - Long Petioles Useful for making plants that grow better in shade
  misc_feature: Phenotype: WHOLE PLANT - Standing Rosette Shaped Useful for making plants with increased biomass and foliage
  misc_feature: Phenotype: SILIQUES - Other Useful for increasing seed/fruit yield or modifying fruit content
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature: Phenotype: ROSETTE LEAVES - Undulate Shaped Useful for making plants with increased biomass and foliage
  misc_feature (1)..(159): Functional Homolog of  Ceres CLONE ID no. 158333 at SEQ ID NO. 2658 with e-value of 1.69E-47 and BLAST sequence identity of 67.0
MASQEEGIKLFGATITLHDKQEGNKEDPNKENPTTDKRPEKVIPCPRCKSMETKFCYFNNYNVNQPRYFCKGCQRYWTAGGALRNVPVGAGRRKTKPPGRVGLDGYSEGCLYDGSGGVHRFELDGMVLEEWHLATTHGSSRHVFPVKRRRSGGSGGHTC

SEQ ID NO: 2616 - protein, 397 aa, Arabidopsis thaliana
  misc_feature (1)..(397): Ceres CLONE ID no. 158702
  misc_feature (53)..(396): Pfam Name: Inositol_P Pfam Description: Inositol monophosphatase family
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: ROSETTE LEAVES - Other Useful for making ornamental plants with modified leaves
MYILDTGARFSAVRFSPVFNPPPTSLRRRYFIVRANLPFPKHQAKYHKELEVAIDAVDRACRLCVDVKRSLFSSKEKIVEKNDQTPVTIADFGVQALVSLELSKLFPSIPLVAEEDSHFVRANNLVSSVVSEVKSKASIGDNHLSDADVLEAIDRGGKDAYTFCNKPATYWVLDPIDGTRGFLKGDEALYVVGLALVVDNEIVLGVMGCPNWPGDSSDGSTGTLMLSHIGCGTWTKKLQNVSGNVAGDWIRCFVDACVLMNKARFCIQESQTWESLPLSGFFDASTVSEDLKHKEILLLPTCCGSLCKYLMVASGRASVFLLRAKTQRTIKSWDHAVGIICVHEAGGKVTDWEGDEINLEEDQSERRLIFPAGGVVVSNGSLHNQILEMISSASPTL

SEQ ID NO: 2617 - DNA, 1236 bp, Populus balsamifera subsp. trichocarpa
  misc_feature (1)..(1236): Ceres ANNOT ID no. 1501773
  misc_feature 295148:<222: Transcription Factor
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: ROSETTE LEAVES - Other Useful for making ornamental plants with modified leaves
atgaatcttcttcaatcatcctcccagttttccaccgtccgattccttcacctccatccttcttcccccacacctctccgcacacgattcctccctgtgaggtcgagtcttcttccattcacaaatcaaaacgccaagtaccatagagaactcgaagctgcagtggatgttgtagagagagcgtgtcgtatctgcgttgacgtgaaaaagtctttgtattctagtgaaggacgtattgttgagaagaatgataacactcctgttacagttgctgattttggagtgcaggctttagtgagtttggaattgagtaaagtgttcccttctattccattggtggctgaagaggattctgattttgtccgttctaataatctggtggattctgttgtgagtgtggttactgataaagcaagctccaatgataagcctttgacaaatgctgatgttttggaagcaattgatagaggaggaaagaatgctattgtctatggaaccaggccagccacatactgggtactggatccaattgatggaaccaaagggtttttgaaaggaagtgaggccttgtatgtggtaggtttggctcttgtagttgaaggagacattgtattaggtgtcatgggctgccctaactggaaggaggctagttcctacaattccaccattgatgttcaaggatctgaaagtgtgccctccagatcagggattttaatggtggcccatgttggctgcggaacatgggcaaggcagctatcagatctgatgggtgtttctgccaaagtgcctaatggttggactaggtgctttgttgatggatgccatttagtacccaaagcacgtttttgcatttcggatagtcagacatgggagtcagtgccactatcagcatttttcagcgcaacaagtgatgctggcggtgtgagcgataaagagattctccttctgccgacatgttgtggaagtttgtgcaagtacttgatggtggcttcaggtagagcatcagtcttcattcttcgagcaagagctcagacaactatcaaggcttgggatcatgctgttggcataatatgtgtccatgaagcaggggggaaggtgactgactggaaaggcagtgatattgatcttgctgcagatcaagttgaaagaagaatcttattcccttcaatgggcgttcttgtgactaatggcactatacacaaccagatcctggagatgatttcttctacttcatga

SEQ ID NO: 2618 - protein, 411 aa, Populus balsamifera subsp. trichocarpa
  misc_feature (1)..(411): Ceres ANNOT ID no. 1501773
  misc_feature (50)..(213): Pfam Name: Inositol_P Pfam Description: Inositol monophosphatase family
  misc_feature: SWISSPROT Homolog: DPNPM_ARATH Putative PAP-specific phosphatase, mitochondrial precursor (3'(2'),5'-bisphosphate nucleotidase) with e-value of 9.2e-215 and BLAST sequence identity of 100.0
  misc_feature: SWISSPROT Homolog: DPNPM_ARATH EC 3.1.3.7 (3'(2'),5-bisphosphonucleoside 3'(2')- phosphohydrolase) (DPNPase)
  misc_feature: SWISSPROT Homolog: DPNP2_ARATH SAL2 phosphatase (3'(2'),5'-bisphosphate nucleotidase 2) with e-value of 3.7e-37 and BLAST sequence identity of 35.1
  misc_feature: SWISSPROT Homolog: DPNP2_ARATH EC 3.1.3.7 (3'(2'),5'-bisphosphonucleoside 3'(2')- phosphohydrolase 2) (DPNPase 2) (Inositol-1,4-bisphosphate 1- phosphatase 2)
  misc_feature: SWISSPROT Homolog: DPNP1_ARATH EC 3.1.3.57 (Inositol polyphosphate 1-phosphatase 2)
  misc_feature: SWISSPROT Homolog: DPNP_ORYSA 3'(2'),5'-bisphosphate nucleotidase (EC 3.1.3.7) (3' (2'),5-bisphosphonucleoside 3'(2')-phosphohydrolase) (DPNPase) with e-value of 4.2e-36 and BLAST sequence identity of 34.1
  misc_feature: SWISSPROT Homolog: DPNP1_ARATH SAL1 phosphatase (3'(2'),5'-bisphosphate nucleotidase 1) with e-value of 6.9e-36 and BLAST sequence identity of 33.5
  misc_feature: SWISSPROT Homolog: DPNP1_ARATH EC 3.1.3.7 (3'(2'),5'-bisphosphonucleoside 3'(2')- phosphohydrolase 1) (DPNPase 1) (Inositol-1,4-bisphosphate 1- phosphatase 1)
  misc_feature: SWISSPROT Homolog: DPNP1_ARATH EC 3.1.3.57 (Inositol polyphosphate 1-phosphatase 1)
  misc_feature: SWISSPROT Homolog: DPNP3_ARATH Probable SAL3 phosphatase (3'(2'),5'-bisphosphate nucleotidase 3) with e-value of 3.8e-35 and BLAST sequence identity of 32.5
  misc_feature: SWISSPROT Homolog: DPNP3_ARATH EC 3.1.3.7 (3'(2'),5'-bisphosphonucleoside 3'(2')- phosphohydrolase 3) (DPNPase 3) (Inositol-1,4-bisphosphate 1- phosphatase 3)
  misc_feature 295319:<222: Transcription Factor
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: ROSETTE LEAVES - Other Useful for making ornamental plants with modified leaves
  misc_feature (1)..(411): Functional Homolog of  Ceres CLONE ID no. 158702 at SEQ ID NO. 2663 with e-value of 8.20E-142 and BLAST sequence identity of 68.7
MNLLQSSSQFSTVRFLHLHPSSPTPLRTRFLPVRSSLLPFTNQNAKYHRELEAAVDVVERACRICVDVKKSLYSSEGRIVEKNDNTPVTVADFGVQALVSLELSKVFPSIPLVAEEDSDFVRSNNLVDSVVSVVTDKASSNDKPLTNADVLEAIDRGGKNAIVYGTRPATYWVLDPIDGTKGFLKGSEALYVVGLALVVEGDIVLGVMGCPNWKEASSYNSTIDVQGSESVPSRSGILMVAHVGCGTWARQLSDLMGVSAKVPNGWTRCFVDGCHLVPKARFCISDSQTWESVPLSAFFSATSDAGGVSDKEILLLPTCCGSLCKYLMVASGRASVFILRARAQTTIKAWDHAVGIICVHEAGGKVTDWKGSDIDLAADQVERRILFPSMGVLVTNGTIHNQILEMISSTS

SEQ ID NO: 2619 - protein, 148 aa, Arabidopsis thaliana
  misc_feature (1)..(148): Ceres CLONE ID no. 158734
  misc_feature (1)..(148): Also Known As Ceres CDNA ID no. 23385649
  misc_feature (1)..(148): Also Known As Ceres GEMINI ID 532C5
  misc_feature (91)..(145): Pfam Name: HTH_3 Pfam Description: Helix-turn-helix
  misc_feature 295464:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
MPSRYPEAVTQDWEPVVLHKSKQKSQDLRDPKAVNAALRNGVAVQTVKKFDAGSNKKGKSTAVPVINTKKLEEETEPAAMDRVKAEVRLMIQKARLEKKMSQADLAKQINERTQVVQEYENGKAVPNQAVLAKMEKVLGVKLRGKIGK

SEQ ID NO: 2620 - DNA, 438 bp, Populus balsamifera subsp. trichocarpa
  misc_feature (1)..(438): Ceres ANNOT ID no. 1477956
  misc_feature 295548:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
atgccaagcagatcagcaggagtaataaagcaggactgggagccggtggtgatgcacaaggcgaagcccaagtcccaagaccttcgcgatccgaaggtagtgaaccatgccctccgatcgggtgctccagtccagacaatcaagaaattcgacgctgggtctaataagaaagcaacggcaccagtggtgaatgccaggaagttggaggaggagacggagccagcggcgttggacaggatttctacggaggtgaggcaggcgattcaaaaagcgcggctggagaagaagatgagccagacagagcttgctaagctgattaatgagcagccaaaggtggtgcaagagtatgagaatggaaaggcggtgcctaaccaagctattttggccaagatggagagagtgctaggcgtgaagcttagagggaagactggcaagtga

SEQ ID NO: 2621 - protein, 145 aa, Populus balsamifera subsp. trichocarpa
  misc_feature (1)..(145): Ceres ANNOT ID no. 1477956
  misc_feature (88)..(142): Pfam Name: HTH_3 Pfam Description: Helix-turn-helix
  misc_feature: SWISSPROT Homolog: EDF1_XENLA Endothelial differentiation-related factor 1 homolog (EDF-1) with e-value of 1.3e-25 and BLAST sequence identity of 47.5
  misc_feature: SWISSPROT Homolog: EDF1_BRARE Endothelial differentiation-related factor 1 homolog (EDF-1) with e-value of 5.7e-25 and BLAST sequence identity of 45.3
  misc_feature: SWISSPROT Homolog: EDF1_MOUSE Endothelial differentiation-related factor 1 (EDF-1) (Multiprotein bridging factor 1) (MBF1) with e-value of 5.7e-25 and BLAST sequence identity of 46.0
  misc_feature: SWISSPROT Homolog: EDF1_RAT Endothelial differentiation-related factor 1 (EDF-1) with e-value of 5.7e-25 and BLAST sequence identity of 46.0
  misc_feature: SWISSPROT Homolog: EDF1_RAT Multiprotein bridging factor 1 (MBF1) Calmodulin-associated peptide 19 (CAP-19)
  misc_feature: SWISSPROT Homolog: EDF1_CHICK Endothelial differentiation-related factor 1 homolog (EDF-1) with e-value of 7.2e-25 and BLAST sequence identity of 46.8
  misc_feature 295671:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature (1)..(145): Functional Homolog of  Ceres CLONE ID no. 158734 at SEQ ID NO. 2666 with e-value of 7.40E-54 and BLAST sequence identity of 76.5
MPSRSAGVIKQDWEPVVMHKAKPKSQDLRDPKVVNHALRSGAPVQTIKKFDAGSNKKATAPVVNARKLEEETEPAALDRISTEVRQAIQKARLEKKMSQTELAKLINEQPKVVQEYENGKAVPNQAILAKMERVLGVKLRGKTGK

SEQ ID NO: 2622 - protein, 258 aa, Arabidopsis thaliana; identical to SEQ ID NO: 2574
  misc_feature (1)..(258): Ceres CLONE ID no. 159318
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems

SEQ ID NO: 2623 - DNA, 957 bp, Populus balsamifera subsp. trichocarpa; identical to SEQ ID NO: 1132
  misc_feature (1)..(957): Ceres ANNOT ID no. 1485362
  misc_feature 295843:<222: Transcription Factor
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems

SEQ ID NO: 2624 - protein, 318 aa, Populus balsamifera subsp. trichocarpa; identical to SEQ ID NO: 1133
  misc_feature (1)..(318): Ceres ANNOT ID no. 1485362
  misc_feature 295907:<222: Transcription Factor
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature (1)..(318): Functional Homolog of  Ceres CLONE ID no. 159318 at SEQ ID NO. 2669 with e-value of 1.59E-60 and BLAST sequence identity of 61.2

SEQ ID NO: 2625 - protein, 324 aa, Arabidopsis thaliana
  misc_feature (1)..(324): Ceres CLONE ID no. 205648
  misc_feature (19)..(146): Pfam Name: NAM Pfam Description: No apical meristem (NAM) protein
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Glossy Useful for making plants with enhanced abiotic stress tolerance
METEEEMKESSISMVEAKLPPGFRFHPKDDELVCDYLMRRSLHNNHRPPLVLIQVDLNKCEPWDIPKMACVGGKDWYFYSQRDRKYATGLRTNRATATGYWKATGKDRTILRKGKLVGMRKTLVFYQGRAPRGRKTDWVMHEFRLQGSHHPPNHSLSSPKEDWVLCRVFHKNTEGVICRDNMGSCFDETASASLPPLMDPYINFDQEPSSYLSDDHHYIINEHVPCFSNLSQNQTLNSNLTNSVSELKIPCKNPNPLFTGGSASATLTGLDSFCSSDQMVLRALLSQLTKIDGSLGPKESQSYGEGSSESLLTDIGIPSTVWNC

SEQ ID NO: 2626 - DNA, 909 bp, Populus balsamifera subsp. trichocarpa
  misc_feature (1)..(909): Ceres ANNOT ID no. 1456842
  misc_feature 296119:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Glossy Useful for making plants with enhanced abiotic stress tolerance
atgagcaacataagctttgtggaggcaaaactgccaccagggtttaggttccatccaagagatgaagagcttgtatgtgattacttgatgaagaaggcttctcactgcgactcccttctcatgatagaggtcgacctcaacaagtgtgagccttgggatattcctgaaacggcatgcgtgggaggcaaggaatggtacttttacagccaaagagatcgtaaatatgcaactggactaagaactaatcgagcaacagcatctggatattggaaggccaccgggaaggacagacatatcctacgtaagggaacccttgttggcatgagaaagaccttggtgttctaccaaggtagggcacctaaagggaaaaaaaccgattgggtcatgcatgagtttcggcttgaagggccacttggtcagcccaaaacttcttcagagaaggaagattgggtcttatgtcgagtgttctataaaaacaccagagaagttgtggccaaacctagcataagaagctgctatgatgacacaggctcttcatctttgcctgcattaatggattcatacatcacttttgaccaaactcaacccaatttagatgagcacgagcaagtgccctgcttctccattttctcccaaatccaaaccaaccaaaatttcccttacataactcaaatggaagtaccaaatttacccacaaagggtacaggcccatttgggcaagtacctatgaatattaccactcattcagacgctttttcttgtgacacaaaggtactaaaagctgttttgaatcacttcaacatgatggaaagcaatgccaacattaaagggtcaccaagcttaggagaaggtagttcagaaagctacttatctgatgtgggcatgcccaacttatggaatcattattga

SEQ ID NO: 2627 - protein, 302 aa, Populus balsamifera subsp. trichocarpa
  misc_feature (1)..(302): Ceres ANNOT ID no. 1456842
  misc_feature (11)..(135): Pfam Name: NAM Pfam Description: No apical meristem (NAM) protein
  misc_feature: SWISSPROT Homolog: NAC22_ARATH NAC domain-containing protein 21/22 (ANAC021) (ANAC022) with e-value of 2.8e-181 and BLAST sequence identity of 100.0
  misc_feature: SWISSPROT Homolog: NAC77_ORYSA NAC domain-containing protein 77 (ONAC077) (ONAC300) with e-value of 1.5e-49 and BLAST sequence identity of 56.7
  misc_feature: SWISSPROT Homolog: NAC68_ORYSA NAC domain-containing protein 68 (ONAC068) with e-value of 5.5e-43 and BLAST sequence identity of 51.6
  misc_feature: SWISSPROT Homolog: NAC94_ARATH Putative NAC domain-containing protein 94 (ANAC094) with e-value of 3.9e-41 and BLAST sequence identity of 49.1
  misc_feature: SWISSPROT Homolog: NAC9_ARATH Putative NAC domain-containing protein 9 (ANAC009) with e-value of 7.2e-41 and BLAST sequence identity of 42.2
  misc_feature 296243:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Glossy Useful for making plants with enhanced abiotic stress tolerance
  misc_feature (1)..(302): Functional Homolog of  Ceres CLONE ID no. 205648 at SEQ ID NO. 2672 with e-value of 8.29E-94 and BLAST sequence identity of 63.5
MSNISFVEAKLPPGFRFHPRDEELVCDYLMKKASHCDSLLMIEVDLNKCEPWDIPETACVGGKEWYFYSQRDRKYATGLRTNRATASGYWKATGKDRHILRKGTLVGMRKTLVFYQGRAPKGKKTDWVMHEFRLEGPLGQPKTSSEKEDWVLCRVFYKNTREVVAKPSIRSCYDDTGSSSLPALMDSYITFDQTQPNLDEHEQVPCFSIFSQIQTNQNFPYITQMEVPNLPTKGTGPFGQVPMNITTHSDAFSCDTKVLKAVLNHFNMMESNANIKGSPSLGEGSSESYLSDVGMPNLWNHY

SEQ ID NO: 2628 - DNA, 963 bp, Populus balsamifera subsp. trichocarpa
  misc_feature (1)..(963): Ceres ANNOT ID no. 1504224
  misc_feature 296354:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Glossy Useful for making plants with enhanced abiotic stress tolerance
atggctgtagaagatgatgagtttttttggcttgccttgtccgttgaaagggagaggaaaatgagcaacataagctttgtggaggcaaagttgccaccagggttcaggtttcatccaagagatgaagaacttgtatgcgattacttgatgaacaaggcttctcagtgctgtgattcccttcttatgatagaagttgacctcaacaagtgtgagccgtgggatatccctggtggcaaggaatggtatttttatagccaaagagatcgcaagtatgcaactggattgagaactaatcgtgcaacagcttctggatattggaaagccacagggaaggacaggcacgtccttcgcaagggcactcttgttggcatgagaaagaccttggtgttctaccaaggtagggcacccaaagggaaaagaactgactgggtcatgcatgagtttcgccttgaaggacctcttggtcccccaaaaatttcttcagataaggaagactgggttttatgccgagtgttctataaaagtaacagagaagttgtggccaaacctagcatggaaagctgcaataatgacacaggttcttcatctttgcctgcattattggattcatacatcacttatgagcaaactcaacccaatttagatgagcacgagcaagtgccctgcttctccattttctcacaaaaccaaaccagccaaaatctcctggctccgtacaccacccagatggaagccccgaacgccccggctaagtgtacgagcccatttggaaaagtacctatggatattaccactcccttggactctttttcttgtgacacaaaggtactaaaaactgttttgaataaccttaccaagatggaaagctatggcaaccttaaagggtcaccaagcttaggagaaggtagttcagagagctacatatctgaagtgggcatgtccagcttatggaatcattattga

SEQ ID NO: 2629 - protein, 320 aa, Populus balsamifera subsp. trichocarpa
  misc_feature (1)..(320): Ceres ANNOT ID no. 1504224
  misc_feature (31)..(151): Pfam Name: NAM Pfam Description: No apical meristem (NAM) protein
  misc_feature: SWISSPROT Homolog: NAC22_ARATH NAC domain-containing protein 21/22 (ANAC021) (ANAC022) with e-value of 2.8e-181 and BLAST sequence identity of 100.0
  misc_feature: SWISSPROT Homolog: NAC77_ORYSA NAC domain-containing protein 77 (ONAC077) (ONAC300) with e-value of 1.5e-49 and BLAST sequence identity of 56.7
  misc_feature: SWISSPROT Homolog: NAC68_ORYSA NAC domain-containing protein 68 (ONAC068) with e-value of 5.5e-43 and BLAST sequence identity of 51.6
  misc_feature: SWISSPROT Homolog: NAC94_ARATH Putative NAC domain-containing protein 94 (ANAC094) with e-value of 3.9e-41 and BLAST sequence identity of 49.1
  misc_feature: SWISSPROT Homolog: NAC9_ARATH Putative NAC domain-containing protein 9 (ANAC009) with e-value of 7.2e-41 and BLAST sequence identity of 42.2
  misc_feature 296480:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Glossy Useful for making plants with enhanced abiotic stress tolerance
  misc_feature (1)..(320): Functional Homolog of  Ceres CLONE ID no. 205648 at SEQ ID NO. 2672 with e-value of 1.39E-89 and BLAST sequence identity of 60.3
MAVEDDEFFWLALSVERERKMSNISFVEAKLPPGFRFHPRDEELVCDYLMNKASQCCDSLLMIEVDLNKCEPWDIPGGKEWYFYSQRDRKYATGLRTNRATASGYWKATGKDRHVLRKGTLVGMRKTLVFYQGRAPKGKRTDWVMHEFRLEGPLGPPKISSDKEDWVLCRVFYKSNREVVAKPSMESCNNDTGSSSLPALLDSYITYEQTQPNLDEHEQVPCFSIFSQNQTSQNLLAPYTTQMEAPNAPAKCTSPFGKVPMDITTPLDSFSCDTKVLKTVLNNLTKMESYGNLKGSPSLGEGSSESYISEVGMSSLWNHY

SEQ ID NO: 2630 - protein, 213 aa, Arabidopsis thaliana
  misc_feature (1)..(213): Ceres CLONE ID no. 206224
  misc_feature (9)..(200): Pfam Name: DUF597 Pfam Description: Protein of unknown function, DUF597
  misc_feature: Phenotype: WHOLE PLANT - Misc. Dwarf Useful for modulating plant size
  misc_feature: Phenotype: INFLORESCENCE - Short Useful for modulating plant height
  misc_feature: Phenotype: ROSETTE LEAVES - Short Petioles Useful for modulating plant size
MGAEEETNKTYPHWLKPLLREKFFVQCKLHADSHKSECNMYCLDRTNGPLCSLCLSFHKDHHAIQIRRSSYHDVIRVSEIQKFLDITGVQTYVINSAKVVFLNERPQPRPGKGVINTCEVCYRSLVDSFRFCSLGCKISGISKKKRKEWTNNLSDSDDSYSSTSIGRLKKNDDIMNNSFTPSTPPLSAVNRRIAKRRKGIPHRAPFGGLIIEY

SEQ ID NO: 2631 - DNA, 1053 bp, Populus balsamifera subsp. trichocarpa
  misc_feature (1)..(1053): Ceres ANNOT ID no. 1485509
  misc_feature 296681:<222: Transcription Factor
  misc_feature: Phenotype: WHOLE PLANT - Misc. Dwarf Useful for modulating plant size
  misc_feature: Phenotype: INFLORESCENCE - Short Useful for modulating plant height
  misc_feature: Phenotype: ROSETTE LEAVES - Short Petioles Useful for modulating plant size
atgaggtgggttccttgcacacaacgcatcttgatggcttattttaatagaggtttgggttcggagttaggcttggtggtttgtagactttctttgtgtgaagataagaacgactcccccccacccccctgcccccaatttaacccccctcctctctcagccgcctctgcttctcttaaactaaaagcctttctcccttcttttcttagcacacaacacaacatcctaaccctctgcccccctactttggacaaaccaggacgaattcgctcattttcttcaatttctctaaaactaagagtgctctgtttctctatacactcattcaagctggcgatcgaaaatcaagaaaccactatgaagcccaagaacaggagaataatgggagctggaggacctgatgatgaggacaacaggtggccgccatggcttaaacctttgttgagagagaggttctttgttcaatgcaagcagcacgctgattcacacaagagtgagtgcaatatgtattgtatggattgtatgaatggtgcgctttgctctctctgtcttgcctaccacaaggaccaccatgctattcagatacggaggtcttcatatcatgatgtgataagggtatctgaaatacagaaggtgctggacatctctggtgttcaaacttatgttatcaacagtgcaagagttgtgtttttgaatgagaggcctcagcctaggcctggaaaaggtgttaccaacacctgtgaggtctgcgagcgcagcctcctcgattccttccgcttctgctctcttgggtgcaagattgttgggacatcaaagaacttccagaagagaaagaagcaacaaatgtcaatggcgtcggattctgaggactcttatagtagtagcagcagccacgcgaggtacatgaagaagaacaacatcaacaatgagaacaaagtgcagagcttctctccttccacaccacctccaacaccagctagttaccggacggcaaagcgaagaaagggaatcccccaccgagccccaatgggaggactgataatagaatattag

SEQ ID NO: 2632 - protein, 231 aa, Populus balsamifera subsp. trichocarpa
  misc_feature (1)..(231): Ceres ANNOT ID no. 1485509
  misc_feature (19)..(218): Pfam Name: DUF597 Pfam Description: Protein of unknown function, DUF597
  misc_feature 296762:<222: Transcription Factor
  misc_feature: Phenotype: WHOLE PLANT - Misc. Dwarf Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature (1)..(231): Functional Homolog of  Ceres CLONE ID no. 206224 at SEQ ID NO. 2677 with e-value of 3.69E-82 and BLAST sequence identity of 75.8
MKPKNRRIMGAGGPDDEDNRWPPWLKPLLRERFFVQCKQHADSHKSECNMYCMDCMNGALCSLCLAYHKDHHAIQIRRSSYHDVIRVSEIQKVLDISGVQTYVINSARVVFLNERPQPRPGKGVTNTCEVCERSLLDSFRFCSLGCKIVGTSKNFQKRKKQQMSMASDSEDSYSSSSSHARYMKKNNINNENKVQSFSPSTPPPTPASYRTAKRRKGIPHRAPMGGLIIEY

SEQ ID NO: 2633 - DNA, 804 bp, Populus balsamifera subsp. trichocarpa
  misc_feature (1)..(804): Ceres ANNOT ID no. 1447022
  misc_feature 296854:<222: Transcription Factor
  misc_feature: Phenotype: WHOLE PLANT - Misc. Dwarf Useful for modulating plant size
  misc_feature: Phenotype: INFLORESCENCE - Short Useful for modulating plant height
  misc_feature: Phenotype: ROSETTE LEAVES - Short Petioles Useful for modulating plant size
atggagaatttatcgagtgctcgtgtttactgggacagtgaatttgagaggcattgtagatatttggtatatgtaatgtcattcaagctggcgatcgaaaaccaagaaaccactattaagcccaagaacagaagaataatgggagctggaggacctgatgatgaggaccacaggtggccgccatggctaaaacctttgttgcgcgagagattctttgttcaatgtaagatgcacgctgattcacacaagagtgaatgcaacatgtattgtttggattgtatgagtggtgctctttgctctctctgccttgcctaccacaaggatcaccgtgctattcagataaggaggtcctcataccatgatgtgataagggtttctgaaatacagaaggtgctagacatcactggtgtccaaacttatgttatcaacagtgctagagttgtgtttttgaacgagaggcctcagccaaggcctggaaaaggtgtaaccaacacctgcgaggtctgcgagcgcagcctcctcgattccttccgcttctgctctcttgggtgcaagattgttggtacttcaaagaacttccagaagaggaagaaacaacaaatgtccatggcatcggattcggaggactcttatagcagcagcagcagtcatgggcagtacatgaagacgaagaacaatgacaacaaagtgcagagcttctccccctctacaccacctccaacgcctgctagtcaccgggcagcaaagcgaagaaagggaatcccccaccgagccccaatgggaggactaataatagaatattag

SEQ ID NO: 2634 - protein, 267 aa, Populus balsamifera subsp. trichocarpa
  misc_feature (1)..(267): Ceres ANNOT ID no. 1447022
  misc_feature (57)..(254): Pfam Name: DUF597 Pfam Description: Protein of unknown function, DUF597
  misc_feature 296927:<222: Transcription Factor
  misc_feature: Phenotype: WHOLE PLANT - Misc. Dwarf Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature (1)..(267): Functional Homolog of  Ceres CLONE ID no. 206224 at SEQ ID NO. 2677 with e-value of 6.10E-82 and BLAST sequence identity of 75.8
MENLSSARVYWDSEFERHCRYLVYVMSFKLAIENQETTIKPKNRRIMGAGGPDDEDHRWPPWLKPLLRERFFVQCKMHADSHKSECNMYCLDCMSGALCSLCLAYHKDHRAIQIRRSSYHDVIRVSEIQKVLDITGVQTYVINSARVVFLNERPQPRPGKGVTNTCEVCERSLLDSFRFCSLGCKIVGTSKNFQKRKKQQMSMASDSEDSYSSSSSHGQYMKTKNNDNKVQSFSPSTPPPTPASHRAAKRRKGIPHRAPMGGLIIEY

SEQ ID NO: 2635 - protein, 311 aa, Arabidopsis thaliana
  misc_feature (1)..(311): Ceres CLONE ID no. 207419
  misc_feature (1)..(311): Also Known As Ceres CDNA ID no. 23371023
  misc_feature (1)..(311): Also Known As Ceres GEMINI ID 539D5
  misc_feature (272)..(298): Pfam Name: zf-CCCH Pfam Description: Zinc finger C-x8-C-x5-C-x3-H type (and similar)
  misc_feature 297045:<222: Transcription Factor
  misc_feature: Phenotype: Activates expression of the gene endogenous to the AtDXPR (SEQ ID NO 4143) regalutory region Useful for modulating Terpenoid Biosynthesis
MEKLAASTVTDLACVTAINSPPPPLSPISEQSFSNKHQEEFAASFASLYNSIFSPESQFSPSPPSSSSPPSRVDTTTEHRLLQAKLILEYDELNDHYELCLNRLQSLMTELDSLRHENDSLRFENSDLLKLIHISTSSSSSVSPPAPIHNRQFRHQISDSRSAKRNNQERNSLPKSISVRSQGYLKINHGFEASDRQTSQLSSNSVLSSQKVCVVQTKGEREALELEVYRQGMMKTELCNKWQETGACCYGDNCQFAHGIDELRPVIRHPRYKTEVCRMIVTGAMCPYGHRCHFRHSLTDQERMMMMMLTR

SEQ ID NO: 2636 - DNA, 930 bp, Populus balsamifera subsp. trichocarpa
  misc_feature (1)..(930): Ceres ANNOT ID no. 1517208
  misc_feature 297130:<222: Transcription Factor
  misc_feature: Phenotype: Activates expression of the gene endogenous to the AtDXPR (SEQ ID NO 4143) regalutory region Useful for modulating Terpenoid Biosynthesis
atgatgagagtggctagcaacctgcaacgagcaagtatactgagagggaattcattcagaaaggaaacgcaaaaagacacctcctccactttaaacagcgaaatcgccaccacccgtaccgcaacaaagttccaggactaccgtctaaacgacgttgcttacaactccgatatcttccccctctctcaagcctcccactcagtagacaactctcgcttcataatgcgacaccaggacctaataaaccgaagcgcactctgcctcgcgcgcctccgtgaagtaaccgtcgaaatggagtgtctccgccaagacaacgccgatcttcgatctatcaatcgcgagctcaacaatcaactcagcgtccttatccaagcctcactccacaaacactacaacgactctacaaggacgccgtttgacattgatattggtttccacaatttgtgcaacatcagcagcggaggaggtggaggtcatgacatgtgcgaagaggatgaaagtccgacgagcgtcatggaggcagggggcgatgaccgggagaggatttcgctgcctaagagtatttcagtgaggtctaatagctactcgaagaggaaccaggagcagaaggtttatgtgcgtagaggcaagaaacaggaggagccacttgagctggaagtgtataaccaaggcatgttcaaaacagagttgtgcaacaaatggcaggagacaggggcttgcctatacggcaaccattgtcagtttgctcatggaattgaggagctccgcccagtcatccgtcaccctcgctacaagactgaggtctgcaaaatggtccttgctggtggtatctgtccttatggccatcgctgtcacttccgccatgccctcacggagcaggacaggttccttagccacatcaagcccagggaaatcaagcctgacaggtaa

SEQ ID NO: 2637 - protein, 309 aa, Populus balsamifera subsp. trichocarpa
  misc_feature (1)..(309): Ceres ANNOT ID no. 1517208
  misc_feature (264)..(290): Pfam Name: zf-CCCH Pfam Description: Zinc finger C-x8-C-x5-C-x3-H type (and similar)
  misc_feature: SWISSPROT Homolog: TISB_HUMAN Butyrate response factor 1 (TIS11B protein) EGF-response factor 1 (ERF-1) with e-value of 7.7e-21 and BLAST sequence identity of 58.6
  misc_feature: SWISSPROT Homolog: TISB_MOUSE Butyrate response factor 1 (TIS11B protein) with e-value of 7.7e-21 and BLAST sequence identity of 58.6
  misc_feature: SWISSPROT Homolog: TISB_RAT Butyrate response factor 1 (TIS11B protein) (EGF-inducible protein CMG1) with e-value of 7.7e-21 and BLAST sequence identity of 58.6
  misc_feature: SWISSPROT Homolog: TISD_MOUSE Butyrate response factor 2 (TIS11D protein) with e-value of 1.0e-19 and BLAST sequence identity of 58.0
  misc_feature: SWISSPROT Homolog: TISD_HUMAN Butyrate response factor 2 (TIS11D protein) EGF-response factor 2 (ERF-2) with e-value of 3.6e-19 and BLAST sequence identity of 58.0
  misc_feature 297233:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(309): Functional Homolog of  Ceres CLONE ID no. 207419 at SEQ ID NO. 2682 with e-value of 4.60E-45 and BLAST sequence identity of 45.9
MMRVASNLQRASILRGNSFRKETQKDTSSTLNSEIATTRTATKFQDYRLNDVAYNSDIFPLSQASHSVDNSRFIMRHQDLINRSALCLARLREVTVEMECLRQDNADLRSINRELNNQLSVLIQASLHKHYNDSTRTPFDIDIGFHNLCNISSGGGGGHDMCEEDESPTSVMEAGGDDRERISLPKSISVRSNSYSKRNQEQKVYVRRGKKQEEPLELEVYNQGMFKTELCNKWQETGACLYGNHCQFAHGIEELRPVIRHPRYKTEVCKMVLAGGICPYGHRCHFRHALTEQDRFLSHIKPREIKPDR

SEQ ID NO: 2638 - protein, 405 aa, Arabidopsis thaliana
  misc_feature (1)..(405): Ceres CLONE ID no. 207684
  misc_feature (122)..(258): Pfam Name: PGAM Pfam Description: Phosphoglycerate mutase family
  misc_feature: Utility: MSX Useful for making plants tolerant to low nitrogen
  misc_feature: Phenotype: WHOLE PLANT - MSX Useful for making plants tolerant to low nitrogen
MGSSQSSQLLDEEEEEEDEAESEGEEVEEEEDEAESELNNRRIELDNLLVKKVLEQEPEMLPCHASASPLSPQLSSLGTPRIGPSIKVWDPYNVLAPPPPSSPPLFSRISSAAEHDRSAVTEVYFISHGECDLNLRPDLIGGRCHVATLTPNWKRQARALAVFLNSEGVRFTSVFSSPLDRARSMAVSVCQEMNFPEEHLQVSDAVVEMSLGDWESCHRSEIYTPETLSLIERCQPDFSAPSGESLRQVEFRMVQFLNGTVSGLSEKLRSELLPSTQHTNSRGFSLATSIHRPILTRKKSGKSRFQVMNATGDHEGSEEIFSNHNDEQHLGDINIKSSSSLLSTCIGVFTHSLPIKCLLTGILGCSPVMTHKICVEDSSVTVLQHSWKTGWQVKRLNDTAHLRLL

SEQ ID NO: 2639 - DNA, 1341 bp, Populus balsamifera subsp. trichocarpa
  misc_feature (1)..(1341): Ceres ANNOT ID no. 1471879
  misc_feature: Utility: MSX Useful for making plants tolerant to low nitrogen
  misc_feature 297444:<222: Transcription Factor
  misc_feature: Phenotype: WHOLE PLANT - MSX Useful for making plants tolerant to low nitrogen
atgggctccacccagtccgcccaagcagctcaagacgacggagaagaaagcgaagaagaagaagaagataaagacgacgacgaagaagaagaagaagaagagctggaacagcctaacgcgagagaaattactgacagcaacaataatttagtcaagaaggttctacaacaggagccagagatgctgccctgttacgcatcagcatcgcctctctctcctcagctctcatctctaggtacccctaggctcggcccttctatcaaggtgtgggacccttacaatgtcctcgcaccgccccctcccccgcccccgtcattgcctattttctcctcctcctccgatgaagttggcgttttggaggtgtttttgatcagtcacggagagtgcgagctcaatttgaggcctgatttagtcggtgggaggtgccacgtgtctgctctgactcccaatgggcagcgacaagctagggctcttgctgtcttcttcaactctcaaggggtcagcttccattccgtttactcgtcgcccctgaatcgtgctagatcaatggctgtctccgtttgtcaggtgatgaaactactaatgattttgatattggaaaaatacttaagtggagcgaattgtccagatataaaaatcttgcaggaaatgaattttgccaaggagcaaatacaatcatcggatgcactcatggatttgagcatggggctttgggaaggttgctccctttcagatatatatacacctgaagttcagagcctgcttgaaaatcttcagcccgatttttgtgcaccatctggagaatcaattaggcaagtggaatttaggatggttcagttcctaaataggacagtcctgggaatgcctgaaaagttgggatcagatttcttgttgcaccatcaaaatgagagccatgggttttctcatgacagagatgggccttctctaccaccaccttcaaattgggatatgcagcatatgcttcataggcaccgacagggcctcgcaaggaaaaagtctggtaagagcaggctacagtttgtgactactactggcaatcacgagggtgaggatgagatctcacttagggaagccagccaccaacacacgatccatgatttgaatatcaggaactcatcctccccagtatcttcatgtgtgggtgttttcacgcattcaattcctattaagtgtctactcacaggcatcctagggtgcagcccagtaatgatgcgtaagatctgcatagaagattcttcggtgacagtgttacagcattcatgtaaaacaggttggcagattaaacgcttgaatgatactgcacatctgagacttctctag

SEQ ID NO: 2640 - protein, 446 aa, Populus balsamifera subsp. trichocarpa
  misc_feature (1)..(446): Ceres ANNOT ID no. 1471879
  misc_feature (216)..(283): Pfam Name: PGAM Pfam Description: Phosphoglycerate mutase family
  misc_feature: Utility: MSX Useful for making plants tolerant to low nitrogen
  misc_feature 297527:<222: Transcription Factor
  misc_feature: Phenotype: WHOLE PLANT - MSX Useful for making plants tolerant to low nitrogen
  misc_feature (1)..(446): Functional Homolog of  Ceres CLONE ID no. 207684 at SEQ ID NO. 2685 with e-value of 7.70E-130 and BLAST sequence identity of 68.8
MGSTQSAQAAQDDGEESEEEEEDKDDDEEEEEEELEQPNAREITDSNNNLVKKVLQQEPEMLPCYASASPLSPQLSSLGTPRLGPSIKVWDPYNVLAPPPPPPPSLPIFSSSSDEVGVLEVFLISHGECELNLRPDLVGGRCHVSALTPNGQRQARALAVFFNSQGVSFHSVYSSPLNRARSMAVSVCQVMKLLMILILEKYLSGANCPDIKILQEMNFAKEQIQSSDALMDLSMGLWEGCSLSDIYTPEVQSLLENLQPDFCAPSGESIRQVEFRMVQFLNRTVLGMPEKLGSDFLLHHQNESHGFSHDRDGPSLPPPSNWDMQHMLHRHRQGLARKKSGKSRLQFVTTTGNHEGEDEISLREASHQHTIHDLNIRNSSSPVSSCVGVFTHSIPIKCLLTGILGCSPVMMRKICIEDSSVTVLQHSCKTGWQIKRLNDTAHLRLL

SEQ ID NO: 2641 - protein, 153 aa, Zea mays
  misc_feature (1)..(153): Ceres CLONE ID no. 208303
  misc_feature (1)..(153): Also Known As Ceres CDNA ID no. 23849426
  misc_feature (1)..(153): Also Known As Ceres GEMINI ID 538A5
  misc_feature (47)..(97): Pfam Name: TFIID_30kDa Pfam Description: Transcription initiation factor TFIID 23-30kDa subunit
  misc_feature 297665:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtPES (SEQ ID NO 4142) regalutory region Useful for modulating Terpenoid Biosynthesis
MMNNNSGGGAGGPGGGMGTGVGGGGDGRHDDEAALTEFLSSLMDYTPTIPDELVEHYLGRSGFHCPDLRLTRLVAVATQKFLSDIASDSLQHCKARVAAPIKDNKSKQPKDRRLVLTMDDLSKALREHGVNLKHAEYFADSPSAGMAPSTREE

SEQ ID NO: 2642 - DNA, 435 bp, Populus balsamifera subsp. trichocarpa
  misc_feature (1)..(435): Ceres ANNOT ID no. 1477838
  misc_feature 297727:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtPES (SEQ ID NO 4142) regalutory region Useful for modulating Terpenoid Biosynthesis
atgaacaacacgagcagcagtaacagtcagcaacagcagcaatcaagtgaagcaaggcatgatgatgatgccgttctcactgaattcctcgcttctttaatggattacactcccactattcctgatgaattagtggagcattacttggctaaaagtgggtttcaatgtcctgatgtcagattggttagattagtagctgttgcgacacagaagtttgttgcagatgttgcaactgatgctcttcagcaatgcaaggcacggccggcaccagtagttaaagacaaaagggacaagcagcaaaaggaaaagcgcctaattttgacaatggaggatctgtcgaaggctctgagtgagtatggtgtaaacgtgaagcaccaggagtattttgctgatagcccatcgactgggatggatcctgcttcaagagaagagtga

SEQ ID NO: 2643 - protein, 144 aa, Populus balsamifera subsp. trichocarpa
  misc_feature (1)..(144): Ceres ANNOT ID no. 1477838
  misc_feature (38)..(88): Pfam Name: TFIID_30kDa Pfam Description: Transcription initiation factor TFIID 23-30kDa subunit
  misc_feature: SWISSPROT Homolog: TAF10_HUMAN Transcription initiation factor TFIID subunit 10 transduction-associated protein 3 with e-value of 2.4e-26 and BLAST sequence identity of 46.0
  misc_feature: SWISSPROT Homolog: TAF10_HUMAN Transcription initiation factor TFIID 30 kDa subunit TAF(II)30 (TAFII-30) (TAFII30) (STAF28)
  misc_feature: SWISSPROT Homolog: TAFAB_DROME Transcription initiation factor TFIID subunit 10b with e-value of 3.9e-26 and BLAST sequence identity of 43.4
  misc_feature: SWISSPROT Homolog: TAFAB_DROME Transcription initiation factor TFIID 16 kDa subunit TAFII-16 (TAFII16) (dTAF(II)16)
  misc_feature: SWISSPROT Homolog: TAF10_MOUSE Transcription initiation factor TFIID subunit 10 with e-value of 4.9e-26 and BLAST sequence identity of 45.3
  misc_feature: SWISSPROT Homolog: TAF10_MOUSE Transcription initiation factor TFIID 30 kDa subunit TAF(II)30 (TAFII-30) (mTAFII30)
  misc_feature: SWISSPROT Homolog: TAF10_DROME Transcription initiation factor TFIID subunit 10 with e-value of 1.4e-21 and BLAST sequence identity of 43.9
  misc_feature: SWISSPROT Homolog: TAF10_DROME Transcription initiation factor TFIID 24 kDa subunit TAFII-24 (TAFII24) (dTAF(II)24)
  misc_feature: SWISSPROT Homolog: TAF10_YEAST Transcription initiation factor TFIID subunit 10 with e-value of 6.6e-18 and BLAST sequence identity of 38.8
  misc_feature: SWISSPROT Homolog: TAF10_YEAST TBP-associated factor 10 TBP-associated factor 25 kDa TAFII-23 (TAFII23) (TAFII-25) (TAFII25) (p25)
  misc_feature 297859:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtPES (SEQ ID NO 4142) regalutory region Useful for modulating Terpenoid Biosynthesis
  misc_feature (1)..(144): Functional Homolog of  Ceres CLONE ID no. 208303 at SEQ ID NO. 2688 with e-value of 1.09E-48 and BLAST sequence identity of 71.8
MNNTSSSNSQQQQQSSEARHDDDAVLTEFLASLMDYTPTIPDELVEHYLAKSGFQCPDVRLVRLVAVATQKFVADVATDALQQCKARPAPVVKDKRDKQQKEKRLILTMEDLSKALSEYGVNVKHQEYFADSPSTGMDPASREE

SEQ ID NO: 2644 - protein, 212 aa, Zea mays
  misc_feature (1)..(212): Ceres CLONE ID no. 208429
  misc_feature (1)..(212): Also Known As Ceres CDNA ID no. 23740209
  misc_feature (1)..(212): Also Known As Ceres GEMINI ID 538B5
  misc_feature (93)..(152): Pfam Name: HMG_box Pfam Description: HMG (high mobility group) box
  misc_feature 297949:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
MAGGKSTGNAARSRKRVEATVLKRSRDGSAFTRCEACNKDVPVVLIDMHSCSLDEKIRMTLEAQVVEKTVEVASADRKKSSAKGGGNKDAKRKRSPTAFFLFMDDFRKEFKATHPDNKSVATVAKEGGERWKSMTDEEKKPYIEKAAELKAEAENGEGSGENNVATKKAKTDDQEVDQPAKKLRKCKALHEDEDDDGDQEDEDEKNELDDDM

SEQ ID NO: 2645 - DNA, 606 bp, Populus balsamifera subsp. trichocarpa
  misc_feature (1)..(606): Ceres ANNOT ID no. 1457538
  misc_feature 298024:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
atggcaaggaagagagtggaggctgagtctacagatgggtctgttgatgccaatactaccacttcacttgttcgtgcgaaagatggcagtgcttttactaagtgtgaggagtgcaagaaggatgtgccagtggctcttataagtttccacagctgtagccttgatgctaagatcaagatgaatttggaggctcaagttgttgaaaagccaactgaagctaagcagaaaccagctgagaggaagaaaggaagttcaactgagccaaaattgaagaaagctaaaaaagaaaagaagggcagggatccaaatgcaccgaaacgccctcccactgcattctttctctttatggatgactttaggaaggaatacaaggaagcgaacccggactctaaggatgttaagaaggttgcgaaggaaggtggtgtgagatggaagtcaatgaccgatgaagagaagaagcaatatgtggataaggctgctgagctcaaggcagagaatgacaaggcattggagagtgacaacgctgaaaatgaagatgacgaaggggtttcttcagagaaggaagtagccgatcttgaactgcgagataaagaggaggaaatttga

SEQ ID NO: 2646 - protein, 201 aa, Populus balsamifera subsp. trichocarpa
  misc_feature (1)..(201): Ceres ANNOT ID no. 1457538
  misc_feature (143)..(170): Pfam Name: DUF1289 Pfam Description: Protein of unknown function (DUF1289)
  misc_feature: SWISSPROT Homolog: MNB1B_MAIZE DNA-binding protein MNB1B (HMG1-like protein) with e-value of 1.9e-24 and BLAST sequence identity of 40.3
  misc_feature: SWISSPROT Homolog: HMGL_WHEAT HMG1/2-like protein with e-value of 6.5e-24 and BLAST sequence identity of 41.1
  misc_feature: SWISSPROT Homolog: HMGL_VICFA HMG1/2-like protein with e-value of 1.2e-23 and BLAST sequence identity of 42.9
  misc_feature: SWISSPROT Homolog: HMGL_IPONI HMG1/2-like protein with e-value of 7.7e-21 and BLAST sequence identity of 40.8
  misc_feature: SWISSPROT Homolog: HMGL_SOYBN HMG1/2-like protein (SB11 protein) with e-value of 1.3e-20 and BLAST sequence identity of 36.8
  misc_feature 298122:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature (1)..(201): Functional Homolog of  Ceres CLONE ID no. 208429 at SEQ ID NO. 2691 with e-value of 2.59E-42 and BLAST sequence identity of 63.3
MARKRVEAESTDGSVDANTTTSLVRAKDGSAFTKCEECKKDVPVALISFHSCSLDAKIKMNLEAQVVEKPTEAKQKPAERKKGSSTEPKLKKAKKEKKGRDPNAPKRPPTAFFLFMDDFRKEYKEANPDSKDVKKVAKEGGVRWKSMTDEEKKQYVDKAAELKAENDKALESDNAENEDDEGVSSEKEVADLELRDKEEEI

SEQ ID NO: 2647 - DNA, 549 bp, Populus balsamifera subsp. trichocarpa
  misc_feature (1)..(549): Ceres ANNOT ID no. 1510743
  misc_feature 298202:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
atggcaaggaagagagtggaggctgagtctacagatgggtctgttgatgccaatactaccacttcacttgttcgtgcgaaagatggcagtgcttttactaagtgtgaggagtgcaagaaggatgtgccagtggctcttataagtttccacagctgtagccttgatgctaagatcaagatgaatttggaggctcaagttgttgaaaagccaactgaagctaagcagaaaccagctgagaggaagaaaggaagttcaactgagccaaaattgaagaaagctaaaaaagaaaagaagggcagggatccaaatgcaccgaaacgccctcccactgcattctttctctttatggatgactttaggaaggaatacaaggaagcgaacccggactctaaggatgttaagaaggttgcgaaggaaggtggtgtgagatggaagtcaatgaccgatgaagagaagaagcaatatgtggataaggctgctgagctcaaggcagagaatgacaaggcattggagagtgacaacgctgaaaatgaagatagaaggaagtag

SEQ ID NO: 2648 - protein, 182 aa, Populus balsamifera subsp. trichocarpa
  misc_feature (1)..(182): Ceres ANNOT ID no. 1510743
  misc_feature (143)..(170): Pfam Name: DUF1289 Pfam Description: Protein of unknown function (DUF1289)
  misc_feature: SWISSPROT Homolog: MNB1B_MAIZE DNA-binding protein MNB1B (HMG1-like protein) with e-value of 1.9e-24 and BLAST sequence identity of 40.3
  misc_feature: SWISSPROT Homolog: HMGL_WHEAT HMG1/2-like protein with e-value of 6.5e-24 and BLAST sequence identity of 41.1
  misc_feature: SWISSPROT Homolog: HMGL_VICFA HMG1/2-like protein with e-value of 1.2e-23 and BLAST sequence identity of 42.9
  misc_feature: SWISSPROT Homolog: HMGL_IPONI HMG1/2-like protein with e-value of 7.7e-21 and BLAST sequence identity of 40.8
  misc_feature: SWISSPROT Homolog: HMGL_SOYBN HMG1/2-like protein (SB11 protein) with e-value of 1.3e-20 and BLAST sequence identity of 36.8
  misc_feature 298298:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature (1)..(182): Functional Homolog of  Ceres CLONE ID no. 208429 at SEQ ID NO. 2691 with e-value of 1.79E-41 and BLAST sequence identity of 63.7
MARKRVEAESTDGSVDANTTTSLVRAKDGSAFTKCEECKKDVPVALISFHSCSLDAKIKMNLEAQVVEKPTEAKQKPAERKKGSSTEPKLKKAKKEKKGRDPNAPKRPPTAFFLFMDDFRKEYKEANPDSKDVKKVAKEGGVRWKSMTDEEKKQYVDKAAELKAENDKALESDNAENEDRRK

SEQ ID NO: 2649 - protein, 317 aa, Zea mays
  misc_feature (1)..(317): Ceres CLONE ID no. 223419
  misc_feature (1)..(317): Also Known As Ceres CDNA ID no. 23751503
  misc_feature (1)..(317): Also Known As Ceres GEMINI ID 552G8
  misc_feature (254)..(303): Pfam Name: Myb_DNA-binding Pfam Description: Myb-like DNA-binding domain
  misc_feature 298395:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
MEFIDPWDSQSRARVVHSGANSTSFSSSTAKAPLSLRHAASCAAAAVALLAAAFYLLPTYQILSSLLIWIASSLLLAPFAPLSATGGDISVGRGRVVPAPEPAPEPTPEPTPAPRRGRRQNPVPTPTKPSDPGTPPVQSAASLHPLQKATTAGGAVVDGGEREEDAGEWTDQELELLRRQMVKHPAGEPQRWEKIAAVFGGRRTPENVIRAAKSGAPAAGGSSFEQFLRKRKPLDPRAEVADTADDAGGAESADAAWSAGDDRALLNALKEFPKDTAMRWEKVAASVPGKTKAACMKRITELKRDFRSTKTASEAAP

SEQ ID NO: 2650 - DNA, 945 bp, Populus balsamifera subsp. trichocarpa
  misc_feature (1)..(945): Ceres ANNOT ID no. 1485423
  misc_feature 298481:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atggagtttttagacgaggacgccagacctcgattcctctttcaatctcgcccgatcccatcttcactaaccaatacccaaacccaacaaaaaccacttaacaaatggttcctcttcctatcaatctctctctcttcccttttgttgcttctctcatttctctacctccaaacagaaccaatcagatccctcctcttctgggtctccatctccctcctcgttggccctttcgctccctctcacctcactggaggtgacattcgtgttggtcaaggcccaatccttgaacccctagaacaagaacccgaatttgtagaagaaaaacaagctagaaaaaagagatcaaaaccgattagatctgaagagattgtgaagaatccgattcaaaatgtggaaataacaaatgggttgtcgactaaagggaaaaaggctgaaactttggctagtggtgaaaagggtttggtgagaaatgagggagagaaggagtggaatgaagaggattcggagattctgaagaaacaaatggtgaagaatcctgtagggaagccaaggagatgggaggtgattgcggaggcatttaatgggaggtatagagtggagagtgtgataaagaaagctaaagaattgggagagaagaagatggatgatagtgattcctatgcgagatttttgaagaacaggaagccactggatacaagagctgaaagtgggagtcaaggattggagagtgatgaaagtgggcaggaggttggtggtggattggggtggactacaggagaggatattgctttgttaaatgcattgaaagtattttctaaggatgtggcaatgaggtgggagaagattgcagctgctgttccggggaagtcaaaggcagcttgtatgaaaagagtcactgaattgaaaaaggattttcggagctcgaaagctggttctgaaagttag

SEQ ID NO: 2651 - protein, 314 aa, Populus balsamifera subsp. trichocarpa
  misc_feature (1)..(314): Ceres ANNOT ID no. 1485423
  misc_feature (253)..(302): Pfam Name: Myb_DNA-binding Pfam Description: Myb-like DNA-binding domain
  misc_feature: SWISSPROT Homolog: ZRF1_HUMAN Zuotin-related factor 1 (M-phase phosphoprotein 11) with e-value of 1.0e-12 and BLAST sequence identity of 32.7
  misc_feature: SWISSPROT Homolog: YMA9_CAEEL Hypothetical protein F54F2.9 in chromosome III with e-value of 3.3e-12 and BLAST sequence identity of 27.1
  misc_feature: SWISSPROT Homolog: DNJC1_HUMAN DnaJ homolog subfamily C member 1 with e-value of 1.0e-10 and BLAST sequence identity of 46.2
  misc_feature 298567:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(314): Functional Homolog of  Ceres CLONE ID no. 223419 at SEQ ID NO. 2696 with e-value of 3.19E-53 and BLAST sequence identity of 42.8
MEFLDEDARPRFLFQSRPIPSSLTNTQTQQKPLNKWFLFLSISLSSLLLLLSFLYLQTEPIRSLLFWVSISLLVGPFAPSHLTGGDIRVGQGPILEPLEQEPEFVEEKQARKKRSKPIRSEEIVKNPIQNVEITNGLSTKGKKAETLASGEKGLVRNEGEKEWNEEDSEILKKQMVKNPVGKPRRWEVIAEAFNGRYRVESVIKKAKELGEKKMDDSDSYARFLKNRKPLDTRAESGSQGLESDESGQEVGGGLGWTTGEDIALLNALKVFSKDVAMRWEKIAAAVPGKSKAACMKRVTELKKDFRSSKAGSES

SEQ ID NO: 2652 - protein, 138 aa, Zea mays
  misc_feature (1)..(138): Ceres CLONE ID no. 224062
  misc_feature: Phenotype: WHOLE PLANT - High Anthocyanin Useful for modulating anthocyanin content
MASAPADSYGCAACGAPLNLSAAHLYPADFYFEAGNKGTLSFSWVDESRLRFAPEDRIRPFFETLNYWGIQRKRTRISCDACGHLLGHVYDDGPPAMQGTGQFGMGPSQVIPRRPRYRFKIKAIAASSSAPAAAAYEK

SEQ ID NO: 2653 - DNA, 381 bp, Populus balsamifera subsp. trichocarpa
  misc_feature (1)..(381): Ceres ANNOT ID no. 1541034
  misc_feature 298710:<222: Transcription Factor
  misc_feature: Phenotype: WHOLE PLANT - High Anthocyanin Useful for modulating anthocyanin content
atggcgtccatctacacttgcatagaatgtggaacaaacctgaatctaaacacaacccatctctacccacaagacttctactttgaagcaggaaacaaaggcaccctctcattttcttcaatagactcgacaaaattcaagtttgaagaagaagacaagatcaggccattttttgagacggtgaactactggggcattcaaagaaagagaaccaagattaagtgtaatagctgtggctgtcttgttggttatatctatgatgatgggcagccttcaactattagtcctggtcagtttggtcttggtcctagtcaggctattccaagggctcctagatataggttcaagactaaggctcttaggattgcttctgaaacttga

SEQ ID NO: 2654 - protein, 126 aa, Populus balsamifera subsp. trichocarpa
  misc_feature (1)..(126): Ceres ANNOT ID no. 1541034
  misc_feature 298749:<222: Transcription Factor
  misc_feature: Phenotype: WHOLE PLANT - High Anthocyanin Useful for modulating anthocyanin content
  misc_feature (1)..(126): Functional Homolog of  Ceres CLONE ID no. 224062 at SEQ ID NO. 2699 with e-value of 2.29E-43 and BLAST sequence identity of 64.2
MASIYTCIECGTNLNLNTTHLYPQDFYFEAGNKGTLSFSSIDSTKFKFEEEDKIRPFFETVNYWGIQRKRTKIKCNSCGCLVGYIYDDGQPSTISPGQFGLGPSQAIPRAPRYRFKTKALRIASET

SEQ ID NO: 2655 - protein, 84 aa, Zea mays
  misc_feature (1)..(84): Ceres CLONE ID no. 225200
  misc_feature: Phenotype: ROSETTE LEAVES - Corkscrew Useful for making plants with altered leaf shape eg curled leaves
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: ROSETTE LEAVES - Serrate Margins Useful for making plants with increased biomass and foliage
MGSKPGEAPTWADQWASGEGDGSIANGKAAGKRTVAGNVKAAASEGLVKAKAAALVGAHKLKTGTSSGIKWVREQYQKKRTSSK

SEQ ID NO: 2656 - DNA, 249 bp, Populus balsamifera subsp. trichocarpa
  misc_feature (1)..(249): Ceres ANNOT ID no. 1471976
  misc_feature 298867:<222: Transcription Factor
  misc_feature: Phenotype: ROSETTE LEAVES - Corkscrew Useful for making plants with altered leaf shape eg curled leaves
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: ROSETTE LEAVES - Serrate Margins Useful for making plants with increased biomass and foliage
atgggaagcaaggcgccaggctgggctgatcagtggggttcaggaagtttcagcaaggaagacgatgagaaattcatggcgaaaatagggcataacaatggtaacgccagcaagaagatggcgggggtcaaggcagcagcttcaacaggactcgacaaggccaagacagctgctcagaaggtaaagagtggaacttcggtgggtatcaaatgggtcaagaacaagtaccagaagaagacttcaaaataa

SEQ ID NO: 2657 - protein, 82 aa, Populus balsamifera subsp. trichocarpa
  misc_feature (1)..(82): Ceres ANNOT ID no. 1471976
  misc_feature 298923:<222: Transcription Factor
  misc_feature: Phenotype: ROSETTE LEAVES - Corkscrew Useful for making plants with altered leaf shape eg curled leaves
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: ROSETTE LEAVES - Serrate Margins Useful for making plants with increased biomass and foliage
  misc_feature (1)..(82): Functional Homolog of  Ceres CLONE ID no. 225200 at SEQ ID NO. 2702 with e-value of 7.50E-13 and BLAST sequence identity of 63.3
MGSKAPGWADQWGSGSFSKEDDEKFMAKIGHNNGNASKKMAGVKAAASTGLDKAKTAAQKVKSGTSVGIKWVKNKYQKKTSK

SEQ ID NO: 2658 - DNA, 255 bp, Populus balsamifera subsp. trichocarpa
  misc_feature (1)..(255): Ceres ANNOT ID no. 1465507
  misc_feature 298995:<222: Transcription Factor
  misc_feature: Phenotype: ROSETTE LEAVES - Corkscrew Useful for making plants with altered leaf shape eg curled leaves
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: ROSETTE LEAVES - Serrate Margins Useful for making plants with increased biomass and foliage
atggcaagtgaggccccaagctgggcagatcaatggggtgcaggaggtattggttcaatggaagatgacaattacactgggaccaagcaacataccagcaacaagaagaaggtagatgccaaagggggattaaacaaagccaaggcagctgctatgtctggagctcaaaagctcagaagtggagcatccaacagcttcaaatgggttaaaatctacgaggttgttagaaagcttgctgactcacaaaatatataa

SEQ ID NO: 2659 - protein, 84 aa, Populus balsamifera subsp. trichocarpa
  misc_feature (1)..(84): Ceres ANNOT ID no. 1465507
  misc_feature 299051:<222: Transcription Factor
  misc_feature: Phenotype: ROSETTE LEAVES - Corkscrew Useful for making plants with altered leaf shape eg curled leaves
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: ROSETTE LEAVES - Serrate Margins Useful for making plants with increased biomass and foliage
  misc_feature (1)..(84): Functional Homolog of  Ceres CLONE ID no. 225200 at SEQ ID NO. 2702 with e-value of 1.09E-11 and BLAST sequence identity of 50.0
MASEAPSWADQWGAGGIGSMEDDNYTGTKQHTSNKKKVDAKGGLNKAKAAAMSGAQKLRSGASNSFKWVKIYEVVRKLADSQNI

SEQ ID NO: 2660 - protein, 106 aa, Zea mays
  misc_feature (1)..(106): Ceres CLONE ID no. 225321
  misc_feature (1)..(106): Also Known As Ceres CDNA ID no. 23748264
  misc_feature (1)..(106): Also Known As Ceres GEMINI ID 552C9
  misc_feature (2)..(50): Pfam Name: TFIIA_gamma_N Pfam Description: Transcription initiation factor IIA gamma subunit, helical domain
  misc_feature (52)..(101): Pfam Name: TFIIA_gamma_C Pfam Description: Transcription initiation factor IIA gamma subunit, beta-barrel domain
  misc_feature 299151:<222: Transcription Factor
  misc_feature: Phenotype: Activates expression of the gene endogenous to the AtDXPR (SEQ ID NO 4143) regalutory region Useful for modulating Terpenoid Biosynthesis
MATFELYRRSTIGMCLTETLDEMVSNGTLSPELAIQVLVQFDKSMTDALENQVKSKVTVKGHLHTYRFCDNVWTFILTDASFKNEEATEQVGKVKIVACDSKLLGQ

SEQ ID NO: 2661 - DNA, 321 bp, Populus balsamifera subsp. trichocarpa
  misc_feature (1)..(321): Ceres ANNOT ID no. 1504670
  misc_feature 299197:<222: Transcription Factor
  misc_feature: Phenotype: Activates expression of the gene endogenous to the AtDXPR (SEQ ID NO 4143) regalutory region Useful for modulating Terpenoid Biosynthesis
atggcgacgtttgagctgtatagaagatcgacgatcgggatgtgcttgacggagactcttgatgacatggttcaaaacggtactctcagtcctgagctagccttccaggttcttgttcagtttgataagtccatgactgaagctttggaaacaaaagtgaagagcaaagtctcaattaagggacatctgcatacctacagattctgcgacaatgtttggaccttcattttacaggatgctatgtttaagaatgaggacacgcaggagaatgttgggcgggttaaaatagtggcatgcgactcaaagctgcttacgcaatga

SEQ ID NO: 2662 - protein, 106 aa, Populus balsamifera subsp. trichocarpa
  misc_feature (1)..(106): Ceres ANNOT ID no. 1504670
  misc_feature (2)..(50): Pfam Name: TFIIA_gamma_N Pfam Description: Transcription initiation factor IIA gamma subunit, helical domain
  misc_feature (52)..(101): Pfam Name: TFIIA_gamma_C Pfam Description: Transcription initiation factor IIA gamma subunit, beta-barrel domain
  misc_feature: SWISSPROT Homolog: T2AG_ORYSA Transcription initiation factor IIA gamma chain (TFIIA-gamma) with e-value of 1.5e-49 and BLAST sequence identity of 93.4
  misc_feature: SWISSPROT Homolog: T2AG_ARATH Transcription initiation factor IIA gamma chain (TFIIA-gamma) with e-value of 6.1e-44 and BLAST sequence identity of 83.0
  misc_feature: SWISSPROT Homolog: T2AG_ONCMY Transcription initiation factor IIA gamma chain TFIIA P12 subunit (TFIIA-12) (TFIIAS) (TFIIA-gamma) with e-value of 3.9e-26 and BLAST sequence identity of 52.0
  misc_feature: SWISSPROT Homolog: T2AG_MOUSE Putative transcription initiation factor IIA gamma chain TFIIA P12 subunit (TFIIA-12) (TFIIAS) (TFIIA-gamma) with e-value of 1.7e-25 and BLAST sequence identity of 51.9
  misc_feature: SWISSPROT Homolog: T2AG_RAT Transcription initiation factor IIA gamma chain TFIIA P12 subunit (TFIIA-12) (TFIIAS) (TFIIA-gamma) with e-value of 1.7e-25 and BLAST sequence identity of 51.9
  misc_feature 299288:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(106): Functional Homolog of  Ceres CLONE ID no. 225321 at SEQ ID NO. 2707 with e-value of 3.59E-45 and BLAST sequence identity of 84.9
MATFELYRRSTIGMCLTETLDDMVQNGTLSPELAFQVLVQFDKSMTEALETKVKSKVSIKGHLHTYRFCDNVWTFILQDAMFKNEDTQENVGRVKIVACDSKLLTQ

SEQ ID NO: 2663 - DNA, 354 bp, Populus balsamifera subsp. trichocarpa
  misc_feature (1)..(354): Ceres ANNOT ID no. 1451585
  misc_feature 299342:<222: Transcription Factor
  misc_feature: Phenotype: Activates expression of the gene endogenous to the AtDXPR (SEQ ID NO 4143) regalutory region Useful for modulating Terpenoid Biosynthesis
atggcgacgtttgagctgtatagaagatcgacgatcgggatgtgcttgacggagactcttgatgacatggttcaaaacggtactctcagtcctgagctagccttccaggttcttgttcagtttgataagtccatgactgaagctttggaaacaaaagtgaagagcaaagtctcaattaagggacatctgcatacctacagattctgcgacaatgtttggaccttcattttacaggatgctatgtttaagaatgaggacacgcaggagaatgttgggcggtttaacgtgggtgtccgggccagcttgcgcgcacctcgactaatcccacgggctctaaagttaacgaccatgtaa

SEQ ID NO: 2664 - protein, 117 aa, Populus balsamifera subsp. trichocarpa
  misc_feature (1)..(117): Ceres ANNOT ID no. 1451585
  misc_feature (2)..(50): Pfam Name: TFIIA_gamma_N Pfam Description: Transcription initiation factor IIA gamma subunit, helical domain
  misc_feature (52)..(101): Pfam Name: TFIIA_gamma_C Pfam Description: Transcription initiation factor IIA gamma subunit, beta-barrel domain
  misc_feature: SWISSPROT Homolog: T2AG_ORYSA Transcription initiation factor IIA gamma chain (TFIIA-gamma) with e-value of 1.5e-49 and BLAST sequence identity of 93.4
  misc_feature: SWISSPROT Homolog: T2AG_ARATH Transcription initiation factor IIA gamma chain (TFIIA-gamma) with e-value of 6.1e-44 and BLAST sequence identity of 83.0
  misc_feature: SWISSPROT Homolog: T2AG_ONCMY Transcription initiation factor IIA gamma chain TFIIA P12 subunit (TFIIA-12) (TFIIAS) (TFIIA-gamma) with e-value of 3.9e-26 and BLAST sequence identity of 52.0
  misc_feature: SWISSPROT Homolog: T2AG_MOUSE Putative transcription initiation factor IIA gamma chain TFIIA P12 subunit (TFIIA-12) (TFIIAS) (TFIIA-gamma) with e-value of 1.7e-25 and BLAST sequence identity of 51.9
  misc_feature: SWISSPROT Homolog: T2AG_RAT Transcription initiation factor IIA gamma chain TFIIA P12 subunit (TFIIA-12) (TFIIAS) (TFIIA-gamma) with e-value of 1.7e-25 and BLAST sequence identity of 51.9
  misc_feature 299433:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(117): Functional Homolog of  Ceres CLONE ID no. 225321 at SEQ ID NO. 2707 with e-value of 1.89E-39 and BLAST sequence identity of 81.25
MATFELYRRSTIGMCLTETLDDMVQNGTLSPELAFQVLVQFDKSMTEALETKVKSKVSIKGHLHTYRFCDNVWTFILQDAMFKNEDTQENVGRFNVGVRASLRAPRLIPRALKLTTM

SEQ ID NO: 2665 - protein, 245 aa, Zea mays
  misc_feature (1)..(245): Ceres CLONE ID no. 225601
  misc_feature (14)..(84): Pfam Name: Ribosomal_L30_N Pfam Description: Ribosomal L30 N-terminal domain
  misc_feature (85)..(137): Pfam Name: Ribosomal_L30 Pfam Description: Ribosomal protein L30p/L7e
  misc_feature: Phenotype: INFLORESCENCE - Corkscrew Appearance Useful for making ornamental plants with modified flowers
  misc_feature: Phenotype: CAULINE LEAVES - Curled 1 Useful for making ornamental plants with altered leaf shape
  misc_feature: Phenotype: ROSETTE LEAVES - Curled 1 Useful for making ornamental plants with altered leaf shape
  misc_feature: Phenotype: CAULINE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: WHOLE PLANT - Other Useful for making bigger plants
  misc_feature: Phenotype: INFLORESCENCE - Other Useful for making ornamental plants with modified flowers
  misc_feature (90)..(90): Xaa is any aa, unknown, or other
  misc_feature (91)..(91): Xaa is any aa, unknown, or other
MSAAEAKAAAVPESVLRKRKREEQWAADKKEKALADRKKALESRKIIFARAKQYAEEYHAQEKELVQLKREARLKGGFYVSPEAKLLFVXXIRGINAMHPKTRKILQLLRLRQIFNGVFLKVNKATINMLRRVEPYVAYGYPNLKSVRELIYKRGYGKLNKQRIPLSNNSVIEEGLGKHNIICIEDLVHEIMTVGPHFKEANNFLWPFKLKAPLGGLKKKRNHYVEGGDAGNRENYINELIKRMN

SEQ ID NO: 2666 - DNA, 732 bp, Populus balsamifera subsp. trichocarpa; identical to SEQ ID NO: 679
  misc_feature (1)..(732): Ceres ANNOT ID no. 1457617
  misc_feature 299638:<222: Transcription Factor
  misc_feature: Phenotype: INFLORESCENCE - Corkscrew Appearance Useful for making ornamental plants with modified flowers
  misc_feature: Phenotype: CAULINE LEAVES - Curled 1 Useful for making ornamental plants with altered leaf shape
  misc_feature: Phenotype: ROSETTE LEAVES - Curled 1 Useful for making ornamental plants with altered leaf shape
  misc_feature: Phenotype: CAULINE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: WHOLE PLANT - Other Useful for making bigger plants
  misc_feature: Phenotype: INFLORESCENCE - Other Useful for making ornamental plants with modified flowers

SEQ ID NO: 2667 - protein, 243 aa, Populus balsamifera subsp. trichocarpa; identical to SEQ ID NO: 680
  misc_feature (1)..(243): Ceres ANNOT ID no. 1457617
  misc_feature (12)..(82): Pfam Name: Ribosomal_L30_N Pfam Description: Ribosomal L30 N-terminal domain
  misc_feature (83)..(135): Pfam Name: Ribosomal_L30 Pfam Description: Ribosomal protein L30p/L7e
  misc_feature: SWISSPROT Homolog: RL73_ARATH 60S ribosomal protein L7-3 with e-value of 1.2e-102 and BLAST sequence identity of 76.7
  misc_feature: SWISSPROT Homolog: RL72_ARATH 60S ribosomal protein L7-2 with e-value of 3.2e-102 and BLAST sequence identity of 76.9
  misc_feature: SWISSPROT Homolog: RL71_ARATH 60S ribosomal protein L7-1 with e-value of 2.2e-101 and BLAST sequence identity of 77.6
  misc_feature: SWISSPROT Homolog: RL7_BOVIN 60S ribosomal protein L7 with e-value of 1.1e-74 and BLAST sequence identity of 59.8
  misc_feature: SWISSPROT Homolog: RL7_YARLI 60S ribosomal protein L7 with e-value of 1.8e-74 and BLAST sequence identity of 60.5
  misc_feature 299792:<222: Transcription Factor
  misc_feature: Phenotype: INFLORESCENCE - Corkscrew Appearance Useful for making ornamental plants with modified flowers
  misc_feature: Phenotype: CAULINE LEAVES - Curled 1 Useful for making ornamental plants with altered leaf shape
  misc_feature: Phenotype: ROSETTE LEAVES - Curled 1 Useful for making ornamental plants with altered leaf shape
  misc_feature: Phenotype: CAULINE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: WHOLE PLANT - Other Useful for making bigger plants
  misc_feature: Phenotype: INFLORESCENCE - Other Useful for making ornamental plants with modified flowers
  misc_feature (1)..(243): Functional Homolog of  Ceres CLONE ID no. 225601 at SEQ ID NO. 2712 with e-value of 9.69E-107 and BLAST sequence identity of 81.7

SEQ ID NO: 2668 - DNA, 735 bp, Populus balsamifera subsp. trichocarpa; identical to SEQ ID NO: 681
  misc_feature (1)..(735): Ceres ANNOT ID no. 1465289
  misc_feature 299929:<222: Transcription Factor
  misc_feature: Phenotype: INFLORESCENCE - Corkscrew Appearance Useful for making ornamental plants with modified flowers
  misc_feature: Phenotype: CAULINE LEAVES - Curled 1 Useful for making ornamental plants with altered leaf shape
  misc_feature: Phenotype: ROSETTE LEAVES - Curled 1 Useful for making ornamental plants with altered leaf shape
  misc_feature: Phenotype: CAULINE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: WHOLE PLANT - Other Useful for making bigger plants
  misc_feature: Phenotype: INFLORESCENCE - Other Useful for making ornamental plants with modified flowers

SEQ ID NO: 2669 - protein, 244 aa, Populus balsamifera subsp. trichocarpa; identical to SEQ ID NO: 682
  misc_feature (1)..(244): Ceres ANNOT ID no. 1465289
  misc_feature (13)..(83): Pfam Name: Ribosomal_L30_N Pfam Description: Ribosomal L30 N-terminal domain
  misc_feature (84)..(136): Pfam Name: Ribosomal_L30 Pfam Description: Ribosomal protein L30p/L7e
  misc_feature: SWISSPROT Homolog: RL73_ARATH 60S ribosomal protein L7-3 with e-value of 1.2e-102 and BLAST sequence identity of 76.7
  misc_feature: SWISSPROT Homolog: RL72_ARATH 60S ribosomal protein L7-2 with e-value of 3.2e-102 and BLAST sequence identity of 76.9
  misc_feature: SWISSPROT Homolog: RL71_ARATH 60S ribosomal protein L7-1 with e-value of 2.2e-101 and BLAST sequence identity of 77.6
  misc_feature: SWISSPROT Homolog: RL7_BOVIN 60S ribosomal protein L7 with e-value of 1.1e-74 and BLAST sequence identity of 59.8
  misc_feature: SWISSPROT Homolog: RL7_YARLI 60S ribosomal protein L7 with e-value of 1.8e-74 and BLAST sequence identity of 60.5
  misc_feature 300083:<222: Transcription Factor
  misc_feature: Phenotype: INFLORESCENCE - Corkscrew Appearance Useful for making ornamental plants with modified flowers
  misc_feature: Phenotype: CAULINE LEAVES - Curled 1 Useful for making ornamental plants with altered leaf shape
  misc_feature: Phenotype: ROSETTE LEAVES - Curled 1 Useful for making ornamental plants with altered leaf shape
  misc_feature: Phenotype: CAULINE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: WHOLE PLANT - Other Useful for making bigger plants
  misc_feature: Phenotype: INFLORESCENCE - Other Useful for making ornamental plants with modified flowers
  misc_feature (1)..(244): Functional Homolog of  Ceres CLONE ID no. 225601 at SEQ ID NO. 2712 with e-value of 4.19E-106 and BLAST sequence identity of 81.3

SEQ ID NO: 2670 - DNA, 1053 bp, Populus balsamifera subsp. trichocarpa; identical to SEQ ID NO: 683
  misc_feature (1)..(1053): Ceres ANNOT ID no. 1478647
  misc_feature 300220:<222: Transcription Factor
  misc_feature: Phenotype: INFLORESCENCE - Corkscrew Appearance Useful for making ornamental plants with modified flowers
  misc_feature: Phenotype: CAULINE LEAVES - Curled 1 Useful for making ornamental plants with altered leaf shape
  misc_feature: Phenotype: ROSETTE LEAVES - Curled 1 Useful for making ornamental plants with altered leaf shape
  misc_feature: Phenotype: CAULINE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: WHOLE PLANT - Other Useful for making bigger plants
  misc_feature: Phenotype: INFLORESCENCE - Other Useful for making ornamental plants with modified flowers

SEQ ID NO: 2671 - protein, 306 aa, Populus balsamifera subsp. trichocarpa; identical to SEQ ID NO: 684
  misc_feature (1)..(306): Ceres ANNOT ID no. 1478647
  misc_feature (108)..(131): Pfam Name: Ribosomal_L30 Pfam Description: Ribosomal protein L30p/L7e
  misc_feature (13)..(83): Pfam Name: Ribosomal_L30_N Pfam Description: Ribosomal L30 N-terminal domain
  misc_feature: SWISSPROT Homolog: RL73_ARATH 60S ribosomal protein L7-3 with e-value of 1.2e-102 and BLAST sequence identity of 76.7
  misc_feature: SWISSPROT Homolog: RL72_ARATH 60S ribosomal protein L7-2 with e-value of 3.2e-102 and BLAST sequence identity of 76.9
  misc_feature: SWISSPROT Homolog: RL71_ARATH 60S ribosomal protein L7-1 with e-value of 2.2e-101 and BLAST sequence identity of 77.6
  misc_feature: SWISSPROT Homolog: RL7_BOVIN 60S ribosomal protein L7 with e-value of 1.1e-74 and BLAST sequence identity of 59.8
  misc_feature: SWISSPROT Homolog: RL7_YARLI 60S ribosomal protein L7 with e-value of 1.8e-74 and BLAST sequence identity of 60.5
  misc_feature 300384:<222: Transcription Factor
  misc_feature: Phenotype: INFLORESCENCE - Corkscrew Appearance Useful for making ornamental plants with modified flowers
  misc_feature: Phenotype: CAULINE LEAVES - Curled 1 Useful for making ornamental plants with altered leaf shape
  misc_feature: Phenotype: ROSETTE LEAVES - Curled 1 Useful for making ornamental plants with altered leaf shape
  misc_feature: Phenotype: CAULINE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: WHOLE PLANT - Other Useful for making bigger plants
  misc_feature: Phenotype: INFLORESCENCE - Other Useful for making ornamental plants with modified flowers
  misc_feature (1)..(306): Functional Homolog of  Ceres CLONE ID no. 225601 at SEQ ID NO. 2712 with e-value of 1.00E-88 and BLAST sequence identity of 78.4

SEQ ID NO: 2672 - DNA, 831 bp, Populus balsamifera subsp. trichocarpa; identical to SEQ ID NO: 685
  misc_feature (1)..(831): Ceres ANNOT ID no. 1453865
  misc_feature 300533:<222: Transcription Factor
  misc_feature: Phenotype: INFLORESCENCE - Corkscrew Appearance Useful for making ornamental plants with modified flowers
  misc_feature: Phenotype: CAULINE LEAVES - Curled 1 Useful for making ornamental plants with altered leaf shape
  misc_feature: Phenotype: ROSETTE LEAVES - Curled 1 Useful for making ornamental plants with altered leaf shape
  misc_feature: Phenotype: CAULINE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: WHOLE PLANT - Other Useful for making bigger plants
  misc_feature: Phenotype: INFLORESCENCE - Other Useful for making ornamental plants with modified flowers

SEQ ID NO: 2673 - protein, 276 aa, Populus balsamifera subsp. trichocarpa; identical to SEQ ID NO: 686
  misc_feature (1)..(276): Ceres ANNOT ID no. 1453865
  misc_feature (13)..(83): Pfam Name: Ribosomal_L30_N Pfam Description: Ribosomal L30 N-terminal domain
  misc_feature (84)..(140): Pfam Name: Ribosomal_L30 Pfam Description: Ribosomal protein L30p/L7e
  misc_feature: SWISSPROT Homolog: RL73_ARATH 60S ribosomal protein L7-3 with e-value of 1.2e-102 and BLAST sequence identity of 76.7
  misc_feature: SWISSPROT Homolog: RL72_ARATH 60S ribosomal protein L7-2 with e-value of 3.2e-102 and BLAST sequence identity of 76.9
  misc_feature: SWISSPROT Homolog: RL71_ARATH 60S ribosomal protein L7-1 with e-value of 2.2e-101 and BLAST sequence identity of 77.6
  misc_feature: SWISSPROT Homolog: RL7_BOVIN 60S ribosomal protein L7 with e-value of 1.1e-74 and BLAST sequence identity of 59.8
  misc_feature: SWISSPROT Homolog: RL7_YARLI 60S ribosomal protein L7 with e-value of 1.8e-74 and BLAST sequence identity of 60.5
  misc_feature 300689:<222: Transcription Factor
  misc_feature: Phenotype: INFLORESCENCE - Corkscrew Appearance Useful for making ornamental plants with modified flowers
  misc_feature: Phenotype: CAULINE LEAVES - Curled 1 Useful for making ornamental plants with altered leaf shape
  misc_feature: Phenotype: ROSETTE LEAVES - Curled 1 Useful for making ornamental plants with altered leaf shape
  misc_feature: Phenotype: CAULINE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: WHOLE PLANT - Other Useful for making bigger plants
  misc_feature: Phenotype: INFLORESCENCE - Other Useful for making ornamental plants with modified flowers
  misc_feature (1)..(276): Functional Homolog of  Ceres CLONE ID no. 225601 at SEQ ID NO. 2712 with e-value of 8.09E-87 and BLAST sequence identity of 72.1

SEQ ID NO: 2674 - DNA, 744 bp, Populus balsamifera subsp. trichocarpa
  misc_feature (1)..(744): Ceres ANNOT ID no. 1438014
  misc_feature 300832:<222: Transcription Factor
  misc_feature: Phenotype: INFLORESCENCE - Corkscrew Appearance Useful for making ornamental plants with modified flowers
  misc_feature: Phenotype: CAULINE LEAVES - Curled 1 Useful for making ornamental plants with altered leaf shape
  misc_feature: Phenotype: ROSETTE LEAVES - Curled 1 Useful for making ornamental plants with altered leaf shape
  misc_feature: Phenotype: CAULINE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: WHOLE PLANT - Other Useful for making bigger plants
  misc_feature: Phenotype: INFLORESCENCE - Other Useful for making ornamental plants with modified flowers
atggcagaagcggagccgcaggcattgacgtatgtaccggaggtgatattgaagaaaaggaagcataaggaagaatcaattgctcttacgaggaaaacccagttggagttggggcaaaatggagggaagaagaggagaatggacgatatcaaaaggcccgaacagtttgtcagggagtttagggacaaggaattggatctcatccgtatgaaacagaggaccaagagagcaaaatcagcattatctataccaaattcgaagctcctatttgtcattcgcgtacatggaaaaaatgacatgcatccaaaaactaggaacatcttatacaaactgagattgacaagaatctttcacggtgtcttcttgaaggcaacccaaggggtattagaattgctgcaaaaggtggagccatatgttacatacggatatccaaatttgaagaatgtgagtgatctgatttacaagaagggctatggaaagatagacaacaaaagagttcctttaattgataataatattattgaacaggcattagggaagcatggcattgtatgtctagaagatattgtacatgaagttgccaatgctggtccacatttcaaggagatcattagttttttggggtcattttcactcaacaagccgaaagaaggattgctggggaagaaggcattatacatagatgggggagacactgggaatcgtgagaatcagattaatgacttgatcaataagatgaactaa

SEQ ID NO: 2675 - protein, 247 aa, Populus balsamifera subsp. trichocarpa
  misc_feature (1)..(247): Ceres ANNOT ID no. 1438014
  misc_feature (15)..(80): Pfam Name: Ribosomal_L30_N Pfam Description: Ribosomal L30 N-terminal domain
  misc_feature (87)..(139): Pfam Name: Ribosomal_L30 Pfam Description: Ribosomal protein L30p/L7e
  misc_feature: SWISSPROT Homolog: RL73_ARATH 60S ribosomal protein L7-3 with e-value of 1.2e-102 and BLAST sequence identity of 76.7
  misc_feature: SWISSPROT Homolog: RL72_ARATH 60S ribosomal protein L7-2 with e-value of 3.2e-102 and BLAST sequence identity of 76.9
  misc_feature: SWISSPROT Homolog: RL71_ARATH 60S ribosomal protein L7-1 with e-value of 2.2e-101 and BLAST sequence identity of 77.6
  misc_feature: SWISSPROT Homolog: RL7_BOVIN 60S ribosomal protein L7 with e-value of 1.1e-74 and BLAST sequence identity of 59.8
  misc_feature: SWISSPROT Homolog: RL7_YARLI 60S ribosomal protein L7 with e-value of 1.8e-74 and BLAST sequence identity of 60.5
  misc_feature 300986:<222: Transcription Factor
  misc_feature: Phenotype: INFLORESCENCE - Corkscrew Appearance Useful for making ornamental plants with modified flowers
  misc_feature: Phenotype: CAULINE LEAVES - Curled 1 Useful for making ornamental plants with altered leaf shape
  misc_feature: Phenotype: ROSETTE LEAVES - Curled 1 Useful for making ornamental plants with altered leaf shape
  misc_feature: Phenotype: CAULINE LEAVES - Curled 2 Useful for making ornamental plants with altered leaf shape
  misc_feature: Phenotype: ROSETTE LEAVES - Curled 3 Useful for making ornamental plants with altered leaf shape
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: WHOLE PLANT - Other Useful for making bigger plants
  misc_feature: Phenotype: INFLORESCENCE - Other Useful for making ornamental plants with modified flowers
  misc_feature (1)..(247): Functional Homolog of  Ceres CLONE ID no. 225601 at SEQ ID NO. 2712 with e-value of 2.29E-59 and BLAST sequence identity of 48.7
MAEAEPQALTYVPEVILKKRKHKEESIALTRKTQLELGQNGGKKRRMDDIKRPEQFVREFRDKELDLIRMKQRTKRAKSALSIPNSKLLFVIRVHGKNDMHPKTRNILYKLRLTRIFHGVFLKATQGVLELLQKVEPYVTYGYPNLKNVSDLIYKKGYGKIDNKRVPLIDNNIIEQALGKHGIVCLEDIVHEVANAGPHFKEIISFLGSFSLNKPKEGLLGKKALYIDGGDTGNRENQINDLINKMN

SEQ ID NO: 2676 - protein, 276 aa, Zea mays
  misc_feature (1)..(276): Ceres CLONE ID no. 226818
  misc_feature (108)..(156): Pfam Name: bZIP_1 Pfam Description: bZIP transcription factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: INFLORESCENCE - Other Useful for making ornamental plants with modified flowers
MDDGDLDFSNPDTYLCPALGTDPPSSCSMDSYFDEILKDTEHHACTHTHTCNPPVHDLSHTHTCVHVHTKIVAASPGDDTADSPSENNTNGSGGNGSNAASKKRPSGNRAAVRKYREKKKAHTASLEEEVVHLRALNQQLVKKLQSHAALEAEVARLRCLLVDIRGRIEGEIGAFPYQRPPPAAKNVDLVSGVDQGGFLAGAAAQVTSSCDFRCNDQMYCSPGMQGAVGGQVLGQGACDVSSIQCVGSTRSASTKLPVCGGMDAVPAACLPNVQNK

SEQ ID NO: 2677 - DNA, 801 bp, Populus balsamifera subsp. trichocarpa
  misc_feature (1)..(801): Ceres ANNOT ID no. 1503617
  misc_feature 301226:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: INFLORESCENCE - Other Useful for making ornamental plants with modified flowers
atggacgatggggagttagatttctcaaaccaagatttgttatctagtccaaatatcggtgagattccaagcagttgttcttttgatttcttggatgagctactgaaggacacccatgcttgtacccatacacacacatgcaatcctcctggccctgactattctcacacacacacttgctatcatgtgcatacaaaaattttgccccctgccgaggacaaggttgtaagtgatgatactgcggagtccacggataaaaaatcaaagaaacgatcgtcaggcaatagggaggctgtccgaaagtatagggagaggaagaaggcaaaggctgcatctttggaggatgaagttaagcatttgcgagctttgaaccagcagttactgaagaggctgcaaggacaggctgcattggaggcagaggttgcaagactcaagtgtttacttgtggacattagggggaggattgaaggggaaattggatcatttccatatcagaaatcagccaataatgtgaatttggccaatccaaatattcctggttctcttgtgatgaatccatgcaacatacagtgtgatggccagatttattgtcagcgtccggtgctggatagcaaaggtggagaaggtgcaccattgaatgggcaagggtttagcagttgtgagcttgagaatcttcagtgtatggagtatcagaattcaggaatgataggcttatctgggtgtagccttgggaatgaagcaacaaatggcaattcttccagtacaaataagagaaagctgcccagttggtggttcggttag

SEQ ID NO: 2678 - protein, 266 aa, Populus balsamifera subsp. trichocarpa
  misc_feature (1)..(266): Ceres ANNOT ID no. 1503617
  misc_feature (83)..(140): Pfam Name: bZIP_2 Pfam Description: Basic region leucine zipper
  misc_feature 301306:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: INFLORESCENCE - Other Useful for making ornamental plants with modified flowers
  misc_feature (1)..(266): Functional Homolog of  Ceres CLONE ID no. 226818 at SEQ ID NO. 2723 with e-value of 5.09E-62 and BLAST sequence identity of 59.7
MDDGELDFSNQDLLSSPNIGEIPSSCSFDFLDELLKDTHACTHTHTCNPPGPDYSHTHTCYHVHTKILPPAEDKVVSDDTAESTDKKSKKRSSGNREAVRKYRERKKAKAASLEDEVKHLRALNQQLLKRLQGQAALEAEVARLKCLLVDIRGRIEGEIGSFPYQKSANNVNLANPNIPGSLVMNPCNIQCDGQIYCQRPVLDSKGGEGAPLNGQGFSSCELENLQCMEYQNSGMIGLSGCSLGNEATNGNSSSTNKRKLPSWWFG

SEQ ID NO: 2679 - DNA, 786 bp, Populus balsamifera subsp. trichocarpa
  misc_feature (1)..(786): Ceres ANNOT ID no. 1450560
  misc_feature 301411:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: INFLORESCENCE - Other Useful for making ornamental plants with modified flowers
atggacgatggggagttagatttctcaaaccaagatttgttatctagtccaaatatcggtgagattccaagcagttgttcttttgatttcttggatgagctactgaaggacacccatgcttgtacccatacacacacatgcaatcctcctggccctgactattctcacacacacacttgctatcatgtgcatacaaaaattttgccccctgccgaggacaaggttgtaagtgatgatactgcggagtccacggataaaaaatcaaagaaacgatcgtcaggcaatagggaggctgtccgaaagtatagggagaggaagaaggcaaaggctgcatctttggaggatgaagttaagcatttgcgagctttgaaccagcagttactgaagaggctgcaaggacaggctgcattggaggcagaggttgcaagactcaagtgtttacttgtggacattagggggaggattgaaggggaaattggatcatttccatatcagaaatcagccaataatgtgaatttggccaatccaaatattcctggttctcttgtgatgaatccatgcaacatacagtgtgatggccagatttattgtcagcgtccggtgctggatagcaaaggtggagaaggtgcaccattgaatgggcaagggtttagcagttgtgagcttgagaatcttcagtgtatggagtatcagaattcaggaatgataggcttatctgggtgtagccttgggaatgaagcaacaaatggcaattcttccagtacaaataagagaaagattgattaa

SEQ ID NO: 2680 - protein, 261 aa, Populus balsamifera subsp. trichocarpa
  misc_feature (1)..(261): Ceres ANNOT ID no. 1450560
  misc_feature (83)..(140): Pfam Name: bZIP_2 Pfam Description: Basic region leucine zipper
  misc_feature 301491:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: INFLORESCENCE - Other Useful for making ornamental plants with modified flowers
  misc_feature (1)..(261): Functional Homolog of  Ceres CLONE ID no. 226818 at SEQ ID NO. 2723 with e-value of 5.09E-62 and BLAST sequence identity of 59.7
MDDGELDFSNQDLLSSPNIGEIPSSCSFDFLDELLKDTHACTHTHTCNPPGPDYSHTHTCYHVHTKILPPAEDKVVSDDTAESTDKKSKKRSSGNREAVRKYRERKKAKAASLEDEVKHLRALNQQLLKRLQGQAALEAEVARLKCLLVDIRGRIEGEIGSFPYQKSANNVNLANPNIPGSLVMNPCNIQCDGQIYCQRPVLDSKGGEGAPLNGQGFSSCELENLQCMEYQNSGMIGLSGCSLGNEATNGNSSSTNKRKID

SEQ ID NO: 2681 - DNA, 825 bp, Populus balsamifera subsp. trichocarpa
  misc_feature (1)..(825): Ceres ANNOT ID no. 1460622
  misc_feature 301596:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: INFLORESCENCE - Other Useful for making ornamental plants with modified flowers
atggacgatggagagttagattattcaaaccaagaattgtttttgagtccgaatatggatgatcttccaagcagttgttcttatggtttcttggatgagctactgatggatactcctcatgcttgtactcatacacacacatgcaatcctcctggtcccgataatcctcacacacacgtttgctttcatgcacatacaaaacttttgtcctcttctgaggacaaggttgagagtgaagacactgcggagtccatagagaaaaagtcaaagaaacggccattgggcaatagggaggctgtccgaaagtatagggagaagaagaaggcaaaggctgcctctttggaggatgaagttaagcgtttgcgagctttgaaccaacagttactaaagaggctgcaaggacaggctgcattggaggcagaggttgcaaggctcaagtgtttactggtagacatcagggggagaattgaaggggagattggatcttttccatatcagaaatcagctaataatgtgaatttgaccaattttcctggttctcttgtgatgaatccatgtaatataaggtgtgatgatcaggtttattgccagcatcctgggttggatggcaaaggtggagaaggtgaagcattgaaaggacaagggtttaacagttgtgagtttgagaaccttcagtgtatggagtatcagaattcaggaatgagagacttacctgggtgtagcattgggaatgaggaaatgaatggcaattcttccagtgcaaacaagaggaaaggaggggcttgtgaagcaacagtgttgggttactcggctgaagctgcctag

SEQ ID NO: 2682 - protein, 274 aa, Populus balsamifera subsp. trichocarpa
  misc_feature (1)..(274): Ceres ANNOT ID no. 1460622
  misc_feature (83)..(151): Pfam Name: bZIP_1 Pfam Description: bZIP transcription factor
  misc_feature 301676:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: INFLORESCENCE - Other Useful for making ornamental plants with modified flowers
  misc_feature (1)..(274): Functional Homolog of  Ceres CLONE ID no. 226818 at SEQ ID NO. 2723 with e-value of 1.69E-61 and BLAST sequence identity of 60.0
MDDGELDYSNQELFLSPNMDDLPSSCSYGFLDELLMDTPHACTHTHTCNPPGPDNPHTHVCFHAHTKLLSSSEDKVESEDTAESIEKKSKKRPLGNREAVRKYREKKKAKAASLEDEVKRLRALNQQLLKRLQGQAALEAEVARLKCLLVDIRGRIEGEIGSFPYQKSANNVNLTNFPGSLVMNPCNIRCDDQVYCQHPGLDGKGGEGEALKGQGFNSCEFENLQCMEYQNSGMRDLPGCSIGNEEMNGNSSSANKRKGGACEATVLGYSAEAA

SEQ ID NO: 2683 - protein, 126 aa, Zea mays
  misc_feature (1)..(126): Ceres CLONE ID no. 227651
  misc_feature (26)..(121): Pfam Name: Ribosomal_S10 Pfam Description: Ribosomal protein S10p/S20e
  misc_feature: Phenotype: ROSETTE LEAVES - Disorganized Rosette Useful for making plants with increased biomass
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: ROSETTE LEAVES - Other Useful for making ornamental plants with modified leaves
MAAAAVYGGFKGKLGVEDAPELQLNRIRITLSSKNVKNLEKVCADLVKGAKDKHLRVKGPVRIPTKVLHITTRKSPCGEGTNTWDRFEFRIHKRVIDLISSPDVVKQITSITIEPGVEVEVTIADV

SEQ ID NO: 2684 - DNA, 372 bp, Populus balsamifera subsp. trichocarpa
  misc_feature (1)..(372): Ceres ANNOT ID no. 1474222
  misc_feature 301857:<222: Transcription Factor
  misc_feature: Phenotype: ROSETTE LEAVES - Disorganized Rosette Useful for making plants with increased biomass
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: ROSETTE LEAVES - Other Useful for making ornamental plants with modified leaves
atggcagcagcttatggagctatgaaggcgcagaagccgggtttggaggaggcccaggagcagattcacaagatcaggatcactctttcctccaagaatgtcaaaaaccttgagaaagtttgcactgacttggttcgtggtgccaaggataagagactgagggtcaagggaccagtgagaatccctaccaaggttcttaacattaccaccaggaaatccccttgtggtgaaggaaccaatacatgggacagatttgagcttcgtgtccacaagcgtgtaattgatctcttcagttctgctgatgttgttaagcagatcacctctatcacaattgaacctggtgttgaggttgaagttaccattgctgattag

SEQ ID NO: 2685 - protein, 123 aa, Populus balsamifera subsp. trichocarpa
  misc_feature (1)..(123): Ceres ANNOT ID no. 1474222
  misc_feature (24)..(119): Pfam Name: Ribosomal_S10 Pfam Description: Ribosomal protein S10p/S20e
  misc_feature: SWISSPROT Homolog: RS20_ARATH 40S ribosomal protein S20 with e-value of 1.9e-47 and BLAST sequence identity of 80.5
  misc_feature: SWISSPROT Homolog: RS20_ORYSA 40S ribosomal protein S20 with e-value of 1.9e-47 and BLAST sequence identity of 84.2
  misc_feature: SWISSPROT Homolog: RS20_HUMAN 40S ribosomal protein S20 with e-value of 4.4e-41 and BLAST sequence identity of 72.8
  misc_feature: SWISSPROT Homolog: RS20_MOUSE 40S ribosomal protein S20 with e-value of 4.4e-41 and BLAST sequence identity of 72.8
  misc_feature: SWISSPROT Homolog: RS20_RAT 40S ribosomal protein S20 with e-value of 4.4e-41 and BLAST sequence identity of 72.8
  misc_feature 301958:<222: Transcription Factor
  misc_feature: Phenotype: ROSETTE LEAVES - Disorganized Rosette Useful for making plants with increased biomass
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: ROSETTE LEAVES - Other Useful for making ornamental plants with modified leaves
  misc_feature (1)..(123): Functional Homolog of  Ceres CLONE ID no. 227651 at SEQ ID NO. 2730 with e-value of 6.99E-49 and BLAST sequence identity of 84.2
MAAAYGAMKAQKPGLEEAQEQIHKIRITLSSKNVKNLEKVCTDLVRGAKDKRLRVKGPVRIPTKVLNITTRKSPCGEGTNTWDRFELRVHKRVIDLFSSADVVKQITSITIEPGVEVEVTIAD

SEQ ID NO: 2686 - DNA, 372 bp, Populus balsamifera subsp. trichocarpa
  misc_feature (1)..(372): Ceres ANNOT ID no. 1468994
  misc_feature 302036:<222: Transcription Factor
  misc_feature: Phenotype: ROSETTE LEAVES - Disorganized Rosette Useful for making plants with increased biomass
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: ROSETTE LEAVES - Other Useful for making ornamental plants with modified leaves
atggcagcagcttatggagctatgaaggcgcaaaagccgggtttggaggagactcaggagcagattcacaagatcaggatcactctttcctccaaggatgtcaaaaaccttgagaaagtttgcactgacttggtccgtggtgccaaggataagagactgagggttaagggtccagtgagaatccctaccaaggttcttaacattaccaccaggaaatccccttgtggtgaaggaaccaacacatgggacagattcgagcttcgggtccacaagcgtgttattgatctcttcagttctgccgatgttgtcaagcagatcacctctattacaattgaacctggtgttgaggttgaagttaccattgcagattag

SEQ ID NO: 2687 - protein, 123 aa, Populus balsamifera subsp. trichocarpa
  misc_feature (1)..(123): Ceres ANNOT ID no. 1468994
  misc_feature (24)..(119): Pfam Name: Ribosomal_S10 Pfam Description: Ribosomal protein S10p/S20e
  misc_feature: SWISSPROT Homolog: RS20_ARATH 40S ribosomal protein S20 with e-value of 1.9e-47 and BLAST sequence identity of 80.5
  misc_feature: SWISSPROT Homolog: RS20_ORYSA 40S ribosomal protein S20 with e-value of 1.9e-47 and BLAST sequence identity of 84.2
  misc_feature: SWISSPROT Homolog: RS20_HUMAN 40S ribosomal protein S20 with e-value of 4.4e-41 and BLAST sequence identity of 72.8
  misc_feature: SWISSPROT Homolog: RS20_MOUSE 40S ribosomal protein S20 with e-value of 4.4e-41 and BLAST sequence identity of 72.8
  misc_feature: SWISSPROT Homolog: RS20_RAT 40S ribosomal protein S20 with e-value of 4.4e-41 and BLAST sequence identity of 72.8
  misc_feature 302137:<222: Transcription Factor
  misc_feature: Phenotype: ROSETTE LEAVES - Disorganized Rosette Useful for making plants with increased biomass
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: ROSETTE LEAVES - Other Useful for making ornamental plants with modified leaves
  misc_feature (1)..(123): Functional Homolog of  Ceres CLONE ID no. 227651 at SEQ ID NO. 2730 with e-value of 6.29E-48 and BLAST sequence identity of 82.6
MAAAYGAMKAQKPGLEETQEQIHKIRITLSSKDVKNLEKVCTDLVRGAKDKRLRVKGPVRIPTKVLNITTRKSPCGEGTNTWDRFELRVHKRVIDLFSSADVVKQITSITIEPGVEVEVTIAD

SEQ ID NO: 2688 - DNA, 366 bp, Populus balsamifera subsp. trichocarpa
  misc_feature (1)..(366): Ceres ANNOT ID no. 1497043
  misc_feature 302215:<222: Transcription Factor
  misc_feature: Phenotype: ROSETTE LEAVES - Disorganized Rosette Useful for making plants with increased biomass
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: ROSETTE LEAVES - Other Useful for making ornamental plants with modified leaves
atggctttggctaaaatgaaacctgtgaagcctggtttagaggaatatcatgatcaagttcaacgtgttaggattactctttcttcgaagaatgtcaaaaaccttgagaaagtgtgtgctgatttaatccgtggtgctaaggataaaagcttgaaagtcaaaggacctgtgaggataccaaccaaagttctccgaattactactagaaaagctccatgtggtgaaggaacgaacacttgggacaggtttgagctccgcattcataaacgagtgattgatctttttagctcagctgatgtggtgaaacagataacttccattaccattgaacctggtgtggaggttgaggttacaattgcaagctaa

SEQ ID NO: 2689 - protein, 116 aa, Populus balsamifera subsp. trichocarpa
  misc_feature (1)..(116): Ceres ANNOT ID no. 1497043
  misc_feature (17)..(112): Pfam Name: Ribosomal_S10 Pfam Description: Ribosomal protein S10p/S20e
  misc_feature: SWISSPROT Homolog: RS20_ARATH 40S ribosomal protein S20 with e-value of 1.9e-47 and BLAST sequence identity of 80.5
  misc_feature: SWISSPROT Homolog: RS20_ORYSA 40S ribosomal protein S20 with e-value of 1.9e-47 and BLAST sequence identity of 84.2
  misc_feature: SWISSPROT Homolog: RS20_HUMAN 40S ribosomal protein S20 with e-value of 4.4e-41 and BLAST sequence identity of 72.8
  misc_feature: SWISSPROT Homolog: RS20_MOUSE 40S ribosomal protein S20 with e-value of 4.4e-41 and BLAST sequence identity of 72.8
  misc_feature: SWISSPROT Homolog: RS20_RAT 40S ribosomal protein S20 with e-value of 4.4e-41 and BLAST sequence identity of 72.8
  misc_feature 302316:<222: Transcription Factor
  misc_feature: Phenotype: ROSETTE LEAVES - Disorganized Rosette Useful for making plants with increased biomass
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: ROSETTE LEAVES - Other Useful for making ornamental plants with modified leaves
  misc_feature (1)..(116): Functional Homolog of  Ceres CLONE ID no. 227651 at SEQ ID NO. 2730 with e-value of 5.90E-45 and BLAST sequence identity of 83.7
MKPVKPGLEEYHDQVQRVRITLSSKNVKNLEKVCADLIRGAKDKSLKVKGPVRIPTKVLRITTRKAPCGEGTNTWDRFELRIHKRVIDLFSSADVVKQITSITIEPGVEVEVTIAS

SEQ ID NO: 2690 - protein, 260 aa, Zea mays
  misc_feature (1)..(260): Ceres CLONE ID no. 228787
  misc_feature (105)..(204): Pfam Name: K-box Pfam Description: K-box region
  misc_feature (40)..(90): Pfam Name: SRF-TF Pfam Description: SRF-type transcription factor DNA-binding and dimerisation domain)
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
MLNMMTDLSCGPSSKAKGGQPAATTGSGGDRQGRGKIEIKRIENTTNRQVTFCKRRNGLLKKAYELSVLCDAEVALVVFSSRGRLYEYANNSVKSTIERYKKANSDTSNSGTVAEVNAQHYQQESSKLRQAIDSLQNANRTIVGDSIHTMGLRELKQMEGKLEKAINKIRARKNELLYAEVEYMQKREMDLQTDNMYLRSKIAENNETGQPAMNMIGVPSTSEYDHMAPFVDSRNFLQVNMQQQPQHYSHQLQPTTLQLG

SEQ ID NO: 2691 - DNA, 726 bp, Populus balsamifera subsp. trichocarpa
  misc_feature (1)..(726): Ceres ANNOT ID no. 1139572
  misc_feature 302494:<222: Transcription Factor
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
atggaatatcaaaatgaatcccttgagagctcccccctgaggaagctgggaaggggaaaggtggagatcaagcggatcgagaacaccaccaatcgccaagtcactttctgcaaaaggcgcagtggtttgctcaagaaagcctacgaattatctgttctttgcgatgctgaggttgcactcatcgtcttctctagccgcggtcgcctttatgagtactctaacgatagtgtcaaatcaacaattgagaggtacaaaaaggcatctgcagattcttcaaacactgggtctgtttctgaagccaatgctcagtactaccagcaagaagctgccaagctgcgttcccaaattggtaatttgcagaattcaaacaggcatatgctgggtgaagcgcttagttcattgagtgtgaaggaacttaagagtttggaaatacgacttgagaaaggaataagcagaattcgttccaaaaagaatgagctgttgtttgcagaaatcgagtatatgcagaagagggaggttgacttgcacaacaataaccagcttctccgagcaaagatttcagagaatgaaagaaagcgacagagcatgaatttgatgccaggaggagcagactttgagatcgtgcagtctcaaccatatgactctcggaactattctcaagtgaatggattacagcctgcaagtcattactcacatcaagatcagatggcccttcagttagtttaa

SEQ ID NO: 2692 - protein, 241 aa, Populus balsamifera subsp. trichocarpa
  misc_feature (1)..(241): Ceres ANNOT ID no. 1139572
  misc_feature (24)..(74): Pfam Name: SRF-TF Pfam Description: SRF-type transcription factor DNA-binding and dimerisation domain)
  misc_feature (88)..(188): Pfam Name: K-box Pfam Description: K-box region
  misc_feature: SWISSPROT Homolog: MADS3_ORYSA MADS-box transcription factor 3 (OsMADS3) (Protein AGAMOUS-like) (RMADS222) with e-value of 3.0e-99 and BLAST sequence identity of 85.3
  misc_feature: SWISSPROT Homolog: MAD58_ORYSA MADS-box transcription factor 58 (OsMADS58) with e-value of 7.8e-83 and BLAST sequence identity of 69.7
  misc_feature: SWISSPROT Homolog: AG_PETHY Floral homeotic protein AGAMOUS (pMADS3) with e-value of 7.7e-76 and BLAST sequence identity of 67.7
  misc_feature: SWISSPROT Homolog: AG_TOBAC Floral homeotic protein AGAMOUS (NAG1) with e-value of 7.0e-75 and BLAST sequence identity of 65.8
  misc_feature: SWISSPROT Homolog: AG_PANGI Floral homeotic protein AGAMOUS (GAG2) with e-value of 3.5e-73 and BLAST sequence identity of 65.4
  misc_feature 302612:<222: Transcription Factor
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature (1)..(241): Functional Homolog of  Ceres CLONE ID no. 228787 at SEQ ID NO. 2737 with e-value of 4.40E-72 and BLAST sequence identity of 64.2
MEYQNESLESSPLRKLGRGKVEIKRIENTTNRQVTFCKRRSGLLKKAYELSVLCDAEVALIVFSSRGRLYEYSNDSVKSTIERYKKASADSSNTGSVSEANAQYYQQEAAKLRSQIGNLQNSNRHMLGEALSSLSVKELKSLEIRLEKGISRIRSKKNELLFAEIEYMQKREVDLHNNNQLLRAKISENERKRQSMNLMPGGADFEIVQSQPYDSRNYSQVNGLQPASHYSHQDQMALQLV

SEQ ID NO: 2693 - DNA, 717 bp, Populus balsamifera subsp. trichocarpa
  misc_feature (1)..(717): Ceres ANNOT ID no. 1139571
  misc_feature 302707:<222: Transcription Factor
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
atggcataccaaaatgaaccccaagagagctctcccctgaggaagctggggaggggaaaggtggagatcaagcggatcgagaacaccaccaatcgccaagtcactttctgcaaaaggcggaatggtttgctcaagaaagcctatgaattatctgttctttgcgatgctgaggttgcactcatcgtcttctccagccgtggacgcctttatgagtactctaacaatagtgtcaaatctacaattgaaaggtacaaaaaggcatgtgcagattcttccaacaacgggtcagtttctgaagccaatgctcagttttatcagcaagaagctgccaagctgcgctcgcaaattggtaatttgcagaattcaaacaggaatatgctgggtgaatcacttagtgcattgagtgtgaaggaacttaagagcttggagataaaacttgagaaaggaattggtagaattcgttcgaaaaagaatgagctgttgtttgctgaaattgagtatatgcagaagagggagattgacttgcacaacaataaccagcttctccgagcaaagattgcagagaatgaaagaaagcgacagcacatgaatttgatgccgggaggtgtcaacttcgagatcatgcagtctcaaccatttgactctcggaactattctcaagttaatggattgccgcctgccaatcattaccctcatgaagaccagctcttcagttag

SEQ ID NO: 2694 - protein, 238 aa, Populus balsamifera subsp. trichocarpa
  misc_feature (1)..(238): Ceres ANNOT ID no. 1139571
  misc_feature (24)..(74): Pfam Name: SRF-TF Pfam Description: SRF-type transcription factor DNA-binding and dimerisation domain)
  misc_feature (89)..(188): Pfam Name: K-box Pfam Description: K-box region
  misc_feature: SWISSPROT Homolog: MADS3_ORYSA MADS-box transcription factor 3 (OsMADS3) (Protein AGAMOUS-like) (RMADS222) with e-value of 3.0e-99 and BLAST sequence identity of 85.3
  misc_feature: SWISSPROT Homolog: MAD58_ORYSA MADS-box transcription factor 58 (OsMADS58) with e-value of 7.8e-83 and BLAST sequence identity of 69.7
  misc_feature: SWISSPROT Homolog: AG_PETHY Floral homeotic protein AGAMOUS (pMADS3) with e-value of 7.7e-76 and BLAST sequence identity of 67.7
  misc_feature: SWISSPROT Homolog: AG_TOBAC Floral homeotic protein AGAMOUS (NAG1) with e-value of 7.0e-75 and BLAST sequence identity of 65.8
  misc_feature: SWISSPROT Homolog: AG_PANGI Floral homeotic protein AGAMOUS (GAG2) with e-value of 3.5e-73 and BLAST sequence identity of 65.4
  misc_feature 302823:<222: Transcription Factor
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature (1)..(238): Functional Homolog of  Ceres CLONE ID no. 228787 at SEQ ID NO. 2737 with e-value of 2.40E-71 and BLAST sequence identity of 65.7
MAYQNEPQESSPLRKLGRGKVEIKRIENTTNRQVTFCKRRNGLLKKAYELSVLCDAEVALIVFSSRGRLYEYSNNSVKSTIERYKKACADSSNNGSVSEANAQFYQQEAAKLRSQIGNLQNSNRNMLGESLSALSVKELKSLEIKLEKGIGRIRSKKNELLFAEIEYMQKREIDLHNNNQLLRAKIAENERKRQHMNLMPGGVNFEIMQSQPFDSRNYSQVNGLPPANHYPHEDQLFS

SEQ ID NO: 2695 - DNA, 777 bp, Populus balsamifera subsp. trichocarpa
  misc_feature (1)..(777): Ceres ANNOT ID no. 1519423
  misc_feature 302915:<222: Transcription Factor
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
atggcataccaaaatgaaccccaagagagctctcccctgaggaagctggggaggggaaaggtggagatcaagcggatcgagaacaccaccaatcgccaagtcactttctgcaaaaggcggaatggtttgctcaagaaagcctatgaattatctgttctttgcgatgctgaggttgcactcatcgtcttctccagccgtggacgcctttatgagtactctaacaatagtgtcaaatctacaattgaaaggtacaaaaaggcatgtgcagattcttccaacaacgggtcagtttctgaagccaatgctcagttctatcagcaagaagctgccaagctgcgctcgcaaattggtaatttgcagaattcaaacaggaatatgctgggtgaatcacttagtgcattgagtgtgaaggaacttaagagcttggagataaaacttgagaaaggaattggtagaattcgttcgaaaaaggagattgacttgcacaacaataaccagcttctccgagcaaagattgcagagaatgaaagaaagcgacagcacatgaatttgatgccgggaggtgtcaacttcgagatcatgcagtctcaaccatttgactctcggaactattctcaagttaatggattgccgcctgccaatcattaccctcatgaagaccagctcttcattaaaaagcaccaagtgcagcaactcctcgcatttccatattccatggagagtacctactatttcactgagcgcaaaagctgcaagtacgctaaaacaaaaatctga

SEQ ID NO: 2696 - protein, 258 aa, Populus balsamifera subsp. trichocarpa
  misc_feature (1)..(258): Ceres ANNOT ID no. 1519423
  misc_feature (158)..(174): Pfam Name: K-box Pfam Description: K-box region
  misc_feature (24)..(74): Pfam Name: SRF-TF Pfam Description: SRF-type transcription factor DNA-binding and dimerisation domain)
  misc_feature: SWISSPROT Homolog: MADS3_ORYSA MADS-box transcription factor 3 (OsMADS3) (Protein AGAMOUS-like) (RMADS222) with e-value of 3.0e-99 and BLAST sequence identity of 85.3
  misc_feature: SWISSPROT Homolog: MAD58_ORYSA MADS-box transcription factor 58 (OsMADS58) with e-value of 7.8e-83 and BLAST sequence identity of 69.7
  misc_feature: SWISSPROT Homolog: AG_PETHY Floral homeotic protein AGAMOUS (pMADS3) with e-value of 7.7e-76 and BLAST sequence identity of 67.7
  misc_feature: SWISSPROT Homolog: AG_TOBAC Floral homeotic protein AGAMOUS (NAG1) with e-value of 7.0e-75 and BLAST sequence identity of 65.8
  misc_feature: SWISSPROT Homolog: AG_PANGI Floral homeotic protein AGAMOUS (GAG2) with e-value of 3.5e-73 and BLAST sequence identity of 65.4
  misc_feature 303033:<222: Transcription Factor
  misc_feature: Phenotype: ROSETTE LEAVES - Curled 3 Useful for making ornamental plants with altered leaf shape
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature (1)..(258): Functional Homolog of  Ceres CLONE ID no. 228787 at SEQ ID NO. 2737 with e-value of 1.19E-60 and BLAST sequence identity of 64.3
MAYQNEPQESSPLRKLGRGKVEIKRIENTTNRQVTFCKRRNGLLKKAYELSVLCDAEVALIVFSSRGRLYEYSNNSVKSTIERYKKACADSSNNGSVSEANAQFYQQEAAKLRSQIGNLQNSNRNMLGESLSALSVKELKSLEIKLEKGIGRIRSKKEIDLHNNNQLLRAKIAENERKRQHMNLMPGGVNFEIMQSQPFDSRNYSQVNGLPPANHYPHEDQLFIKKHQVQQLLAFPYSMESTYYFTERKSCKYAKTKI

SEQ ID NO: 2697 - protein, 433 aa, Zea mays
  misc_feature (1)..(433): Ceres CLONE ID no. 229604
  misc_feature (1)..(433): Also Known As Ceres CDNA ID no. 23764087
  misc_feature (1)..(433): Also Known As Ceres GEMINI ID 537F10
  misc_feature (149)..(212): Pfam Name: Acetyltransf_1 Pfam Description: Acetyltransferase (GNAT) family
  misc_feature (243)..(432): Pfam Name: NMT_C Pfam Description: Myristoyl-CoA:protein N-myristoyltransferase C-terminal domain
  misc_feature 303158:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
MAAPNSNDAASASGTGPAGEEDISIEALARRVQEHMTLSSNPAARRHKFWETQPVGQFRDVADTSLPDGPIEPPTPLSEVRADPYPLPAAFEWLTCDLDDDALLADLYSLLAHNYVEDDENMFRFNYSPAFLRWALKPPSFFRAWHIGVRAKESKKLVAFISGVPARIRARDDVVRMAEINFLCVHKKLRSKRLAPVLIREVTRRVHQENIWQAAYTAGVVLPTPITTCRYWHRSLNPKKLIDVGFSRLGPRMTMSRTVRLYKLPDAPLTPGFRRMELRDVAAVTRLLRAYLARFVVAPDFDEVDVEHWLLPQEDVVDSYLVESPETHEVTDFCSFYTLPSSVLNNANYATLKAAYSYYNVSTKTALQQLMNDALIVAKQKNYDVFNALDVMENESFLKELKFGPGDGQLHYYLYNYRIRNGIKPSELGLVLL

SEQ ID NO: 2698 - DNA, 1311 bp, Populus balsamifera subsp. trichocarpa
  misc_feature (1)..(1311): Ceres ANNOT ID no. 1480703
  misc_feature 303268:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
atggccgataacaataacaattcaccacctgtgtcttcgaaagaaaacccagatcatgattctgagacgaacctaattgccaaggaagatagctccctcgcaactatagcccgtaggtttcaggactccatttccttaggcaagacacacaagttctgggaaagtcaacctgttggtcaattcaaagacattggtgattcaagtttgcccgagggccctattgagcctccaaccccgctatctgaagttaaacaagaaccatacaatctccctactcagtatgaatggaccacctgtgacatggagtccgaggagacttgcaatgaggtctataatctcttgaaaaacaactatgttgaagatgatgagaacatgtttaggtttaattactcacaggagtttcttagatgggctttgtgtcccccgggttactatccaagctggcacattggggttcgtgccaaagcttcccagaagctcgttgctttcatcacaggtgtccctgcaaggattcgggtgcgtgatgaagttgtgaaaatggttgagatcaatttcttgtgtgttcataagaagcttcggtcgaagagacttgcccctgttatgattaaggaggttactaggagggttcatttagagaatatttggcaagcagcatatactgctggcgtggttcttccaacaccaataacaacctgtcagtattggcacaggtctttgaacccgaagaagcttattgatgttggcttttcaaggcttggtgcaaggatgacaatgagtcggacaataaaactctacaagttaccagattcccccgccacccctggatttagaaaaatggaacttcgtgatgtacctgctgttacaaggttgctaagaaattacttgagccagtttgttgttgcacctgattttgatgagaatgatgtggagcactggcttcttccaactgagaacgtggttgatagttacttggttgagagtccagagactcatgagatcactgacttctgcagcttctacacgcttccatcctctatcctaggcaaccagaattacttgacgttgaaagctgcttattcatattacaatgttagcgtgaagactccattgcttcagttaatgaatgatgcactgattgttgccaagcagaaggattttgatgtttttaatgcattggatgtcatgcataacgagtctttcctgaaagaactgaaatttggaccaggtgatgggcaactacactactatctttacaattaccgcttacagcatgccttgagaccctcggaactggggcttgtcctcttatag

SEQ ID NO: 2699 - protein, 436 aa, Populus balsamifera subsp. trichocarpa
  misc_feature (1)..(436): Ceres ANNOT ID no. 1480703
  misc_feature (246)..(435): Pfam Name: NMT_C Pfam Description: Myristoyl-CoA:protein N-myristoyltransferase C-terminal domain
  misc_feature (71)..(232): Pfam Name: NMT Pfam Description: Myristoyl-CoA:protein N-myristoyltransferase N-terminal domain
  misc_feature: SWISSPROT Homolog: NMT1_ARATH Glycylpeptide N-tetradecanoyltransferase 1 (EC 2.3.1.97) with e-value of 1.6e-180 and BLAST sequence identity of 76.5
  misc_feature: SWISSPROT Homolog: NMT1_ARATH Peptide N-myristoyltransferase 1 Myristoyl-CoA:protein N-myristoyltransferase 1 (NMT 1) Type I N-myristoyltransferase 1
  misc_feature: SWISSPROT Homolog: NMT2_ARATH Probable glycylpeptide N-tetradecanoyltransferase 2 (EC 2.3.1.97) with e-value of 5.9e-133 and BLAST sequence identity of 62.2
  misc_feature: SWISSPROT Homolog: NMT2_ARATH Peptide N-myristoyltransferase 2 Myristoyl-CoA:protein N-myristoyltransferase 2 (NMT 2) Type I N-myristoyltransferase 2
  misc_feature: SWISSPROT Homolog: NMT2_MOUSE Glycylpeptide N-tetradecanoyltransferase 2 (EC 2.3.1.97) with e-value of 3.9e-120 and BLAST sequence identity of 57.7
  misc_feature: SWISSPROT Homolog: NMT2_MOUSE Peptide N-myristoyltransferase 2 Myristoyl-CoA:protein N-myristoyltransferase 2 (NMT 2) Type II N-myristoyltransferase
  misc_feature: SWISSPROT Homolog: NMT2_HUMAN Glycylpeptide N-tetradecanoyltransferase 2 (EC 2.3.1.97) with e-value of 1.0e-119 and BLAST sequence identity of 57.9
  misc_feature: SWISSPROT Homolog: NMT2_HUMAN Peptide N-myristoyltransferase 2 Myristoyl-CoA:protein N-myristoyltransferase 2 (NMT 2) Type II N-myristoyltransferase
  misc_feature: SWISSPROT Homolog: NMT1_HUMAN Glycylpeptide N-tetradecanoyltransferase 1 (EC 2.3.1.97) with e-value of 7.3e-119 and BLAST sequence identity of 52.8
  misc_feature: SWISSPROT Homolog: NMT1_HUMAN Peptide N-myristoyltransferase 1 Myristoyl-CoA:protein N-myristoyltransferase 1 (NMT 1) Type I N-myristoyltransferase
  misc_feature 303432:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (1)..(436): Functional Homolog of  Ceres CLONE ID no. 229604 at SEQ ID NO. 2744 with e-value of 2.00E-179 and BLAST sequence identity of 77.1
MADNNNNSPPVSSKENPDHDSETNLIAKEDSSLATIARRFQDSISLGKTHKFWESQPVGQFKDIGDSSLPEGPIEPPTPLSEVKQEPYNLPTQYEWTTCDMESEETCNEVYNLLKNNYVEDDENMFRFNYSQEFLRWALCPPGYYPSWHIGVRAKASQKLVAFITGVPARIRVRDEVVKMVEINFLCVHKKLRSKRLAPVMIKEVTRRVHLENIWQAAYTAGVVLPTPITTCQYWHRSLNPKKLIDVGFSRLGARMTMSRTIKLYKLPDSPATPGFRKMELRDVPAVTRLLRNYLSQFVVAPDFDENDVEHWLLPTENVVDSYLVESPETHEITDFCSFYTLPSSILGNQNYLTLKAAYSYYNVSVKTPLLQLMNDALIVAKQKDFDVFNALDVMHNESFLKELKFGPGDGQLHYYLYNYRLQHALRPSELGLVLL

SEQ ID NO: 2700 - DNA, 1311 bp, Populus balsamifera subsp. trichocarpa
  misc_feature (1)..(1311): Ceres ANNOT ID no. 1454366
  misc_feature 303550:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
atggctgataacaataacaattcactacctgggtcttcgaaagataaccctgatcatgattctgagacaaacccagtttccaaggaaaatagttcgctctcaactatagtccgtaggtttaaggactcggtttctttaggcaagacacacaagttttgggaaagtcaacctgttggtcaattcaaagacattggtgactcaaatctgcctgaaggtcccatcgagcctccaaccctgctttctgaagttaaacaggaaccttacaatctccctagtcagtatgaatggaccacctgtgacatggaatctgatgagacttgcgttgaggtttacaatctcttgaagaacaactatgttgaggacgatgagaacatgttcaggtttaattactcgcaggagtttcttacatgggctttgcgtcccccgggctattatcgaaactggcacattggagttcgtgccaaaacttcgaagaagcttgttgcttttataacaggcgttcctgcaaggattcgggtgcgtgatgaagttgtgaaaatggcagagattaatttcttatgtgttcataagaagcttcgatccaagagacttgctcctgttatgattaaggaggttacaaggagggttcatttagagaatatttggcaggctgcttacactgctggagtggttcttccaacaccaataacaacctgccagtattggcacaggtctttgaaccccaagaagcttattgatgttggcttttcaaggcttggtgcaaggatgacaatgagccggaccataaaactttacaagttaccagattcccctgccacccctggatttagaaatatggaacttcgtgatgtgcctgctgtcacgaggttgctaagaaattacttgagccagtttgttgttgctccggattttgatgaaaatgatgtagagcactggcttcttccaaccgagaacgtggttgatagctacttggttgagagcccagagactcatgagatcaccgacttctgcagcttctatactcttccatcctctattcttggcaaccagaaccactcgacattgaaagctgcttattcatattacaatgttagcatgaagactccattgcttcagttaatgaatgatgcactgattgttgccaagcagaaggattttgacgtttttaatgcattggatgtcatgcataacgagcctttcctgaaagaactgaaatttggaccaggtgatgggcaactacactactacctttacaattaccgcataaggcatgccttgagaccctcggaactagggctagtactcttataa

SEQ ID NO: 2701 - protein, 436 aa, Populus balsamifera subsp. trichocarpa
  misc_feature (1)..(436): Ceres ANNOT ID no. 1454366
  misc_feature (246)..(435): Pfam Name: NMT_C Pfam Description: Myristoyl-CoA:protein N-myristoyltransferase C-terminal domain
  misc_feature (71)..(232): Pfam Name: NMT Pfam Description: Myristoyl-CoA:protein N-myristoyltransferase N-terminal domain
  misc_feature: SWISSPROT Homolog: NMT1_ARATH Glycylpeptide N-tetradecanoyltransferase 1 (EC 2.3.1.97) with e-value of 1.6e-180 and BLAST sequence identity of 76.5
  misc_feature: SWISSPROT Homolog: NMT1_ARATH Peptide N-myristoyltransferase 1 Myristoyl-CoA:protein N-myristoyltransferase 1 (NMT 1) Type I N-myristoyltransferase 1
  misc_feature: SWISSPROT Homolog: NMT2_ARATH Probable glycylpeptide N-tetradecanoyltransferase 2 (EC 2.3.1.97) with e-value of 5.9e-133 and BLAST sequence identity of 62.2
  misc_feature: SWISSPROT Homolog: NMT2_ARATH Peptide N-myristoyltransferase 2 Myristoyl-CoA:protein N-myristoyltransferase 2 (NMT 2) Type I N-myristoyltransferase 2
  misc_feature: SWISSPROT Homolog: NMT2_MOUSE Glycylpeptide N-tetradecanoyltransferase 2 (EC 2.3.1.97) with e-value of 3.9e-120 and BLAST sequence identity of 57.7
  misc_feature: SWISSPROT Homolog: NMT2_MOUSE Peptide N-myristoyltransferase 2 Myristoyl-CoA:protein N-myristoyltransferase 2 (NMT 2) Type II N-myristoyltransferase
  misc_feature: SWISSPROT Homolog: NMT2_HUMAN Glycylpeptide N-tetradecanoyltransferase 2 (EC 2.3.1.97) with e-value of 1.0e-119 and BLAST sequence identity of 57.9
  misc_feature: SWISSPROT Homolog: NMT2_HUMAN Peptide N-myristoyltransferase 2 Myristoyl-CoA:protein N-myristoyltransferase 2 (NMT 2) Type II N-myristoyltransferase
  misc_feature: SWISSPROT Homolog: NMT1_HUMAN Glycylpeptide N-tetradecanoyltransferase 1 (EC 2.3.1.97) with e-value of 7.3e-119 and BLAST sequence identity of 52.8
  misc_feature: SWISSPROT Homolog: NMT1_HUMAN Peptide N-myristoyltransferase 1 Myristoyl-CoA:protein N-myristoyltransferase 1 (NMT 1) Type I N-myristoyltransferase
  misc_feature 303714:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (1)..(436): Functional Homolog of  Ceres CLONE ID no. 229604 at SEQ ID NO. 2744 with e-value of 2.50E-179 and BLAST sequence identity of 76.9
MADNNNNSLPGSSKDNPDHDSETNPVSKENSSLSTIVRRFKDSVSLGKTHKFWESQPVGQFKDIGDSNLPEGPIEPPTLLSEVKQEPYNLPSQYEWTTCDMESDETCVEVYNLLKNNYVEDDENMFRFNYSQEFLTWALRPPGYYRNWHIGVRAKTSKKLVAFITGVPARIRVRDEVVKMAEINFLCVHKKLRSKRLAPVMIKEVTRRVHLENIWQAAYTAGVVLPTPITTCQYWHRSLNPKKLIDVGFSRLGARMTMSRTIKLYKLPDSPATPGFRNMELRDVPAVTRLLRNYLSQFVVAPDFDENDVEHWLLPTENVVDSYLVESPETHEITDFCSFYTLPSSILGNQNHSTLKAAYSYYNVSMKTPLLQLMNDALIVAKQKDFDVFNALDVMHNEPFLKELKFGPGDGQLHYYLYNYRIRHALRPSELGLVLL

SEQ ID NO: 2702 - protein, 207 aa, Zea mays
  misc_feature (1)..(207): Ceres CLONE ID no. 230582
  misc_feature (1)..(207): Also Known As Ceres CDNA ID no. 23768927
  misc_feature (1)..(207): Also Known As Ceres GEMINI ID 552G7
  misc_feature (107)..(134): Pfam Name: NHL Pfam Description: NHL repeat
  misc_feature 303852:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
MAGSPRHLSLFPLRLLLLLPLLAAGKPVLEDGYTVTTFADLNPLPASGPHPYAVLPRSRAGDLLLLDSAGSALYTISLSSSPGEPRRLAGGKRGSGFNDGGPGDAAFDRPRSVAVDAADNVYVADRLHGAVRKVAPSGYTTTIAGGFSSGPGHRDGPAQNATFSSDFALVYVPKICALLVADRGNRMVRQINLKPEDCAHEKQSGKY

SEQ ID NO: 2703 - DNA, 843 bp, Populus balsamifera subsp. trichocarpa
  misc_feature (1)..(843): Ceres ANNOT ID no. 1502431
  misc_feature 303917:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atggcttctcaattctctttgctcatcctcatcctcttcctcttcaacctagcttcaattcatgtgacaggagatcagatcatgttagaagatgggtacatggtaactacagttttggatggacacaaattaaacataaaccctcatgcagttcaactcagatcatctgaaattgttgtcctcgattcttctcgtagtgttttttacactctaccatttcccatttctcaggccagcgtgatggttaaacggttatctggagaggggaaaactgggtacatagatggagaaccgggtttggctcggttcaataaaccaaagagttttgctgttgatcttagagggaatgtttatgtggctgatcaacaaaaccatgctgtcagaaagataagcaactcaggggtgacctccaccatcgtcgggaattactcccagacaggtcggcaagatggtccagggaaaactgcaacattctccagtgattttgaggtgctttttgttcctcaaatatgcgctttgctaatttcagatcatggaaatcagctgcttcgccagattgatcttaagccagaggattgtgtaattggttctcaatctggtgagaatctgaacatcttgcaatcttttacttcagcactcggagctgttaaattttgggttcttggactggcgctttcatgtttgcttggcatagtcatcgggattgcaactcgcccttatgttatcccccatacaggaaggctccagaccccttcatttcagcaagacatggaagcattgcctaatcaatctggcgagtctagtaccgatgagttgcttcgacgtcagaaacgcaattgctag

SEQ ID NO: 2704 - protein, 280 aa, Populus balsamifera subsp. trichocarpa
  misc_feature (1)..(280): Ceres ANNOT ID no. 1502431
  misc_feature (103)..(130): Pfam Name: NHL Pfam Description: NHL repeat
  misc_feature 303979:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(280): Functional Homolog of  Ceres CLONE ID no. 230582 at SEQ ID NO. 2749 with e-value of 5.79E-38 and BLAST sequence identity of 50.0
MASQFSLLILILFLFNLASIHVTGDQIMLEDGYMVTTVLDGHKLNINPHAVQLRSSEIVVLDSSRSVFYTLPFPISQASVMVKRLSGEGKTGYIDGEPGLARFNKPKSFAVDLRGNVYVADQQNHAVRKISNSGVTSTIVGNYSQTGRQDGPGKTATFSSDFEVLFVPQICALLISDHGNQLLRQIDLKPEDCVIGSQSGENLNILQSFTSALGAVKFWVLGLALSCLLGIVIGIATRPYVIPHTGRLQTPSFQQDMEALPNQSGESSTDELLRRQKRNC

SEQ ID NO: 2705 - protein, 116 aa, Zea mays
  misc_feature (1)..(116): Ceres CLONE ID no. 235706
  misc_feature (1)..(60): Pfam Name: dCMP_cyt_deam Pfam Description: Cytidine and deoxycytidylate deaminase zinc-binding region
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
MVLKHTDPTAHAEVTAIREACKKLGKIELSDCEIYASCEPCPMCFSAVHLSRIKRLVYGAKAEAAIAIGFDDFIADALRGTGFYQKANLEIKKADGNGALIAEQVFEKTKEKFQMY

SEQ ID NO: 2706 - DNA, 561 bp, Populus balsamifera subsp. trichocarpa; identical to SEQ ID NO: 809
  misc_feature (1)..(561): Ceres ANNOT ID no. 1462351
  misc_feature 304134:<222: Transcription Factor
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage

SEQ ID NO: 2707 - protein, 116 aa, Populus balsamifera subsp. trichocarpa
  misc_feature (1)..(116): Ceres ANNOT ID no. 1462351
  misc_feature (5)..(60): Pfam Name: dCMP_cyt_deam Pfam Description: Cytidine and deoxycytidylate deaminase zinc-binding region
  misc_feature: SWISSPROT Homolog: GUAD_BACSU Guanine deaminase (EC 3.5.4.3) (Guanase) (Guanine aminase) (Guanine aminohydrolase) (GAH) (GDEase) with e-value of 5.6e-18 and BLAST sequence identity of 56.8
  misc_feature: SWISSPROT Homolog: TADA_AQUAE tRNA-specific adenosine deaminase (EC 3.5.4.-) with e-value of 1.3e-11 and BLAST sequence identity of 51.9
  misc_feature: SWISSPROT Homolog: TADA_HAEIN tRNA-specific adenosine deaminase (EC 3.5.4.-) with e-value of 2.6e-11 and BLAST sequence identity of 45.2
  misc_feature: SWISSPROT Homolog: Y236_BUCBP Hypothetical protein bbp_236 with e-value of 7.0e-11 and BLAST sequence identity of 50.0
  misc_feature: SWISSPROT Homolog: TILS_DEIRA tRNA(Ile)-lysidine synthase (EC 6.3.4.-) (tRNA (Ile)-lysidine synthetase) (tRNA(Ile)-2-lysyl-cytidine synthase) with e-value of 1.1e-10 and BLAST sequence identity of 47.9
  misc_feature 304239:<222: Transcription Factor
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature (1)..(116): Functional Homolog of  Ceres CLONE ID no. 235706 at SEQ ID NO. 2752 with e-value of 1.20E-53 and BLAST sequence identity of 90.5
MVLKHTDPTAHAEVTAIREACKKLNQIELSDCEIYASCEPCPMCFGAIHLSRIKRLVYGAKAEAAIAIGFDDFIADALRGTSFYQKSQLEIKRADGTQAIIAEQVFEKTKEKFQMY

SEQ ID NO: 2708 - DNA, 543 bp, Populus balsamifera subsp. trichocarpa; identical to SEQ ID NO: 813
  misc_feature (1)..(543): Ceres ANNOT ID no. 1469462
  misc_feature 304310:<222: Transcription Factor
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage

SEQ ID NO: 2709 - protein, 116 aa, Populus balsamifera subsp. trichocarpa
  misc_feature (1)..(116): Ceres ANNOT ID no. 1469462
  misc_feature (7)..(60): Pfam Name: dCMP_cyt_deam Pfam Description: Cytidine and deoxycytidylate deaminase zinc-binding region
  misc_feature: SWISSPROT Homolog: GUAD_BACSU Guanine deaminase (EC 3.5.4.3) (Guanase) (Guanine aminase) (Guanine aminohydrolase) (GAH) (GDEase) with e-value of 5.6e-18 and BLAST sequence identity of 56.8
  misc_feature: SWISSPROT Homolog: TADA_AQUAE tRNA-specific adenosine deaminase (EC 3.5.4.-) with e-value of 1.3e-11 and BLAST sequence identity of 51.9
  misc_feature: SWISSPROT Homolog: TADA_HAEIN tRNA-specific adenosine deaminase (EC 3.5.4.-) with e-value of 2.6e-11 and BLAST sequence identity of 45.2
  misc_feature: SWISSPROT Homolog: Y236_BUCBP Hypothetical protein bbp_236 with e-value of 7.0e-11 and BLAST sequence identity of 50.0
  misc_feature: SWISSPROT Homolog: TILS_DEIRA tRNA(Ile)-lysidine synthase (EC 6.3.4.-) (tRNA (Ile)-lysidine synthetase) (tRNA(Ile)-2-lysyl-cytidine synthase) with e-value of 1.1e-10 and BLAST sequence identity of 47.9
  misc_feature 304415:<222: Transcription Factor
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature (1)..(116): Functional Homolog of  Ceres CLONE ID no. 235706 at SEQ ID NO. 2752 with e-value of 5.20E-53 and BLAST sequence identity of 88.7
MVLKNTDPTAHAEVTVIREACKKLNRIELSDCEIYASCEPCPMCFGAIHLSRLKRLVYGAEAEAAIAIGFDDFIADALRGTGFYQKAHLEIKKADGSGAVIAEQVFEKTKSKFTMY

SEQ ID NO: 2710 - DNA, 567 bp, Populus balsamifera subsp. trichocarpa; identical to SEQ ID NO: 811
  misc_feature (1)..(567): Ceres ANNOT ID no. 1488821
  misc_feature 304486:<222: Transcription Factor
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage

SEQ ID NO: 2711 - protein, 120 aa, Populus balsamifera subsp. trichocarpa
  misc_feature (1)..(120): Ceres ANNOT ID no. 1488821
  misc_feature (7)..(64): Pfam Name: dCMP_cyt_deam Pfam Description: Cytidine and deoxycytidylate deaminase zinc-binding region
  misc_feature: SWISSPROT Homolog: GUAD_BACSU Guanine deaminase (EC 3.5.4.3) (Guanase) (Guanine aminase) (Guanine aminohydrolase) (GAH) (GDEase) with e-value of 5.6e-18 and BLAST sequence identity of 56.8
  misc_feature: SWISSPROT Homolog: TADA_AQUAE tRNA-specific adenosine deaminase (EC 3.5.4.-) with e-value of 1.3e-11 and BLAST sequence identity of 51.9
  misc_feature: SWISSPROT Homolog: TADA_HAEIN tRNA-specific adenosine deaminase (EC 3.5.4.-) with e-value of 2.6e-11 and BLAST sequence identity of 45.2
  misc_feature: SWISSPROT Homolog: Y236_BUCBP Hypothetical protein bbp_236 with e-value of 7.0e-11 and BLAST sequence identity of 50.0
  misc_feature: SWISSPROT Homolog: TILS_DEIRA tRNA(Ile)-lysidine synthase (EC 6.3.4.-) (tRNA (Ile)-lysidine synthetase) (tRNA(Ile)-2-lysyl-cytidine synthase) with e-value of 1.1e-10 and BLAST sequence identity of 47.9
  misc_feature 304591:<222: Transcription Factor
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature (1)..(120): Functional Homolog of  Ceres CLONE ID no. 235706 at SEQ ID NO. 2752 with e-value of 9.70E-52 and BLAST sequence identity of 88.7
MVLKNTDPTAHAEVTAVREACKKLNRIELSDCEIYASCEPCPMCFGAIHLSRVKALQQRLVYGAEAEAAIAIGFDDFIADALRGTGFYQKAHLEIKKADGSGAVIAEQVFEKTKAKFTMY

SEQ ID NO: 2712 - protein, 190 aa, Zea mays
  misc_feature (1)..(190): Ceres CLONE ID no. 236747
  misc_feature (1)..(190): Also Known As Ceres CDNA ID no. 23785125
  misc_feature (1)..(190): Also Known As Ceres GEMINI ID 536D8
  misc_feature (109)..(181): Pfam Name: Pterin_4a Pfam Description: Pterin 4 alpha carbinolamine dehydratase
  misc_feature 304682:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MIRTATVRARLLLSRSYVAQAKAASRWPLVRWKASHLGSVRSFYQMDITRQYKNKILTARGCHSSPESQELAMKSCVPCNSKDLGPMSEDSAKKLLEQVNGWELITEGGVLKLHRTWKVKNFVKGLEFFQLVAAIAEEEGHHPDLHLVGWNNVKIDVWTHSVRGLTSNDFILAAKINHLTLDGIIRKKAK

SEQ ID NO: 2713 - DNA, 510 bp, Populus balsamifera subsp. trichocarpa
  misc_feature (1)..(510): Ceres ANNOT ID no. 1519379
  misc_feature 304744:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atgtggttaaatattagattgcttttgagaattttattttggccacccttatcagtttatggcatagtattaggacacaaccacttgcatgttggatatgggttattcttgttcattgaaacagttttgcttcctatgatagatttggctgcaaagaagtgtgtgccatgcaactcgaaggatctacaagccatgactgaagaaagtgcaaatgaccttctatcgaaggttgctgggtggaatttggtgaatgaaaatggtacactaaagctgaatcgttcatggaaagtaaagagtttcactaaagggctggaactattcaagcttgttgggaatgttgctgaagcagaaggtcaccatccggatcttcatctggttggatggaacaatataacaatcgagatatggactcatgcagtgggtggactaacggaaaacgacttcatacttgctgctaagataaatgggcttaacctgcaccacctactgaggaagaaggctgctgcttga

SEQ ID NO: 2714 - protein, 169 aa, Populus balsamifera subsp. trichocarpa
  misc_feature (1)..(169): Ceres ANNOT ID no. 1519379
  misc_feature (59)..(159): Pfam Name: Pterin_4a Pfam Description: Pterin 4 alpha carbinolamine dehydratase
  misc_feature: SWISSPROT Homolog: PHS_METCA Putative pterin-4-alpha-carbinolamine dehydratase with e-value of 8.8e-20 and BLAST sequence identity of 39.3
  misc_feature: SWISSPROT Homolog: PHS_METCA EC 4.2.1.96) (PHS)(4- alpha-hydroxy-tetrahydropterin dehydratase) ( Pterin carbinolamine dehydratase) (PCD)
  misc_feature: SWISSPROT Homolog: PHS_RICFE Putative pterin-4-alpha-carbinolamine dehydratase with e-value of 3.0e-19 and BLAST sequence identity of 40.9
  misc_feature: SWISSPROT Homolog: PHS_RICFE EC 4.2.1.96) (PHS)(4- alpha-hydroxy-tetrahydropterin dehydratase) ( Pterin carbinolamine dehydratase) (PCD)
  misc_feature: SWISSPROT Homolog: PHS_PELLD Putative pterin-4-alpha-carbinolamine dehydratase with e-value of 6.2e-19 and BLAST sequence identity of 39.1
  misc_feature: SWISSPROT Homolog: PHS_PELLD EC 4.2.1.96) (PHS)(4- alpha-hydroxy-tetrahydropterin dehydratase) ( Pterin carbinolamine dehydratase) (PCD)
  misc_feature: SWISSPROT Homolog: PHS_VIBCH Putative pterin-4-alpha-carbinolamine dehydratase with e-value of 9.1e-18 and BLAST sequence identity of 39.0
  misc_feature: SWISSPROT Homolog: PHS_VIBCH EC 4.2.1.96) (PHS)(4- alpha-hydroxy-tetrahydropterin dehydratase) ( Pterin carbinolamine dehydratase) (PCD)
  misc_feature: SWISSPROT Homolog: PHS_NITOC Putative pterin-4-alpha-carbinolamine dehydratase with e-value of 1.5e-17 and BLAST sequence identity of 39.3
  misc_feature: SWISSPROT Homolog: PHS_NITOC EC 4.2.1.96) (PHS)(4- alpha-hydroxy-tetrahydropterin dehydratase) ( Pterin carbinolamine dehydratase) (PCD)
  misc_feature 304875:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(169): Functional Homolog of  Ceres CLONE ID no. 236747 at SEQ ID NO. 2759 with e-value of 3.29E-42 and BLAST sequence identity of 66.6
MWLNIRLLLRILFWPPLSVYGIVLGHNHLHVGYGLFLFIETVLLPMIDLAAKKCVPCNSKDLQAMTEESANDLLSKVAGWNLVNENGTLKLNRSWKVKSFTKGLELFKLVGNVAEAEGHHPDLHLVGWNNITIEIWTHAVGGLTENDFILAAKINGLNLHHLLRKKAAA

SEQ ID NO: 2715 - protein, 257 aa, Zea mays
  misc_feature (1)..(257): Ceres CLONE ID no. 237356
  misc_feature (1)..(257): Also Known As Ceres CDNA ID no. 23782013
  misc_feature (1)..(257): Also Known As Ceres GEMINI ID 537E10
  misc_feature (10)..(239): Pfam Name: DUF599 Pfam Description: Protein of unknown function, DUF599
  misc_feature 304962:<222: Transcription Factor
  misc_feature: Phenotype: Activates expression of the gene endogenous to the AtDXPR (SEQ ID NO 4143) regalutory region Useful for modulating Terpenoid Biosynthesis
MEWRDSFLDLALIPLSLLLPMAYHAWLWREVRLRPLRTAVGINAATRRLWAIGMMKDNAKNAVTVVQSVRNVIMGSTLMATTAILFCTGVAAVLSSTYTIKKPLSDTVFGAHGEYMMALKYVALMLLFLLAFLCHSLAICFLNQASFLINTSACLFSSSADSDAAVLGLPLPPTRDYIGDVLERGFTLNLVGNRLFYAGVPLLLWIFGPLLAFLSSMVMVPILYSLDVVNLMGHSGCVVVSGKSAEMNGGSECARAV

SEQ ID NO: 2716 - DNA, 705 bp, Populus balsamifera subsp. trichocarpa
  misc_feature (1)..(705): Ceres ANNOT ID no. 1480939
  misc_feature 305038:<222: Transcription Factor
  misc_feature: Phenotype: Activates expression of the gene endogenous to the AtDXPR (SEQ ID NO 4143) regalutory region Useful for modulating Terpenoid Biosynthesis
atggagtggagaaaatgttatcttgatgttatactagtaccactagggtttatgatctccatggcttaccatggctggttatggcataaggttagaacgcaacctctcaccacaatcatcgggacaaatgctagcgggcggaggttttgggtttcagccataatgaaggataatgataagaagaacatactggcagtccaaactcttagaaacttgatcatgggatcaaccctaatggccaccacctccatccttctatccgctggcctggctgccattataagcagtacatacagtgtgaagaagccactaaatgatgcggtttatggggctcacggtgaattcatggtggcgttaaaatacgtcacaatcttaaccatcttcatgttctcattcttttgtcactctttgtccataaggtttgtgaaccaagttaacctgctcatcaatactccaccagatcccatgtccatggtgacctcagagtatgtaagcgagctcttagagaaggggtttgtcttgaacacagtggggaacaggctcttctactcagcgatgcctctcttgctttggatattcgggccagtccttgttttcttgtgttcagtcacaatggtcccagtgctttacaacttagactttgtgtttggtaacggacagggaaagattatgaataggaatggagagatcggagactttgtatga

SEQ ID NO: 2717 - protein, 234 aa, Populus balsamifera subsp. trichocarpa
  misc_feature (1)..(234): Ceres ANNOT ID no. 1480939
  misc_feature (10)..(216): Pfam Name: DUF599 Pfam Description: Protein of unknown function, DUF599
  misc_feature 305093:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(234): Functional Homolog of  Ceres CLONE ID no. 237356 at SEQ ID NO. 2762 with e-value of 7.80E-66 and BLAST sequence identity of 57.6
MEWRKCYLDVILVPLGFMISMAYHGWLWHKVRTQPLTTIIGTNASGRRFWVSAIMKDNDKKNILAVQTLRNLIMGSTLMATTSILLSAGLAAIISSTYSVKKPLNDAVYGAHGEFMVALKYVTILTIFMFSFFCHSLSIRFVNQVNLLINTPPDPMSMVTSEYVSELLEKGFVLNTVGNRLFYSAMPLLLWIFGPVLVFLCSVTMVPVLYNLDFVFGNGQGKIMNRNGEIGDFV

SEQ ID NO: 2718 - protein, 229 aa, Zea mays
  misc_feature (1)..(229): Ceres CLONE ID no. 241379
  misc_feature (104)..(188): Pfam Name: Ribosomal_S3_C Pfam Description: Ribosomal protein S3, C-terminal domain
  misc_feature (45)..(102): Pfam Name: KH_2 Pfam Description: KH domain
  misc_feature: Phenotype: INFLORESCENCE - Asecondary Branching Useful for making ornamental plants with modified flowers
  misc_feature: Phenotype: CAULINE LEAVES - Curled 1 Useful for making ornamental plants with altered leaf shape
  misc_feature: Phenotype: ROSETTE LEAVES - Curled 2 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - No Branching Useful for modifying plant architecture, ie amount of  branching
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRYVMESGAKGCEVIVSGKLRAQRAKSMKFKDGYMISSGQPVNEYIDSAVRHVLLRQGVLGIKVKIMLDWDPKGKVGPITPLPDLVTIHTPKDEDEPRPPVLAPPEV

SEQ ID NO: 2719 - DNA, 702 bp, Populus balsamifera subsp. trichocarpa
  misc_feature (1)..(702): Ceres ANNOT ID no. 1526950
  misc_feature 305320:<222: Transcription Factor
  misc_feature: Phenotype: INFLORESCENCE - Asecondary Branching Useful for making ornamental plants with modified flowers
  misc_feature: Phenotype: CAULINE LEAVES - Curled 1 Useful for making ornamental plants with altered leaf shape
  misc_feature: Phenotype: ROSETTE LEAVES - Curled 2 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - No Branching Useful for modifying plant architecture, ie amount of  branching
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atggccactcaaatcagtaagaaacgcaagtttgttgcggatggagttttctacgcagaactgaacgaggtattgactagagaattggctgaggatggatactctggtgttgaagttagggttactcccatgcgcaccgagatcatcatcagggctactcgtacccaaaatgttcttggtgagaagggaaggaggatcagggagctcacttccgttgtccagaaacgtttcaagtttcccgagaatggtgtcgagctctatgctgagaaagttaacaacaggggtctctgtgccattgcgcaggccgagtctcttcgttacaagctccttggaggccttgctgttcgcagggcttgttatggagtgttgaggtttgtaatggagagtggggcaaaaggatgtgaggttattgtgagtggaaagcttcgggcacagcgtgccaaatccatgaaattcaaggatgggtacatgatatcctctggccaacctgttaaagagtatattgattcagctgttaggcatgttcttcttagacagggtgtgcttggtatcaaggtcaagatcatgcttgactgggatccaaagggcaaggttgggccaatgacaccattacctgatctggtcacaatccatcctcccaaggaagaagaagagtatgttccaccattgttgaccaccaatattgagatcccagtagcataa

SEQ ID NO: 2720 - protein, 233 aa, Populus balsamifera subsp. trichocarpa
  misc_feature (1)..(233): Ceres ANNOT ID no. 1526950
  misc_feature (104)..(188): Pfam Name: Ribosomal_S3_C Pfam Description: Ribosomal protein S3, C-terminal domain
  misc_feature (45)..(102): Pfam Name: KH_2 Pfam Description: KH domain
  misc_feature: SWISSPROT Homolog: RS31_XENLA 40S ribosomal protein S3-A (S1A) with e-value of 4.6e-94 and BLAST sequence identity of 82.5
  misc_feature: SWISSPROT Homolog: RS3_MOUSE 40S ribosomal protein S3 with e-value of 5.9e-94 and BLAST sequence identity of 82.5
  misc_feature: SWISSPROT Homolog: RS3_RAT 40S ribosomal protein S3 with e-value of 5.9e-94 and BLAST sequence identity of 82.5
  misc_feature: SWISSPROT Homolog: RS3_BOVIN 40S ribosomal protein S3 with e-value of 7.5e-94 and BLAST sequence identity of 82.5
  misc_feature: SWISSPROT Homolog: RS3_HUMAN 40S ribosomal protein S3 with e-value of 7.5e-94 and BLAST sequence identity of 82.5
  misc_feature 305487:<222: Transcription Factor
  misc_feature: Phenotype: INFLORESCENCE - Asecondary Branching Useful for making ornamental plants with modified flowers
  misc_feature: Phenotype: CAULINE LEAVES - Curled 1 Useful for making ornamental plants with altered leaf shape
  misc_feature: Phenotype: ROSETTE LEAVES - Curled 2 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - No Branching Useful for modifying plant architecture, ie amount of  branching
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(233): Functional Homolog of  Ceres CLONE ID no. 241379 at SEQ ID NO. 2765 with e-value of 2.49E-108 and BLAST sequence identity of 93.75
MATQISKKRKFVADGVFYAELNEVLTRELAEDGYSGVEVRVTPMRTEIIIRATRTQNVLGEKGRRIRELTSVVQKRFKFPENGVELYAEKVNNRGLCAIAQAESLRYKLLGGLAVRRACYGVLRFVMESGAKGCEVIVSGKLRAQRAKSMKFKDGYMISSGQPVKEYIDSAVRHVLLRQGVLGIKVKIMLDWDPKGKVGPMTPLPDLVTIHPPKEEEEYVPPLLTTNIEIPVA

SEQ ID NO: 2721 - DNA, 711 bp, Populus balsamifera subsp. trichocarpa
  misc_feature (1)..(711): Ceres ANNOT ID no. 1508362
  misc_feature 305635:<222: Transcription Factor
  misc_feature: Phenotype: INFLORESCENCE - Asecondary Branching Useful for making ornamental plants with modified flowers
  misc_feature: Phenotype: CAULINE LEAVES - Curled 1 Useful for making ornamental plants with altered leaf shape
  misc_feature: Phenotype: ROSETTE LEAVES - Curled 2 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - No Branching Useful for modifying plant architecture, ie amount of  branching
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atggctacccaaatcagtaagaagcgcaaatttgttgcggatggagttttctacgcagagctgaatgaggtattgaccagagaattggctgaggatggatactctggtgttgaagttagggttactccgatgcgcactgagatcatcatcagggctactcgtactcaaaatgttcttggtgagaagggaaggaggatcagggagctgacttctgttgttcagaaacgttttaagtttcctgagaatggtgtggagctctatgctgagaaagttaacaacaggggtctctgtgccattgctcaggctgagtctcttcgttacaagcttcttggaggccttgctgttcgcagggcttgctatggtgtcctgagatttgtaatggagagtggggcaaaaggatgtgaggttattgtgagtggaaagcttagggcacagcgtgccaaatccatgaaatttaaggatgggtacatgatatcctctggccaacctgttaaagaatatattgatgcagctgttaggcatgttcttcttagacagggagtgcttggtatcaaggtcaagatcatgcttgactgggatcctaagggcaaggtggggccaatgactccactacctgatctggtcaccatccatcctcccaaggaagaagaagagtatgttgctccaccagtgatgacaaccaatatcgagattccagtagcattagcataa

SEQ ID NO: 2722 - protein, 236 aa, Populus balsamifera subsp. trichocarpa
  misc_feature (1)..(236): Ceres ANNOT ID no. 1508362
  misc_feature (104)..(188): Pfam Name: Ribosomal_S3_C Pfam Description: Ribosomal protein S3, C-terminal domain
  misc_feature (45)..(102): Pfam Name: KH_2 Pfam Description: KH domain
  misc_feature: SWISSPROT Homolog: RS31_XENLA 40S ribosomal protein S3-A (S1A) with e-value of 4.6e-94 and BLAST sequence identity of 82.5
  misc_feature: SWISSPROT Homolog: RS3_MOUSE 40S ribosomal protein S3 with e-value of 5.9e-94 and BLAST sequence identity of 82.5
  misc_feature: SWISSPROT Homolog: RS3_RAT 40S ribosomal protein S3 with e-value of 5.9e-94 and BLAST sequence identity of 82.5
  misc_feature: SWISSPROT Homolog: RS3_BOVIN 40S ribosomal protein S3 with e-value of 7.5e-94 and BLAST sequence identity of 82.5
  misc_feature: SWISSPROT Homolog: RS3_HUMAN 40S ribosomal protein S3 with e-value of 7.5e-94 and BLAST sequence identity of 82.5
  misc_feature 305802:<222: Transcription Factor
  misc_feature: Phenotype: INFLORESCENCE - Asecondary Branching Useful for making ornamental plants with modified flowers
  misc_feature: Phenotype: CAULINE LEAVES - Curled 1 Useful for making ornamental plants with altered leaf shape
  misc_feature: Phenotype: ROSETTE LEAVES - Curled 2 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - No Branching Useful for modifying plant architecture, ie amount of  branching
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(236): Functional Homolog of  Ceres CLONE ID no. 241379 at SEQ ID NO. 2765 with e-value of 1.79E-107 and BLAST sequence identity of 93.3
MATQISKKRKFVADGVFYAELNEVLTRELAEDGYSGVEVRVTPMRTEIIIRATRTQNVLGEKGRRIRELTSVVQKRFKFPENGVELYAEKVNNRGLCAIAQAESLRYKLLGGLAVRRACYGVLRFVMESGAKGCEVIVSGKLRAQRAKSMKFKDGYMISSGQPVKEYIDAAVRHVLLRQGVLGIKVKIMLDWDPKGKVGPMTPLPDLVTIHPPKEEEEYVAPPVMTTNIEIPVALA

SEQ ID NO: 2723 - DNA, 681 bp, Populus balsamifera subsp. trichocarpa
  misc_feature (1)..(681): Ceres ANNOT ID no. 1477361
  misc_feature 305950:<222: Transcription Factor
  misc_feature: Phenotype: INFLORESCENCE - Asecondary Branching Useful for making ornamental plants with modified flowers
  misc_feature: Phenotype: CAULINE LEAVES - Curled 1 Useful for making ornamental plants with altered leaf shape
  misc_feature: Phenotype: ROSETTE LEAVES - Curled 2 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - No Branching Useful for modifying plant architecture, ie amount of  branching
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atggctacccaaatcaatggcgttttctatgcagaactgaatgaggtattgactagagaattggctgaggatgggtactctggtgttgaagttagggttacaccgatgcgcactgagatcatcatcagggctactcgtacccaaaatgttcttggtgagaaggggaggaggatcagggaactgacctctgttgttcagaaacgttttaagtttcctgagaatggtgtggagctttatgctgagaaagttaataacaggggtctctgtgcaattgctcaggctgagtctcttcgttacaagcttcttggaggccttgctgttcgcagggcttgctatggggtcctgagatttgtaatggagagtggagcaaaaggatgtgaggttattgtgagtggaaagctccgagcacaacgtgccaagtccatgaaatttaaggacgggtacatgatatcctccggccaacctgttaaagagtatattgattcagctgttaggcatgttcttcttagacagggtgtgcttggtatcaaggtcaagatcatgcttgactgggatcctaagggcaaggtggggcccatgacaccattgcctgatctggttaccatccatcctcccaaggaagatgaggagtatgttgctccaccagtaatgacagccaatattgagattccagtagtataa

SEQ ID NO: 2724 - protein, 226 aa, Populus balsamifera subsp. trichocarpa
  misc_feature (1)..(226): Ceres ANNOT ID no. 1477361
  misc_feature (37)..(94): Pfam Name: KH_2 Pfam Description: KH domain
  misc_feature (96)..(180): Pfam Name: Ribosomal_S3_C Pfam Description: Ribosomal protein S3, C-terminal domain
  misc_feature: SWISSPROT Homolog: RS31_XENLA 40S ribosomal protein S3-A (S1A) with e-value of 4.6e-94 and BLAST sequence identity of 82.5
  misc_feature: SWISSPROT Homolog: RS3_MOUSE 40S ribosomal protein S3 with e-value of 5.9e-94 and BLAST sequence identity of 82.5
  misc_feature: SWISSPROT Homolog: RS3_RAT 40S ribosomal protein S3 with e-value of 5.9e-94 and BLAST sequence identity of 82.5
  misc_feature: SWISSPROT Homolog: RS3_BOVIN 40S ribosomal protein S3 with e-value of 7.5e-94 and BLAST sequence identity of 82.5
  misc_feature: SWISSPROT Homolog: RS3_HUMAN 40S ribosomal protein S3 with e-value of 7.5e-94 and BLAST sequence identity of 82.5
  misc_feature 306117:<222: Transcription Factor
  misc_feature: Phenotype: INFLORESCENCE - Asecondary Branching Useful for making ornamental plants with modified flowers
  misc_feature: Phenotype: CAULINE LEAVES - Curled 1 Useful for making ornamental plants with altered leaf shape
  misc_feature: Phenotype: ROSETTE LEAVES - Curled 2 Useful for making ornamental plants with altered leaf shape
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: INFLORESCENCE - No Branching Useful for modifying plant architecture, ie amount of  branching
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(226): Functional Homolog of  Ceres CLONE ID no. 241379 at SEQ ID NO. 2765 with e-value of 3.99E-101 and BLAST sequence identity of 93.3
MATQINGVFYAELNEVLTRELAEDGYSGVEVRVTPMRTEIIIRATRTQNVLGEKGRRIRELTSVVQKRFKFPENGVELYAEKVNNRGLCAIAQAESLRYKLLGGLAVRRACYGVLRFVMESGAKGCEVIVSGKLRAQRAKSMKFKDGYMISSGQPVKEYIDSAVRHVLLRQGVLGIKVKIMLDWDPKGKVGPMTPLPDLVTIHPPKEDEEYVAPPVMTANIEIPVV

SEQ ID NO: 2725 - protein, 235 aa, Zea mays
  misc_feature (1)..(235): Ceres CLONE ID no. 244916
  misc_feature (1)..(235): Also Known As Ceres CDNA ID no. 23766279
  misc_feature (1)..(235): Also Known As Ceres GEMINI ID 531C10
  misc_feature (113)..(178): Pfam Name: K-box Pfam Description: K-box region
  misc_feature (13)..(63): Pfam Name: SRF-TF Pfam Description: SRF-type transcription factor DNA-binding and dimerisation domain)
  misc_feature 306292:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MVGTGKRERIAIRRIDNLAARQVTFSKRRRGLFKKAEELSILCDAEVGLVVFSATGKLFHFASSSMKQVIDRYDSHSKTLQRSEPQSSQLQSHMDDGTCARLKEELAETSLKLRQMRGEELQRLSVEQLQELEKTLESGLGSVLKTKSQKILDEISGLERKRTRLIEENSRLKEQLQVTRMSRMETQLGADPEFVYEEGQSSESVTNTSYPRPSTDTDDCSDTSLRLGLPLFSSK

SEQ ID NO: 2726 - DNA, 732 bp, Populus balsamifera subsp. trichocarpa
  misc_feature (1)..(732): Ceres ANNOT ID no. 1510619
  misc_feature 306363:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggcaagagagaggattcagataaaaaagatcgataacgccaccgctaggcaagtcacgttttcaaaacgaagaagagggcttttcaagaaagctgaggagctttcagttctctgtgatgctgatgttgctctcatcatcttctcctccactggcaagctctttgagttctccagctcaagcatgaaggaaatactggaaaggcataatttgcactcgaagaatcttgagaagctggagcaaccatctcttgagttgcagctggtagaagacagcacctgctccaggttgagtaaggaagttgcggagaaaagccatcagctgaggcaaatgagaggggaagatctgcgaggattggatatagacgaattgctgcagctagagaagtctcttgaggctggattgagctgtgtgatagagaagaagggtgagaagattatgaacgagatcactgatcttcaaagaaagggaatgcaattgatggaagagaatgagagactcaaacagcaagtggtggagatatctaatggccgaaagcatgttacagctgattcagagaatgttggttacgaggaagggcagtcatcagagtccgtaaccaatgtctgcaactcaaatggccctctacatgattatgaaagctctgatacatccctcaagttggggttagttcagcacatacaaagaggattttatacttctgtctctgtgtgtttgtctgctgttacttga

SEQ ID NO: 2727 - protein, 243 aa, Populus balsamifera subsp. trichocarpa
  misc_feature (1)..(243): Ceres ANNOT ID no. 1510619
  misc_feature (107)..(173): Pfam Name: K-box Pfam Description: K-box region
  misc_feature (9)..(59): Pfam Name: SRF-TF Pfam Description: SRF-type transcription factor DNA-binding and dimerisation domain)
  misc_feature: SWISSPROT Homolog: MAD47_ORYSA MADS-box transcription factor 47 (OsMADS47) with e-value of 4.3e-91 and BLAST sequence identity of 83.3
  misc_feature: SWISSPROT Homolog: SVP_ARATH SHORT VEGETATIVE PHASE protein with e-value of 2.7e-57 and BLAST sequence identity of 54.2
  misc_feature: SWISSPROT Homolog: MAD22_ORYSA MADS-box transcription factor 22 (OsMADS22) with e-value of 5.6e-57 and BLAST sequence identity of 56.2
  misc_feature: SWISSPROT Homolog: JOIN_LYCES MADS-box JOINTLESS protein (LeMADS) with e-value of 1.8e-53 and BLAST sequence identity of 50.8
  misc_feature: SWISSPROT Homolog: MAD27_ORYSA MADS-box transcription factor 27 (OsMADS27) (RMADS218) with e-value of 1.0e-34 and BLAST sequence identity of 40.6
  misc_feature 306467:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(243): Functional Homolog of  Ceres CLONE ID no. 244916 at SEQ ID NO. 2772 with e-value of 1.40E-59 and BLAST sequence identity of 57.2
MARERIQIKKIDNATARQVTFSKRRRGLFKKAEELSVLCDADVALIIFSSTGKLFEFSSSSMKEILERHNLHSKNLEKLEQPSLELQLVEDSTCSRLSKEVAEKSHQLRQMRGEDLRGLDIDELLQLEKSLEAGLSCVIEKKGEKIMNEITDLQRKGMQLMEENERLKQQVVEISNGRKHVTADSENVGYEEGQSSESVTNVCNSNGPLHDYESSDTSLKLGLVQHIQRGFYTSVSVCLSAVT

SEQ ID NO: 2728 - protein, 52 aa, Arabidopsis thaliana
  misc_feature (1)..(52): Ceres CLONE ID no. 250132
  misc_feature (16)..(40): Pfam Name: zf-A20 Pfam Description: A20-like zinc finger
MGSEQNDSTSFSPSEPKLCVKGCGFFGSPSNMNLCSKCYQRHPSHGGTNRFR

SEQ ID NO: 2729 - DNA, 150 bp, Populus balsamifera subsp. trichocarpa
  misc_feature (1)..(150): Ceres ANNOT ID no. 1527653
  misc_feature 306582:<222: Transcription Factor
atggattcacaagacaatttgactcgtacgctgtgcgccaagggctgtggcttctttgggtctccagagaacaaaaatctatgttcaaagtgttacaaagattatctcaaagaagaggtgattgttaaagactgccaacaaactctctga

SEQ ID NO: 2730 - protein, 49 aa, Populus balsamifera subsp. trichocarpa
  misc_feature (1)..(49): Ceres ANNOT ID no. 1527653
  misc_feature (9)..(33): Pfam Name: zf-A20 Pfam Description: A20-like zinc finger
  misc_feature: SWISSPROT Homolog: ZF2N1_ARATH Zinc finger A20 and AN1 domains-containing protein At1g12440 with e-value of 2.1e-18 and BLAST sequence identity of 97.5
  misc_feature: SWISSPROT Homolog: ZF2N3_ARATH Zinc finger A20 and AN1 domains-containing protein At4g12040 with e-value of 2.0e-15 and BLAST sequence identity of 82.5
  misc_feature: SWISSPROT Homolog: ZF2N2_ARATH Zinc finger A20 and AN1 domains-containing protein At2g36320 with e-value of 4.1e-06 and BLAST sequence identity of 60.7
  misc_feature 306633:<222: Transcription Factor
  misc_feature (1)..(49): Functional Homolog of  Ceres CLONE ID no. 250132 at SEQ ID NO. 2775 with e-value of 1.19E-7 and BLAST sequence identity of 82.6
MDSQDNLTRTLCAKGCGFFGSPENKNLCSKCYKDYLKEEVIVKDCQQTL

SEQ ID NO: 2731 - protein, 295 aa, Arabidopsis thaliana
  misc_feature (1)..(295): Ceres CLONE ID no. 254065
  misc_feature (6)..(73): Pfam Name: RRM_1 Pfam Description: RNA recognition motif. (a.k.a. RRM RBD, or RNP domain)
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Other Useful for making ornamental plants with modified leaves
MSMVTVKVSNVSLEATERDLKEFFSFSGDIAYLETQSENDGSKLAYVTFKDLQGAETAVLLTGSTIVDSSVTVTMSPDYQLPPDALASIESLKESNKSSSPTREDVSVFRKAEDVVSGMISKGFVLGKDAIAKAKSLDEKHQLTSTASARVTSFDKRIGFTEKINTGTTVVSEKVKEVDQKFQVTEKTKSAIAAAEQTVSNAGSAIMKNRYVLTGATWVTGAFNRVSKAAEEVGQKAKEKVGLAEEEEEEKKKVVDEVAIVHLTESPKALDQSEQDSKLPESKSQPHKELNASVV

SEQ ID NO: 2732 - DNA, 876 bp, Populus balsamifera subsp. trichocarpa; identical to SEQ ID NO: 1431
  misc_feature (1)..(876): Ceres ANNOT ID no. 1485544
  misc_feature 306778:<222: Transcription Factor
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Other Useful for making ornamental plants with modified leaves

SEQ ID NO: 2733 - protein, 288 aa, Populus balsamifera subsp. trichocarpa; identical to SEQ ID NO: 1432
  misc_feature (1)..(288): Ceres ANNOT ID no. 1485544
  misc_feature (14)..(81): Pfam Name: RRM_1 Pfam Description: RNA recognition motif. (a.k.a. RRM RBD, or RNP domain)
  misc_feature: SWISSPROT Homolog: VIP1_SCHPO Protein vip1 with e-value of 7.9e-10 and BLAST sequence identity of 24.4
  misc_feature 306868:<222: Transcription Factor
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Other Useful for making ornamental plants with modified leaves
  misc_feature (1)..(288): Functional Homolog of  Ceres CLONE ID no. 254065 at SEQ ID NO. 2778 with e-value of 4.00E-94 and BLAST sequence identity of 71.5

SEQ ID NO: 2734 - DNA, 870 bp, Populus balsamifera subsp. trichocarpa; identical to SEQ ID NO: 1433
  misc_feature (1)..(870): Ceres ANNOT ID no. 1447051
  misc_feature 306979:<222: Transcription Factor
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Other Useful for making ornamental plants with modified leaves

SEQ ID NO: 2735 - protein, 289 aa, Populus balsamifera subsp. trichocarpa; identical to SEQ ID NO: 1434
  misc_feature (1)..(289): Ceres ANNOT ID no. 1447051
  misc_feature (22)..(89): Pfam Name: RRM_1 Pfam Description: RNA recognition motif. (a.k.a. RRM RBD, or RNP domain)
  misc_feature: SWISSPROT Homolog: VIP1_SCHPO Protein vip1 with e-value of 7.9e-10 and BLAST sequence identity of 24.4
  misc_feature 307069:<222: Transcription Factor
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Other Useful for making ornamental plants with modified leaves
  misc_feature (1)..(289): Functional Homolog of  Ceres CLONE ID no. 254065 at SEQ ID NO. 2778 with e-value of 5.59E-88 and BLAST sequence identity of 70.4

SEQ ID NO: 2736 - DNA, 933 bp, Populus balsamifera subsp. trichocarpa
  misc_feature (1)..(933): Ceres ANNOT ID no. 1517016
  misc_feature 307180:<222: Transcription Factor
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Other Useful for making ornamental plants with modified leaves
atgtcgtcgacgtcggttccgatacaggaagatgctggtcagaaaaccgaagctctaccccagtcaaatagtgcaacggactggacagtcaatgtttcagatgtaagaacagttaaagtcagcaacatttcattaactgctactgatagggatatcgaagagtttttctccttctctggtgatattctatatgtcgaaatgcgaagggaaagtgaaacaactcagcttgcctatgttacattcgaggagtcgcatggagctgatacggcgatgcttctttcaggagccatcgtagctgatctttctgttttgattacacctgttgaggattatcaactgccccctgaagctctttcatcaaaattggagcaaaagccacctgctactgattctgctgttaagaaggctgaagatgtggtgagcaccatgcttgccaagggctttgtattggggaaggatgccatcaacaagggcaaagcctttgatgaacgtattcatctgacttcaaatgcctctgcaacagttgcttcaattgaccataagatgggtctgagtgaaaagcttagtgtgggtacagctgtggtgaatgaaaaggtccgggagatggatgagaagttccaagtgcttgtaaagacgaaaactgtcctttcagtagctgagcagaaggcaagcagtgtaggatctgccatcatgagtaacccttacgtatccacaggagcttcatgggtttcaggtgcatttactgcagtggcaaaggcagctgaggatgtgagcgtgatgaccagggagaaagttgaaaaggctgaagaggaaaaaatagagattcctgtcagcgaggggagcccagcacacatccatcacaatggatctccagcgggagagcctccagtgattccaattgattcagcagatagtaagcttgcaaatatctga

SEQ ID NO: 2737 - protein, 310 aa, Populus balsamifera subsp. trichocarpa
  misc_feature (1)..(310): Ceres ANNOT ID no. 1517016
  misc_feature (38)..(105): Pfam Name: RRM_1 Pfam Description: RNA recognition motif. (a.k.a. RRM RBD, or RNP domain)
  misc_feature: SWISSPROT Homolog: VIP1_SCHPO Protein vip1 with e-value of 7.9e-10 and BLAST sequence identity of 24.4
  misc_feature 307272:<222: Transcription Factor
  misc_feature: Phenotype: WHOLE PLANT - Small Useful for modulating plant size
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Other Useful for making ornamental plants with modified leaves
  misc_feature (1)..(310): Functional Homolog of  Ceres CLONE ID no. 254065 at SEQ ID NO. 2778 with e-value of 4.80E-66 and BLAST sequence identity of 55.6
MSSTSVPIQEDAGQKTEALPQSNSATDWTVNVSDVRTVKVSNISLTATDRDIEEFFSFSGDILYVEMRRESETTQLAYVTFEESHGADTAMLLSGAIVADLSVLITPVEDYQLPPEALSSKLEQKPPATDSAVKKAEDVVSTMLAKGFVLGKDAINKGKAFDERIHLTSNASATVASIDHKMGLSEKLSVGTAVVNEKVREMDEKFQVLVKTKTVLSVAEQKASSVGSAIMSNPYVSTGASWVSGAFTAVAKAAEDVSVMTREKVEKAEEEKIEIPVSEGSPAHIHHNGSPAGEPPVIPIDSADSKLANI

SEQ ID NO: 2738 - protein, 157 aa, Arabidopsis thaliana
  misc_feature (1)..(157): Ceres CLONE ID no. 256433
  misc_feature: Utility: High Sucrose Useful for making plants with enhanced tolerance to drought
  misc_feature: Phenotype: WHOLE PLANT - High Sucrose Useful for making plants with enhanced tolerance to drought
MATCWPEPIVSVQSLSQTGVPTVPNRYVKPAHQRPVFNTTQSDAGIEIPVLDMNDVWGKPEGLRLVRSACEEWGFFQMVNHGVTHSLMERVRGAWREFFELPLEEKRKYANSPDTYEGYGSRLGVVRDAKLDWSDYFFLNYLPSSIRNPSKWPYSAS

SEQ ID NO: 2739 - DNA, 1104 bp, Populus balsamifera subsp. trichocarpa
  misc_feature (1)..(1104): Ceres ANNOT ID no. 1475918
  misc_feature: Utility: High Sucrose Useful for making plants with enhanced tolerance to drought
  misc_feature 307450:<222: Transcription Factor
  misc_feature: Phenotype: WHOLE PLANT - High Sucrose Useful for making plants with enhanced tolerance to drought
atgatgaactgcttgcagagttggccagaacctgtggttcgagtccaatctttagccgcaagtggtatccaggcaatcccagagcgttatgttaagccaccttctcacagaccgttatcaaacagtgatttctcactacctcaggaggtcaacattcctgttattgatttccaaaacgttttctctaacgaccaacgcctccgcgaagaggccctccgttgtatctacagagcctgtagtgaatggggcttctttcaagtagtgaaccatggtgtgagccacgaactgatgaagggggttcgtgagatttggcgcgagttctttaacctgccagtagaagtgaagcaagagtatgctaacagtcctgctacgtatgaggggtatggtagccggttgggcgtggagaaaggagcaactcttgattggagtgattatttcttccttcattacatgcctgtttctctcagaaaccaaaacaagtggcctgcaaccccagcttcttgccgggaattggtagctgagtacggccgcgaggtggttaaacttggtggaaagctgatgaaggcattctctatgaaccttggcctggaagaggacttcctccttgatgcttttggcggagaggaaaatgtcggtgcatgtttaagggttaattactatccaaagtgtccacagccagacctcacactaggcctctcgccgcactccgaccctggtggaatgaccattctcctgcctgatgaaaacgtggctggactgcaagtccgtagaaaggacagttgggtcaccgttaagccagcaccaaacgcctttattataaacataggggatcaaatccaggtactgagcaatgccatctaccagagcgtggagcacagggtgattgtgaattctaataaagatagagtctctcttgccttcttctataaccccaagagtgacttgctcattgaaccatccaaggaactcgtcaccgtcgaccggccggccctctacccaccgatgacattcgatgaatacagactttacattaggacaaagggtccctgcggcaagaaacaagttgaatccctaaaatctcctagtccatgtaatgaatgttga

SEQ ID NO: 2740 - protein, 366 aa, Populus balsamifera subsp. trichocarpa
  misc_feature (1)..(366): Ceres ANNOT ID no. 1475918
  misc_feature (210)..(310): Pfam Name: 2OG-FeII_Oxy Pfam Description: 2OG-Fe(II) oxygenase superfamily
  misc_feature: SWISSPROT Homolog: LDOX_VITVI Leucoanthocyanidin dioxygenase (EC 1.14.11.19) (LDOX) (Leucocyanidin oxygenase) (Leucoanthocyanidin hydroxylase) with e-value of 1.1e-23 and BLAST sequence identity of 35.4
  misc_feature: SWISSPROT Homolog: LDOX_MALDO Leucoanthocyanidin dioxygenase with e-value of 2.8e-23 and BLAST sequence identity of 33.3
  misc_feature: SWISSPROT Homolog: LDOX_MALDO EC 1.14.11.19 (LDOX) (Leucocyanidin oxygenase) Leucoanthocyanidin hydroxylase Anthocyanidin synthase
  misc_feature: SWISSPROT Homolog: LDOX_ARATH Leucoanthocyanidin dioxygenase with e-value of 5.8e-23 and BLAST sequence identity of 35.0
  misc_feature: SWISSPROT Homolog: LDOX_ARATH EC 1.14.11.19 (LDOX)(Leucocyanidin oxygenase) Leucoanthocyanidin hydroxylase Anthocyanidin synthase (ANS)
  misc_feature: SWISSPROT Homolog: LDOX_PETHY Leucoanthocyanidin dioxygenase (EC 1.14.11.19) (LDOX) (Leucocyanidin oxygenase) (Leucoanthocyanidin hydroxylase) with e-value of 2.8e-22 and BLAST sequence identity of 34.2
  misc_feature: SWISSPROT Homolog: LDOX_PERFR Leucoanthocyanidin dioxygenase (EC 1.14.11.19) (LDOX) (Leucocyanidin oxygenase) (Leucoanthocyanidin hydroxylase) with e-value of 8.6e-22 and BLAST sequence identity of 32.7
  misc_feature: Utility: High Sucrose Useful for making plants with enhanced tolerance to drought
  misc_feature 307581:<222: Transcription Factor
  misc_feature: Phenotype: WHOLE PLANT - High Sucrose Useful for making plants with enhanced tolerance to drought
  misc_feature (1)..(366): Functional Homolog of  Ceres CLONE ID no. 256433 at SEQ ID NO. 2785 with e-value of 9.29E-47 and BLAST sequence identity of 59.7
MNCLQSWPEPVVRVQSLAASGIQAIPERYVKPPSHRPLSNSDFSLPQEVNIPVIDFQNVFSNDQRLREEALRCIYRACSEWGFFQVVNHGVSHELMKGVREIWREFFNLPVEVKQEYANSPATYEGYGSRLGVEKGATLDWSDYFFLHYMPVSLRNQNKWPATPASCRELVAEYGREVVKLGGKLMKAFSMNLGLEEDFLLDAFGGEENVGACLRVNYYPKCPQPDLTLGLSPHSDPGGMTILLPDENVAGLQVRRKDSWVTVKPAPNAFIINIGDQIQVLSNAIYQSVEHRVIVNSNKDRVSLAFFYNPKSDLLIEPSKELVTVDRPALYPPMTFDEYRLYIRTKGPCGKKQVESLKSPSPCNEC

SEQ ID NO: 2741 - DNA, 1062 bp, Populus balsamifera subsp. trichocarpa
  misc_feature (1)..(1062): Ceres ANNOT ID no. 1507347
  misc_feature: Utility: High Sucrose Useful for making plants with enhanced tolerance to drought
  misc_feature 307689:<222: Transcription Factor
  misc_feature: Phenotype: WHOLE PLANT - High Sucrose Useful for making plants with enhanced tolerance to drought
atgatgaactgcttgcagagttggcctgaacctgtggttagagtccaatctttagcagcaagtggtatccgggcaatcccagagcgttatattaagccaccatcccatagacccttatcaaaaaatgacttttcaccacctcaagaggtaaacattcctgttattgatttccaaaacgttttctctgacgaccaacgcctccgtgacgaggccctccgtgatatctacagtgcttgccatgaatgggggttctttcaagtagtgaaccatggtgttagccatgaactgatgaagaggactagtgaggtttggcgagagttcttcaacttgccagtagaagtgaagcaggagtatgctaacactcctgctacgtatgaggggtatggtagtcggttaggggtggagaagggggcgatacttgattggagtgattatttcttccttaattatatgcctgtttctctcagaaaccaaaacaagtggcctgcaaccccagcttcttgcagtgaagtggttaaactttgtggaaagttgatgaaggtattctccatgaaccttggtctggaagaggactccctccttaacgcttttggtggagaagaaaacattggggcaggcttgagggtgaattactaccccaagtgtccccagccagaccttacactaggtctctccccacactctgaccctggtggaatgacccttctcctgcctgatgaaaatgtggctggcctacaagtctgtaggaagggcagttggctcactgttaagccgatcccaaatgccttcattatcaacataggagatcaaatccaggtactgagcaacgccatctatcagagtgtggagcacagggttattgtgaattctaatagtgatagagtctctcttgcccttttctataacccgaagagcgactcgctcattgaaccatccaaggagcttgtgtccgatgaccggccagctctctacccaccgatgagatttgatgaatacagactttacgttaggacaaagggtctctgcggcaaggaacaggttgaatccttaataatatcctag

SEQ ID NO: 2742 - protein, 352 aa, Populus balsamifera subsp. trichocarpa
  misc_feature (1)..(352): Ceres ANNOT ID no. 1507347
  misc_feature (202)..(302): Pfam Name: 2OG-FeII_Oxy Pfam Description: 2OG-Fe(II) oxygenase superfamily
  misc_feature: SWISSPROT Homolog: LDOX_VITVI Leucoanthocyanidin dioxygenase (EC 1.14.11.19) (LDOX) (Leucocyanidin oxygenase) (Leucoanthocyanidin hydroxylase) with e-value of 1.1e-23 and BLAST sequence identity of 35.4
  misc_feature: SWISSPROT Homolog: LDOX_MALDO Leucoanthocyanidin dioxygenase with e-value of 2.8e-23 and BLAST sequence identity of 33.3
  misc_feature: SWISSPROT Homolog: LDOX_MALDO EC 1.14.11.19 (LDOX) (Leucocyanidin oxygenase) Leucoanthocyanidin hydroxylase Anthocyanidin synthase
  misc_feature: SWISSPROT Homolog: LDOX_ARATH Leucoanthocyanidin dioxygenase with e-value of 5.8e-23 and BLAST sequence identity of 35.0
  misc_feature: SWISSPROT Homolog: LDOX_ARATH EC 1.14.11.19 (LDOX)(Leucocyanidin oxygenase) Leucoanthocyanidin hydroxylase Anthocyanidin synthase (ANS)
  misc_feature: SWISSPROT Homolog: LDOX_PETHY Leucoanthocyanidin dioxygenase (EC 1.14.11.19) (LDOX) (Leucocyanidin oxygenase) (Leucoanthocyanidin hydroxylase) with e-value of 2.8e-22 and BLAST sequence identity of 34.2
  misc_feature: SWISSPROT Homolog: LDOX_PERFR Leucoanthocyanidin dioxygenase (EC 1.14.11.19) (LDOX) (Leucocyanidin oxygenase) (Leucoanthocyanidin hydroxylase) with e-value of 8.6e-22 and BLAST sequence identity of 32.7
  misc_feature: Utility: High Sucrose Useful for making plants with enhanced tolerance to drought
  misc_feature 307818:<222: Transcription Factor
  misc_feature: Phenotype: WHOLE PLANT - High Sucrose Useful for making plants with enhanced tolerance to drought
  misc_feature (1)..(352): Functional Homolog of  Ceres CLONE ID no. 256433 at SEQ ID NO. 2785 with e-value of 5.09E-46 and BLAST sequence identity of 58.3
MNCLQSWPEPVVRVQSLAASGIRAIPERYIKPPSHRPLSKNDFSPPQEVNIPVIDFQNVFSDDQRLRDEALRDIYSACHEWGFFQVVNHGVSHELMKRTSEVWREFFNLPVEVKQEYANTPATYEGYGSRLGVEKGAILDWSDYFFLNYMPVSLRNQNKWPATPASCSEVVKLCGKLMKVFSMNLGLEEDSLLNAFGGEENIGAGLRVNYYPKCPQPDLTLGLSPHSDPGGMTLLLPDENVAGLQVCRKGSWLTVKPIPNAFIINIGDQIQVLSNAIYQSVEHRVIVNSNSDRVSLALFYNPKSDSLIEPSKELVSDDRPALYPPMRFDEYRLYVRTKGLCGKEQVESLIIS

SEQ ID NO: 2743 - DNA, 1089 bp, Populus balsamifera subsp. trichocarpa
  misc_feature (1)..(1089): Ceres ANNOT ID no. 1454201
  misc_feature: Utility: High Sucrose Useful for making plants with enhanced tolerance to drought
  misc_feature 307926:<222: Transcription Factor
  misc_feature: Phenotype: WHOLE PLANT - High Sucrose Useful for making plants with enhanced tolerance to drought
atgatgaaaagtttacagagttggcctgaaccagtgactcgagtccaatctttagcagcaagtggtatacgggcaatcccagagcgttatattaagtcaccatcccagagaccattactaaacaacgacgctcaggaggtcaatgttcctgttattgatttccaaaacttattctccagtgaccgaggcctctgcgaggaagccctccgctgcgttcacaatgcctgccgtgaatgggggttctttcaagtagtgaaccatggtgtgaaccatgaactcatgaagaggacttgtgaggtttggcatgaattctttaacctgccattagaagtgaagcaggagtatgctaacactcctgcaacgtacgaggggtatggtagccgggtgggagtggagaagggggcaagtcttgattggagtgattatttcttccttcattttatgcctctttcactcataaacaaaaacaaatggcctgcaatcccagcttcttgcagggaattggtagatgagtatggcagtgaagtggttagactttgtggaaagttgatgaaggtattctccatgaaccttggcctggaagaggactccctcctaaacgcttttggtggagaagagaacgttggggcatgcctgagggctaattactaccccaagtgtccccagccagaccttacactaggtctctcaccacactctgaccctggtggaatgaccattctcctgcctgatgaaaatgtggctggcctacaagtccgcaggaagggcagttggctcactgttaagccgatcccaaatgccttcattatcaacataggggatcaaatccaggtactcagcaatgccatctatcagagtgtggagcacagggtaattgtgaattctaataaagatagggtctctctcgcccttttctataaccccaagagcgacctgctccttgaaccatgcaaggaactgctcaccaaggaccagccagctctctacaaaccgatgacatatgatgaatacagacttaccattaggacaaagggtccttgtggcaagaaacaagtagaatctttaaaatctcctgggcaatgtaattaa

SEQ ID NO: 2744 - protein, 361 aa, Populus balsamifera subsp. trichocarpa
  misc_feature (1)..(361): Ceres ANNOT ID no. 1454201
  misc_feature (207)..(307): Pfam Name: 2OG-FeII_Oxy Pfam Description: 2OG-Fe(II) oxygenase superfamily
  misc_feature: SWISSPROT Homolog: LDOX_VITVI Leucoanthocyanidin dioxygenase (EC 1.14.11.19) (LDOX) (Leucocyanidin oxygenase) (Leucoanthocyanidin hydroxylase) with e-value of 1.1e-23 and BLAST sequence identity of 35.4
  misc_feature: SWISSPROT Homolog: LDOX_MALDO Leucoanthocyanidin dioxygenase with e-value of 2.8e-23 and BLAST sequence identity of 33.3
  misc_feature: SWISSPROT Homolog: LDOX_MALDO EC 1.14.11.19 (LDOX) (Leucocyanidin oxygenase) Leucoanthocyanidin hydroxylase Anthocyanidin synthase
  misc_feature: SWISSPROT Homolog: LDOX_ARATH Leucoanthocyanidin dioxygenase with e-value of 5.8e-23 and BLAST sequence identity of 35.0
  misc_feature: SWISSPROT Homolog: LDOX_ARATH EC 1.14.11.19 (LDOX)(Leucocyanidin oxygenase) Leucoanthocyanidin hydroxylase Anthocyanidin synthase (ANS)
  misc_feature: SWISSPROT Homolog: LDOX_PETHY Leucoanthocyanidin dioxygenase (EC 1.14.11.19) (LDOX) (Leucocyanidin oxygenase) (Leucoanthocyanidin hydroxylase) with e-value of 2.8e-22 and BLAST sequence identity of 34.2
  misc_feature: SWISSPROT Homolog: LDOX_PERFR Leucoanthocyanidin dioxygenase (EC 1.14.11.19) (LDOX) (Leucocyanidin oxygenase) (Leucoanthocyanidin hydroxylase) with e-value of 8.6e-22 and BLAST sequence identity of 32.7
  misc_feature: Utility: High Sucrose Useful for making plants with enhanced tolerance to drought
  misc_feature 308057:<222: Transcription Factor
  misc_feature: Phenotype: WHOLE PLANT - High Sucrose Useful for making plants with enhanced tolerance to drought
  misc_feature (1)..(361): Functional Homolog of  Ceres CLONE ID no. 256433 at SEQ ID NO. 2785 with e-value of 1.40E-43 and BLAST sequence identity of 54.4
MKSLQSWPEPVTRVQSLAASGIRAIPERYIKSPSQRPLLNNDAQEVNVPVIDFQNLFSSDRGLCEEALRCVHNACREWGFFQVVNHGVNHELMKRTCEVWHEFFNLPLEVKQEYANTPATYEGYGSRVGVEKGASLDWSDYFFLHFMPLSLINKNKWPAIPASCRELVDEYGSEVVRLCGKLMKVFSMNLGLEEDSLLNAFGGEENVGACLRANYYPKCPQPDLTLGLSPHSDPGGMTILLPDENVAGLQVRRKGSWLTVKPIPNAFIINIGDQIQVLSNAIYQSVEHRVIVNSNKDRVSLALFYNPKSDLLLEPCKELLTKDQPALYKPMTYDEYRLTIRTKGPCGKKQVESLKSPGQCN

SEQ ID NO: 2745 - protein, 374 aa, Zea mays
  misc_feature (1)..(374): Ceres CLONE ID no. 256804
  misc_feature (83)..(365): Pfam Name: Pkinase Pfam Description: Protein kinase domain
  misc_feature: Utility: PEG Useful for making plants with increased tolerance to drought
  misc_feature: Phenotype: WHOLE PLANT - PEG Useful for making plants with increased tolerance to drought
MGNCAGVEGNAEINPSFSAPNSSGTAGSKSVSKNAADTGTFGTKTSGSSSSVPPTPRTEAEILESSNVRKFSFGELKGSTRNFRPDSLLGEGGFGSVFKGWMDERTLAPVRPGAGIIVAVKKLKLDSFQGHREWLAEVNYLGQLSHPNLVKLIGYCLEDEQRLLVYEYMPRGSLEHHLFRRGSNFQPLPWNLRMKVALEAARGLAFLHGDQAKVIYRDFKTSNILLDSEYNAKLSDFGLAKDGPSGDKSHVSTRVMGTQGYAAPEYLATGHLTAKSDVYSYGVVLLELLSGQRALDKNRPPGQHNLVEWARPYITNKRRVIHVLDSRLGSQYSLPAAQKVATLALQCLSMDARCRPAMDQVVTALEQLQRPRAH

SEQ ID NO: 2746 - DNA, 1218 bp, Populus balsamifera subsp. trichocarpa
  misc_feature (1)..(1218): Ceres ANNOT ID no. 1461811
  misc_feature: Utility: PEG Useful for making plants with increased tolerance to drought
  misc_feature 308271:<222: Transcription Factor
  misc_feature: Phenotype: WHOLE PLANT - PEG Useful for making plants with increased tolerance to drought
atggggatttgcttgagtgcccaaattaaagctgagagctcatgcagcacagggttgagttcaaagaatgctagcacatatgggactgatctgagcagtacgagtagcaaggtctcatctctttcagtgccacccactcctcggagtgagggtgagatcttgcaatcctctaatctgaagagcttcagtttttctgatctcaagatggccaccaggaatttccgtcctgatagtgtcctaggagaaggtggttttggttctgtttttaagggatggattgatgagcaaacattttctgctgccaagcctggaactggaatggttattgcggtgaaaaggcttaaccaagatggtttccaaggtcacaaggagtggctggcggaagtaaattatctggggcagctctataatcctcaccttgtgaagctgattggctattgcttagaggatgaacaccgactcttggtgtatgaatttatgcctcgaggcagtttggaaaatcatttatttagaagaggttcttatttccaaccactttcttggaacctccgaatgaaggtttctcttggtgctgcaaaggggcttgcatttcttcatagtgctgaaacgaaagtaatatatagggacttcaagacttctaacattctgcttgattcgaaatacaatgcaaaactttctgattttgggctggccaaagatgggccgactggtgacaagagtcatgtatctaccagggttatggggacctatggttatgctgctccagaatatctagctacagggcatctaactgccaagagtgatgtctatagctttggagttgttttgctagaaatgttatctggcaggagagcagttgataaaaatcgcccatctggagagcacaatcttgtcgaatgggctaaaccctatctagcaaacaaacgcaagatctttcgcatcctagatagtcgtcttgaaggtcagtattcaatggatgttgcctataaggtctctacccttgcgctacgttgcctatccatagaaaccaagtttcgaccaactatggatgaggttgtgacagcattggagcagctccaggattccaaagaaactggtactgccaatggccatgtgggcaacaagccccgaatacgtagacgaagtgccaatgatgcaactggtggagggagtattgctgcatatcctcggccctctgcatccccgctttatgcgtga

SEQ ID NO: 2747 - protein, 405 aa, Populus balsamifera subsp. trichocarpa
  misc_feature (1)..(405): Ceres ANNOT ID no. 1461811
  misc_feature (74)..(283): Pfam Name: Pkinase_Tyr Pfam Description: Protein tyrosine kinase
  misc_feature: SWISSPROT Homolog: APK1A_ARATH Protein kinase APK1A, chloroplast precursor (EC 2.7.11.1) with e-value of 1.4e-131 and BLAST sequence identity of 69.6
  misc_feature: SWISSPROT Homolog: APK1B_ARATH Protein kinase APK1B, chloroplast precursor (EC 2.7.11.1) with e-value of 1.4e-131 and BLAST sequence identity of 70.9
  misc_feature: SWISSPROT Homolog: NAK_ARATH Probable serine/threonine-protein kinase NAK chloroplast precursor (EC 2.7.11.1) with e-value of 4.4e-128 and BLAST sequence identity of 70.6
  misc_feature: SWISSPROT Homolog: CX32_ARATH Probable serine/threonine-protein kinase Cx32, chloroplast precursor (EC 2.7.11.1) with e-value of 2.1e-98 and BLAST sequence identity of 51.6
  misc_feature: SWISSPROT Homolog: PBS1_ARATH Serine/threonine-protein kinase PBS1 chloroplast precursor EC 2.7.11.1 (AvrPphB susceptible protein 1) with e-value of 3.1e-81 and BLAST sequence identity of 47.8
  misc_feature: Utility: PEG Useful for making plants with increased tolerance to drought
  misc_feature 308390:<222: Transcription Factor
  misc_feature: Phenotype: WHOLE PLANT - PEG Useful for making plants with increased tolerance to drought
  misc_feature (1)..(405): Functional Homolog of  Ceres CLONE ID no. 256804 at SEQ ID NO. 2792 with e-value of 3.70E-139 and BLAST sequence identity of 73.1
MGICLSAQIKAESSCSTGLSSKNASTYGTDLSSTSSKVSSLSVPPTPRSEGEILQSSNLKSFSFSDLKMATRNFRPDSVLGEGGFGSVFKGWIDEQTFSAAKPGTGMVIAVKRLNQDGFQGHKEWLAEVNYLGQLYNPHLVKLIGYCLEDEHRLLVYEFMPRGSLENHLFRRGSYFQPLSWNLRMKVSLGAAKGLAFLHSAETKVIYRDFKTSNILLDSKYNAKLSDFGLAKDGPTGDKSHVSTRVMGTYGYAAPEYLATGHLTAKSDVYSFGVVLLEMLSGRRAVDKNRPSGEHNLVEWAKPYLANKRKIFRILDSRLEGQYSMDVAYKVSTLALRCLSIETKFRPTMDEVVTALEQLQDSKETGTANGHVGNKPRIRRRSANDATGGGSIAAYPRPSASPLYA

SEQ ID NO: 2748 - DNA, 1218 bp, Populus balsamifera subsp. trichocarpa
  misc_feature (1)..(1218): Ceres ANNOT ID no. 1439959
  misc_feature: Utility: PEG Useful for making plants with increased tolerance to drought
  misc_feature 308507:<222: Transcription Factor
  misc_feature: Phenotype: WHOLE PLANT - PEG Useful for making plants with increased tolerance to drought
atggggatttgcttgagtgcccaaattaaagctgagagctcatgcaacacagggttgagttcaaagtatgttagcacagatgggaatgatctgagcagtacgggtagcaaggtcttgtctgtttcagtgcctccaactcctcggagtgagggtgagatcttgcagtccaccaatctgaagagctttagtttttctgatctcaaaatggccaccaggagtttccgtcctgatagtgtcttaggagaaggtggttttggttcagtttttaagggatggattgatgagcagtcattttctgctgccaagcctggaactggaattgttattgctgtgaaaaggcttaaccaagacggtttccaaggtcacaaggagtggctggcagaagtaaattatctggggcagttctatcatcctcaccttgtgaagctgattggctattgcttagaggatgaacaccgactattggtatatgaatttatgcctcgaggcagtttggaaaatcatttatttagaagaggttcttatttccaaccgctttcttggaacctccgcttgaaggttgctcttggtgctgcaaagggtcttgcgtttcttcattgtgctgaaacacaagtaatatacagggacttcaagacttctaacattctacttgattcgaaatacaatgcaaaactttctgattttgggttggccaaggatggaccgactggtgataagagtcatgtatctaccagggttataggtacctatggttatgctgctccagaatatctagctaccggtcatctaactgccaaaagtgatgtctatagcttcggagttgttttgctagaaatgttatctggcaggagagcaatcgacaaaaatcgcccatctggagagcacaatcttgttgaatgggctaaaccctatctagctaacaaacgtaagatctttcgcatcctagataatcgtcttgaaggccagtattcaatggatgttgcctttaaggcctctacacttgcgctgcgttgcctatccatagaaaccaagtttcgaccaactatggatgaggttgtgacagcaatggagcagcttcaggattccaaagaaactggtagtgcaaatggccatgcaagcaatgctccccgaattcgtagacgaagtgcagatgacactattagtggaaggaatactgctgcatatcctcggccctccacatccccactatatgcttga

SEQ ID NO: 2749 - protein, 405 aa, Populus balsamifera subsp. trichocarpa
  misc_feature (1)..(405): Ceres ANNOT ID no. 1439959
  misc_feature (74)..(356): Pfam Name: Pkinase_Tyr Pfam Description: Protein tyrosine kinase
  misc_feature: SWISSPROT Homolog: APK1A_ARATH Protein kinase APK1A, chloroplast precursor (EC 2.7.11.1) with e-value of 1.4e-131 and BLAST sequence identity of 69.6
  misc_feature: SWISSPROT Homolog: APK1B_ARATH Protein kinase APK1B, chloroplast precursor (EC 2.7.11.1) with e-value of 1.4e-131 and BLAST sequence identity of 70.9
  misc_feature: SWISSPROT Homolog: NAK_ARATH Probable serine/threonine-protein kinase NAK chloroplast precursor (EC 2.7.11.1) with e-value of 4.4e-128 and BLAST sequence identity of 70.6
  misc_feature: SWISSPROT Homolog: CX32_ARATH Probable serine/threonine-protein kinase Cx32, chloroplast precursor (EC 2.7.11.1) with e-value of 2.1e-98 and BLAST sequence identity of 51.6
  misc_feature: SWISSPROT Homolog: PBS1_ARATH Serine/threonine-protein kinase PBS1 chloroplast precursor EC 2.7.11.1 (AvrPphB susceptible protein 1) with e-value of 3.1e-81 and BLAST sequence identity of 47.8
  misc_feature: Utility: PEG Useful for making plants with increased tolerance to drought
  misc_feature 308626:<222: Transcription Factor
  misc_feature: Phenotype: WHOLE PLANT - PEG Useful for making plants with increased tolerance to drought
  misc_feature (1)..(405): Functional Homolog of  Ceres CLONE ID no. 256804 at SEQ ID NO. 2792 with e-value of 6.99E-136 and BLAST sequence identity of 70.1
MGICLSAQIKAESSCNTGLSSKYVSTDGNDLSSTGSKVLSVSVPPTPRSEGEILQSTNLKSFSFSDLKMATRSFRPDSVLGEGGFGSVFKGWIDEQSFSAAKPGTGIVIAVKRLNQDGFQGHKEWLAEVNYLGQFYHPHLVKLIGYCLEDEHRLLVYEFMPRGSLENHLFRRGSYFQPLSWNLRLKVALGAAKGLAFLHCAETQVIYRDFKTSNILLDSKYNAKLSDFGLAKDGPTGDKSHVSTRVIGTYGYAAPEYLATGHLTAKSDVYSFGVVLLEMLSGRRAIDKNRPSGEHNLVEWAKPYLANKRKIFRILDNRLEGQYSMDVAFKASTLALRCLSIETKFRPTMDEVVTAMEQLQDSKETGSANGHASNAPRIRRRSADDTISGRNTAAYPRPSTSPLYA

SEQ ID NO: 2750 - DNA, 1200 bp, Populus balsamifera subsp. trichocarpa; identical to SEQ ID NO: 1066
  misc_feature (1)..(1200): Ceres ANNOT ID no. 1535293
  misc_feature: Utility: PEG Useful for making plants with increased tolerance to drought
  misc_feature 308743:<222: Transcription Factor
  misc_feature: Phenotype: WHOLE PLANT - PEG Useful for making plants with increased tolerance to drought

SEQ ID NO: 2751 - protein, 399 aa, Populus balsamifera subsp. trichocarpa; identical to SEQ ID NO: 1067
  misc_feature (1)..(399): Ceres ANNOT ID no. 1535293
  misc_feature (329)..(356): Pfam Name: Pkinase_Tyr Pfam Description: Protein tyrosine kinase
  misc_feature: SWISSPROT Homolog: APK1A_ARATH Protein kinase APK1A, chloroplast precursor (EC 2.7.11.1) with e-value of 1.4e-131 and BLAST sequence identity of 69.6
  misc_feature: SWISSPROT Homolog: APK1B_ARATH Protein kinase APK1B, chloroplast precursor (EC 2.7.11.1) with e-value of 1.4e-131 and BLAST sequence identity of 70.9
  misc_feature: SWISSPROT Homolog: NAK_ARATH Probable serine/threonine-protein kinase NAK chloroplast precursor (EC 2.7.11.1) with e-value of 4.4e-128 and BLAST sequence identity of 70.6
  misc_feature: SWISSPROT Homolog: CX32_ARATH Probable serine/threonine-protein kinase Cx32, chloroplast precursor (EC 2.7.11.1) with e-value of 2.1e-98 and BLAST sequence identity of 51.6
  misc_feature: SWISSPROT Homolog: PBS1_ARATH Serine/threonine-protein kinase PBS1 chloroplast precursor EC 2.7.11.1 (AvrPphB susceptible protein 1) with e-value of 3.1e-81 and BLAST sequence identity of 47.8
  misc_feature: Utility: PEG Useful for making plants with increased tolerance to drought
  misc_feature 308862:<222: Transcription Factor
  misc_feature: Phenotype: WHOLE PLANT - PEG Useful for making plants with increased tolerance to drought
  misc_feature (1)..(399): Functional Homolog of  Ceres CLONE ID no. 256804 at SEQ ID NO. 2792 with e-value of 8.99E-136 and BLAST sequence identity of 72.0

SEQ ID NO: 2752 - DNA, 1137 bp, Populus balsamifera subsp. trichocarpa; identical to SEQ ID NO: 1068
  misc_feature (1)..(1137): Ceres ANNOT ID no. 1481806
  misc_feature: Utility: PEG Useful for making plants with increased tolerance to drought
  misc_feature 308976:<222: Transcription Factor
  misc_feature: Phenotype: WHOLE PLANT - PEG Useful for making plants with increased tolerance to drought

SEQ ID NO: 2753 - protein, 378 aa, Populus balsamifera subsp. trichocarpa; identical to SEQ ID NO: 1069
  misc_feature (1)..(378): Ceres ANNOT ID no. 1481806
  misc_feature (313)..(340): Pfam Name: Pkinase_Tyr Pfam Description: Protein tyrosine kinase
  misc_feature: SWISSPROT Homolog: APK1A_ARATH Protein kinase APK1A, chloroplast precursor (EC 2.7.11.1) with e-value of 1.4e-131 and BLAST sequence identity of 69.6
  misc_feature: SWISSPROT Homolog: APK1B_ARATH Protein kinase APK1B, chloroplast precursor (EC 2.7.11.1) with e-value of 1.4e-131 and BLAST sequence identity of 70.9
  misc_feature: SWISSPROT Homolog: NAK_ARATH Probable serine/threonine-protein kinase NAK chloroplast precursor (EC 2.7.11.1) with e-value of 4.4e-128 and BLAST sequence identity of 70.6
  misc_feature: SWISSPROT Homolog: CX32_ARATH Probable serine/threonine-protein kinase Cx32, chloroplast precursor (EC 2.7.11.1) with e-value of 2.1e-98 and BLAST sequence identity of 51.6
  misc_feature: SWISSPROT Homolog: PBS1_ARATH Serine/threonine-protein kinase PBS1 chloroplast precursor EC 2.7.11.1 (AvrPphB susceptible protein 1) with e-value of 3.1e-81 and BLAST sequence identity of 47.8
  misc_feature: Utility: PEG Useful for making plants with increased tolerance to drought
  misc_feature 309091:<222: Transcription Factor
  misc_feature: Phenotype: WHOLE PLANT - PEG Useful for making plants with increased tolerance to drought
  misc_feature (1)..(378): Functional Homolog of  Ceres CLONE ID no. 256804 at SEQ ID NO. 2792 with e-value of 1.49E-135 and BLAST sequence identity of 73.5

SEQ ID NO: 2754 - DNA, 1395 bp, Populus balsamifera subsp. trichocarpa
  misc_feature (1)..(1395): Ceres ANNOT ID no. 1503112
  misc_feature: Utility: PEG Useful for making plants with increased tolerance to drought
  misc_feature 309202:<222: Transcription Factor
  misc_feature: Phenotype: WHOLE PLANT - PEG Useful for making plants with increased tolerance to drought
atgggtttgagtccagattcagtaaaggtaaagaattttaaggagaaatcaaagagcaagaaaaataagaaaaatcaaggaaatgaaaaggacgaggaggatattggatgttggtttaaattcaggtcgacgggaagctgcatgccttcaagatcaaaagttgatagctctttaagtggcatctcaactcactatgctatgtcttctactaccacgactagcaatgcagagagtgcatcctcacttccaacattcagtgaggaattgaagcttgcttctcagctccgaaaatttacatttaatgaccttaaattagcaactagaaactttaggcctgagagtcttcttggggagggtgggtttgggtgtgtcttcaaaggttggattgaggagaatggaactgctcctgtgaaacctggcactgggcttaccgttgcagtcaaaaccctcaaccatgatggacttcagggtcataaagagtggcttgctgaagttagttttcttgggaaccttctgcataaaaacttggtgaaattggttggttactgcattgaagatgatcaaaggttgctggtgtatgagttcatgcctagaggaagtttggagaatcacctcttcagaaaagggtccttgccccttccttggtctatcaggatgaaaattgctcttggtgctgcacaaggtcttgctttccttcacgaggaggctgacagaccagtaatatatcgtgattttaaaacatctaatatattattagatgcggactacaacgccaaactttctgattttggacttgcaaaggatgctcctgatggaggtaaaactcatgtatcaaccagagttatgggaacttatggctatgctgccccggaatatgtgatgactggacatttgacatcaaagagtgatgtctacagctttggagtagttttacttgaaatgctcactggccgaagatccatggacaaaaacagaccaaatggggagcacaacctcgtggaatgggcaaggccacattttggggacaagagaaggttctaccgcttattagacccccgtcttgaaggccatttctcaatcaaaggagctcagaaaggcattcagttggctgcccagtgtctaagccgtgatcccaaagccagaccccagatgagtgaagttgttgaagcactaaagcctttaccaaacttaaaggatatggctagctcttcgtattactttcaaagtatgcaagcagatcgtaacaagtcaaacatgaatgctaaaaatggcactagaacacaggctggatttgtaacaaggaatggacagccattgaggagcttaagtgatgtgcgtgcttctccatataaccagcctcagcagtcaccaaaacctaaagggagaagttcatag

SEQ ID NO: 2755 - protein, 417 aa, Populus balsamifera subsp. trichocarpa
  misc_feature (1)..(417): Ceres ANNOT ID no. 1503112
  misc_feature (325)..(344): Pfam Name: Pkinase_Tyr Pfam Description: Protein tyrosine kinase
  misc_feature: SWISSPROT Homolog: APK1A_ARATH Protein kinase APK1A, chloroplast precursor (EC 2.7.11.1) with e-value of 1.4e-131 and BLAST sequence identity of 69.6
  misc_feature: SWISSPROT Homolog: APK1B_ARATH Protein kinase APK1B, chloroplast precursor (EC 2.7.11.1) with e-value of 1.4e-131 and BLAST sequence identity of 70.9
  misc_feature: SWISSPROT Homolog: NAK_ARATH Probable serine/threonine-protein kinase NAK chloroplast precursor (EC 2.7.11.1) with e-value of 4.4e-128 and BLAST sequence identity of 70.6
  misc_feature: SWISSPROT Homolog: CX32_ARATH Probable serine/threonine-protein kinase Cx32, chloroplast precursor (EC 2.7.11.1) with e-value of 2.1e-98 and BLAST sequence identity of 51.6
  misc_feature: SWISSPROT Homolog: PBS1_ARATH Serine/threonine-protein kinase PBS1 chloroplast precursor EC 2.7.11.1 (AvrPphB susceptible protein 1) with e-value of 3.1e-81 and BLAST sequence identity of 47.8
  misc_feature: Utility: PEG Useful for making plants with increased tolerance to drought
  misc_feature 309327:<222: Transcription Factor
  misc_feature: Phenotype: WHOLE PLANT - PEG Useful for making plants with increased tolerance to drought
  misc_feature (1)..(417): Functional Homolog of  Ceres CLONE ID no. 256804 at SEQ ID NO. 2792 with e-value of 2.30E-114 and BLAST sequence identity of 64.7
MPSRSKVDSSLSGISTHYAMSSTTTTSNAESASSLPTFSEELKLASQLRKFTFNDLKLATRNFRPESLLGEGGFGCVFKGWIEENGTAPVKPGTGLTVAVKTLNHDGLQGHKEWLAEVSFLGNLLHKNLVKLVGYCIEDDQRLLVYEFMPRGSLENHLFRKGSLPLPWSIRMKIALGAAQGLAFLHEEADRPVIYRDFKTSNILLDADYNAKLSDFGLAKDAPDGGKTHVSTRVMGTYGYAAPEYVMTGHLTSKSDVYSFGVVLLEMLTGRRSMDKNRPNGEHNLVEWARPHFGDKRRFYRLLDPRLEGHFSIKGAQKGIQLAAQCLSRDPKARPQMSEVVEALKPLPNLKDMASSSYYFQSMQADRNKSNMNAKNGTRTQAGFVTRNGQPLRSLSDVRASPYNQPQQSPKPKGRSS

SEQ ID NO: 2756 - DNA, 1362 bp, Populus balsamifera subsp. trichocarpa
  misc_feature (1)..(1362): Ceres ANNOT ID no. 1516877
  misc_feature: Utility: PEG Useful for making plants with increased tolerance to drought
  misc_feature 309447:<222: Transcription Factor
  misc_feature: Phenotype: WHOLE PLANT - PEG Useful for making plants with increased tolerance to drought
atgggcaactgcttagattcttcttctgctaaagtagattccacccagagctcacataatcctggagcctcaagaatttccagcagaaccagccattcttcagttccatctagtctgaccatcccatcatacagtggaaggagcagtgaatgtcttcctacaccaaggagtgaaggtgaaatattgtcatcgccaaatttaaaagctttctcattcaatgagctaaaaaatgctaccagaaacttccgtcccgacagtcttctgggtgaaggtggctttggctatgttttcaaaggatggattgatgaacacactcttactgctgcaaagcctggatcgggaatggttgttgctgtcaagaagcttaaacctgaaggtttccaaggccacaaggagtggttgacagaagttaattatctcggccaacttcatcatccaaatctggttaaattgattggatactgcttggaaggtgagaaccggcttctggtctatgagttcatgcctaaagggagcttagagaatcatctgttcagaagaggaccacagccactttcatgggcgataagaatcaaagtggccataggtgctgccagaggactctcttttcttcatgatgcaaaatcacaagtcatataccgtgacttcaaggcatctaatattctactagatgcggaatttaatgcaaaactttctgattttggtttggccaaggcaggccctactggtgataggactcatgtgtccactcaagttatgggtactcatgggtatgcagcacctgaatacgttgctacagccattcttatctctgatgaccatgctgatgcttctcgcccttctaggtcaggcctcttctgtaatgaccaggtttctttctattgtccaagtgggggaaagcttgatggtcggttgacagccaaaagtgatgtatacagcttcggggttgtattgctggaattcctgtctgggcgacgcgctgttgataaatctaaggtgggtgtggagcagaatctggtagactgggtgaaaccgtatctgggtgacaaaaggaaattattccgaattatggacaccaaattggggggacaatatcctcagaaaggagccttcatggctgctaacctggctttacagtgcctaagcactgaagctaaagtcaggcctcgaatgtcagaagtattagcaacactggagcaaattgaatccccaaaaggtgcagttaaaaacatccaattagagcatcaaacagttcagactcctgtccgacagtccccaatgagacaccatcgctctcctgtgattccaacggccagtgcctccccgctgccatcccaccaccaatctccacgattacgataa

SEQ ID NO: 2757 - protein, 453 aa, Populus balsamifera subsp. trichocarpa
  misc_feature (1)..(453): Ceres ANNOT ID no. 1516877
  misc_feature (302)..(325): Pfam Name: Pkinase_Tyr Pfam Description: Protein tyrosine kinase
  misc_feature: SWISSPROT Homolog: APK1A_ARATH Protein kinase APK1A, chloroplast precursor (EC 2.7.11.1) with e-value of 1.4e-131 and BLAST sequence identity of 69.6
  misc_feature: SWISSPROT Homolog: APK1B_ARATH Protein kinase APK1B, chloroplast precursor (EC 2.7.11.1) with e-value of 1.4e-131 and BLAST sequence identity of 70.9
  misc_feature: SWISSPROT Homolog: NAK_ARATH Probable serine/threonine-protein kinase NAK chloroplast precursor (EC 2.7.11.1) with e-value of 4.4e-128 and BLAST sequence identity of 70.6
  misc_feature: SWISSPROT Homolog: CX32_ARATH Probable serine/threonine-protein kinase Cx32, chloroplast precursor (EC 2.7.11.1) with e-value of 2.1e-98 and BLAST sequence identity of 51.6
  misc_feature: SWISSPROT Homolog: PBS1_ARATH Serine/threonine-protein kinase PBS1 chloroplast precursor EC 2.7.11.1 (AvrPphB susceptible protein 1) with e-value of 3.1e-81 and BLAST sequence identity of 47.8
  misc_feature: Utility: PEG Useful for making plants with increased tolerance to drought
  misc_feature 309570:<222: Transcription Factor
  misc_feature: Phenotype: WHOLE PLANT - PEG Useful for making plants with increased tolerance to drought
  misc_feature (1)..(453): Functional Homolog of  Ceres CLONE ID no. 256804 at SEQ ID NO. 2792 with e-value of 1.60E-113 and BLAST sequence identity of 61.5
MGNCLDSSSAKVDSTQSSHNPGASRISSRTSHSSVPSSLTIPSYSGRSSECLPTPRSEGEILSSPNLKAFSFNELKNATRNFRPDSLLGEGGFGYVFKGWIDEHTLTAAKPGSGMVVAVKKLKPEGFQGHKEWLTEVNYLGQLHHPNLVKLIGYCLEGENRLLVYEFMPKGSLENHLFRRGPQPLSWAIRIKVAIGAARGLSFLHDAKSQVIYRDFKASNILLDAEFNAKLSDFGLAKAGPTGDRTHVSTQVMGTHGYAAPEYVATAILISDDHADASRPSRSGLFCNDQVSFYCPSGGKLDGRLTAKSDVYSFGVVLLEFLSGRRAVDKSKVGVEQNLVDWVKPYLGDKRKLFRIMDTKLGGQYPQKGAFMAANLALQCLSTEAKVRPRMSEVLATLEQIESPKGAVKNIQLEHQTVQTPVRQSPMRHHRSPVIPTASASPLPSHHQSPRLR

SEQ ID NO: 2758 - DNA, 1284 bp, Populus balsamifera subsp. trichocarpa
  misc_feature (1)..(1284): Ceres ANNOT ID no. 1506920
  misc_feature: Utility: PEG Useful for making plants with increased tolerance to drought
  misc_feature 309696:<222: Transcription Factor
  misc_feature: Phenotype: WHOLE PLANT - PEG Useful for making plants with increased tolerance to drought
atggatagcaagtgtggttgctgggctgtcttaaaacgtggagttagaggttcttgcaagtcctctgcctctagagattctgctaacgcgatccctcgtactagtcttgtttacgatgcagctactgaaacaagatacctaaatgcaagcaatcgagagttatgtgctcataatgaagcacaactatcttctgataatcctgatccacaagataagaaatctccatgccagttgctgcagtttacctttcaagaactaaaatcatcaacggggaattttaggcctgatagcattcttggagagggcggatttggatatgtgtttaaaggatggatagaggaaaatggaacagcaccagcaaaacctgggtcgggaatcacagtcgcggtgaagagcttaaagccagatggtcttcaaggccatagagaatgggtggctgaagttgattttcttggacagcttcaccatcctaatctcgttaagcttattggttactgcatcgaggatgatcaacggcttcttgtttatgaatttatgacgcgagggagtcttgaaaatcatctttttagaaggacaatacctcttccatggtccaacaggattaagattgcacttggggcagcaaaaggattggcctttctccatggtggccctgaaccagttatttacagagattttaagacgtcaaacattttgcttgactcggaatataatgctaagctttcagattttggtctagcaaaagctgggcctcaaggggacaaaactcatgtttctacaagggttgttgggacatacggctatgctgctccagagtatgtgatgacaggacacctgacatctaagagtgatgtttacagcttcggagttgtgctgcttgagattttgacaggcagaagatcaatggacaagaagcgacctagtggtgaacagaatctagttgcatgggcacgaccttatttagctgacaagagaaagatgtaccagctagtggatcccaggttggagctgaattactcccttaaagcggtccagaaagtttctcaattggcttacagctgcctcagtagggattcaaagtcccgtcctacaatggatgaagttgtgaaagttctcactccattgcaagatctaaacgaccttgccattttatcttatcactctcgcttgtctcaacaagggaagcgcaagaagaaaagtgaaggagcgcagcagcacgcaaatgtatcttccaaaagcatcagagattctcccttgaatactggcaagcagcgttatagatga

SEQ ID NO: 2759 - protein, 427 aa, Populus balsamifera subsp. trichocarpa
  misc_feature (1)..(427): Ceres ANNOT ID no. 1506920
  misc_feature (93)..(372): Pfam Name: Pkinase_Tyr Pfam Description: Protein tyrosine kinase
  misc_feature: SWISSPROT Homolog: APK1A_ARATH Protein kinase APK1A, chloroplast precursor (EC 2.7.11.1) with e-value of 1.4e-131 and BLAST sequence identity of 69.6
  misc_feature: SWISSPROT Homolog: APK1B_ARATH Protein kinase APK1B, chloroplast precursor (EC 2.7.11.1) with e-value of 1.4e-131 and BLAST sequence identity of 70.9
  misc_feature: SWISSPROT Homolog: NAK_ARATH Probable serine/threonine-protein kinase NAK chloroplast precursor (EC 2.7.11.1) with e-value of 4.4e-128 and BLAST sequence identity of 70.6
  misc_feature: SWISSPROT Homolog: CX32_ARATH Probable serine/threonine-protein kinase Cx32, chloroplast precursor (EC 2.7.11.1) with e-value of 2.1e-98 and BLAST sequence identity of 51.6
  misc_feature: SWISSPROT Homolog: PBS1_ARATH Serine/threonine-protein kinase PBS1 chloroplast precursor EC 2.7.11.1 (AvrPphB susceptible protein 1) with e-value of 3.1e-81 and BLAST sequence identity of 47.8
  misc_feature: Utility: PEG Useful for making plants with increased tolerance to drought
  misc_feature 309817:<222: Transcription Factor
  misc_feature: Phenotype: WHOLE PLANT - PEG Useful for making plants with increased tolerance to drought
  misc_feature (1)..(427): Functional Homolog of  Ceres CLONE ID no. 256804 at SEQ ID NO. 2792 with e-value of 6.29E-112 and BLAST sequence identity of 70.0
MDSKCGCWAVLKRGVRGSCKSSASRDSANAIPRTSLVYDAATETRYLNASNRELCAHNEAQLSSDNPDPQDKKSPCQLLQFTFQELKSSTGNFRPDSILGEGGFGYVFKGWIEENGTAPAKPGSGITVAVKSLKPDGLQGHREWVAEVDFLGQLHHPNLVKLIGYCIEDDQRLLVYEFMTRGSLENHLFRRTIPLPWSNRIKIALGAAKGLAFLHGGPEPVIYRDFKTSNILLDSEYNAKLSDFGLAKAGPQGDKTHVSTRVVGTYGYAAPEYVMTGHLTSKSDVYSFGVVLLEILTGRRSMDKKRPSGEQNLVAWARPYLADKRKMYQLVDPRLELNYSLKAVQKVSQLAYSCLSRDSKSRPTMDEVVKVLTPLQDLNDLAILSYHSRLSQQGKRKKKSEGAQQHANVSSKSIRDSPLNTGKQRYR

SEQ ID NO: 2760 - DNA, 1329 bp, Populus balsamifera subsp. trichocarpa
  misc_feature (1)..(1329): Ceres ANNOT ID no. 1453775
  misc_feature: Utility: PEG Useful for making plants with increased tolerance to drought
  misc_feature 309937:<222: Transcription Factor
  misc_feature: Phenotype: WHOLE PLANT - PEG Useful for making plants with increased tolerance to drought
atggatagcaagtgtggttgctgggctgtcttaaaacgtggagttagaggttcttgcaagtcctctgcctctagagattctgctaacgcgatccctcgtactagtcttgtttacgatgcaggaactgggaaatgcaagttctatttcagtttacaaggttatcatgctactgaaacaagatacctaaatgcaagcaatcgagagttatgtgctcataatgaagcacaactatcttctgataatcctgatccacaagataagaaatctccatgccagttgctgcagtttacctttcaagaactaaaatcatcaacggggaattttaggcctgatagcattcttggagagggcggatttggatatgtgtttaaaggatggatagaggaaaatggaacagcaccagcaaaacctgggtcgggaatcacagtcgcggtgaagagcttaaagccagatggtcttcaaggccatagagaatgggtggctgaagttgattttcttggacagcttcaccatcctaatctcgttaagcttattggttactgcatcgaggatgatcaacggcttcttgtttatgaatttatgacgcgagggagtcttgaaaatcatctttttagaaggacaatacctcttccatggtccaacaggattaagattgcacttggggcagcaaaaggattggcctttctccatggtggccctgaaccagttatttacagagattttaagacgtcaaacattttgcttgactcggaatataatgctaagctttcagattttggtctagcaaaagctgggcctcaaggggacaaaactcatgtttctacaagggttgttgggacatacggctatgctgctccagagtatgtgatgacaggacacctgacatctaagagtgatgtttacagcttcggagttgtgctgcttgagattttgacaggcagaagatcaatggacaagaagcgacctagtggtgaacagaatctagttgcatgggcacgaccttatttagctgacaagagaaagatgtaccagctagtggatcccaggttggagctgaattactcccttaaagcggtccagaaagtttctcaattggcttacagctgcctcagtagggattcaaagtcccgtcctacaatggatgaagttgtgaaagttctcactccattgcaagatctaaacgaccttgccattttatcttatcactctcgcttgtctcaacaagggaagcgcaagaagaaaagtgaaggagcgcagcagcacgcaaatgtatcttccaaaagcatcagagattctcccttgaatactggcaagcagcgttatagatga

SEQ ID NO: 2761 - protein, 442 aa, Populus balsamifera subsp. trichocarpa
  misc_feature (1)..(442): Ceres ANNOT ID no. 1453775
  misc_feature (108)..(387): Pfam Name: Pkinase_Tyr Pfam Description: Protein tyrosine kinase
  misc_feature: SWISSPROT Homolog: APK1A_ARATH Protein kinase APK1A, chloroplast precursor (EC 2.7.11.1) with e-value of 1.4e-131 and BLAST sequence identity of 69.6
  misc_feature: SWISSPROT Homolog: APK1B_ARATH Protein kinase APK1B, chloroplast precursor (EC 2.7.11.1) with e-value of 1.4e-131 and BLAST sequence identity of 70.9
  misc_feature: SWISSPROT Homolog: NAK_ARATH Probable serine/threonine-protein kinase NAK chloroplast precursor (EC 2.7.11.1) with e-value of 4.4e-128 and BLAST sequence identity of 70.6
  misc_feature: SWISSPROT Homolog: CX32_ARATH Probable serine/threonine-protein kinase Cx32, chloroplast precursor (EC 2.7.11.1) with e-value of 2.1e-98 and BLAST sequence identity of 51.6
  misc_feature: SWISSPROT Homolog: PBS1_ARATH Serine/threonine-protein kinase PBS1 chloroplast precursor EC 2.7.11.1 (AvrPphB susceptible protein 1) with e-value of 3.1e-81 and BLAST sequence identity of 47.8
  misc_feature: Utility: PEG Useful for making plants with increased tolerance to drought
  misc_feature 310060:<222: Transcription Factor
  misc_feature: Phenotype: WHOLE PLANT - PEG Useful for making plants with increased tolerance to drought
  misc_feature (1)..(442): Functional Homolog of  Ceres CLONE ID no. 256804 at SEQ ID NO. 2792 with e-value of 6.29E-112 and BLAST sequence identity of 70.0
MDSKCGCWAVLKRGVRGSCKSSASRDSANAIPRTSLVYDAGTGKCKFYFSLQGYHATETRYLNASNRELCAHNEAQLSSDNPDPQDKKSPCQLLQFTFQELKSSTGNFRPDSILGEGGFGYVFKGWIEENGTAPAKPGSGITVAVKSLKPDGLQGHREWVAEVDFLGQLHHPNLVKLIGYCIEDDQRLLVYEFMTRGSLENHLFRRTIPLPWSNRIKIALGAAKGLAFLHGGPEPVIYRDFKTSNILLDSEYNAKLSDFGLAKAGPQGDKTHVSTRVVGTYGYAAPEYVMTGHLTSKSDVYSFGVVLLEILTGRRSMDKKRPSGEQNLVAWARPYLADKRKMYQLVDPRLELNYSLKAVQKVSQLAYSCLSRDSKSRPTMDEVVKVLTPLQDLNDLAILSYHSRLSQQGKRKKKSEGAQQHANVSSKSIRDSPLNTGKQRYR

SEQ ID NO: 2762 - DNA, 1290 bp, Populus balsamifera subsp. trichocarpa
  misc_feature (1)..(1290): Ceres ANNOT ID no. 1478539
  misc_feature: Utility: PEG Useful for making plants with increased tolerance to drought
  misc_feature 310183:<222: Transcription Factor
  misc_feature: Phenotype: WHOLE PLANT - PEG Useful for making plants with increased tolerance to drought
atggagagcaagtgcggttgctggcctgtcttaaaacgtggggttagaggttctcgcaagtcctctgcctctagagattctgctaactctatccctcgtactagtcttgtttatgatgcagctactgaaacaagatatctaaatgcaagcaatcgagagttatgtgctcctaatgaagctcaactatcctatgacaatcctcatccaccacccacagataccaaatctctatgccagtcacttcagtttacttttcaagaactaaaatcagcaaccgggaattttaggcctgatagcattcttggagagggcggatttggatacgtgtttaaaggatggatagaggagcatgggacagcaccagcaaaacctgggtcaggaatcacagttgcggtgaagagtttaaagccagatggtcttcaaggccatagagaatgggtggctgaagttgattttcttggacagcttcatcatcctaatcttgttaagcttattggttactgcattgaggatgatcagcggcttcttgtttatgagtttatgacacgaggaagtcttgaaaatcatctttttagaaggacaatacctcttccatggtccaacaggattaagattgcacttggagcagcaaaagggttggcctttctccatggtggtcctgaaccagttatttacagggattttaagacatcaaacattttgcttgattcggaatacaatgcaaagctttcagattttggtctagcaaaagctgggcctcaaggggacaaaactcatgtttctaccagggttgttgggacatatggctatgctgctccagagtatgtgatgacaggacacttgacatctaagagtgatgtttacagcttcggagttgtgctacttgagattctgacaggtagaagatcaatggacaagaagcgacctagtggtgaacagaatcttgttacatgggcacggccttatttagctgacaagagaaagatgtaccagctagtggatcccaggttggagctaaattactcccttaaaggggtccagaaagtttctcagttggctttcagctgcctcagtagggattcatattcccgccccacaatggatgaagttgtgaaagttctcactccattgcaagatcttaacgaccttgccattttatcataccactctcgtttgtctcaacaagggaagcgcaagaagaagagcgaaggaacacaaaagcatacgaatgtatcatccaaaagcatcagagattctcccttgaatacaggcaagcagcgttttagataa

SEQ ID NO: 2763 - protein, 429 aa, Populus balsamifera subsp. trichocarpa
  misc_feature (1)..(429): Ceres ANNOT ID no. 1478539
  misc_feature (355)..(374): Pfam Name: Pkinase_Tyr Pfam Description: Protein tyrosine kinase
  misc_feature: SWISSPROT Homolog: APK1A_ARATH Protein kinase APK1A, chloroplast precursor (EC 2.7.11.1) with e-value of 1.4e-131 and BLAST sequence identity of 69.6
  misc_feature: SWISSPROT Homolog: APK1B_ARATH Protein kinase APK1B, chloroplast precursor (EC 2.7.11.1) with e-value of 1.4e-131 and BLAST sequence identity of 70.9
  misc_feature: SWISSPROT Homolog: NAK_ARATH Probable serine/threonine-protein kinase NAK chloroplast precursor (EC 2.7.11.1) with e-value of 4.4e-128 and BLAST sequence identity of 70.6
  misc_feature: SWISSPROT Homolog: CX32_ARATH Probable serine/threonine-protein kinase Cx32, chloroplast precursor (EC 2.7.11.1) with e-value of 2.1e-98 and BLAST sequence identity of 51.6
  misc_feature: SWISSPROT Homolog: PBS1_ARATH Serine/threonine-protein kinase PBS1 chloroplast precursor EC 2.7.11.1 (AvrPphB susceptible protein 1) with e-value of 3.1e-81 and BLAST sequence identity of 47.8
  misc_feature: Utility: PEG Useful for making plants with increased tolerance to drought
  misc_feature 310304:<222: Transcription Factor
  misc_feature: Phenotype: WHOLE PLANT - PEG Useful for making plants with increased tolerance to drought
  misc_feature (1)..(429): Functional Homolog of  Ceres CLONE ID no. 256804 at SEQ ID NO. 2792 with e-value of 1.00E-111 and BLAST sequence identity of 61.5
MESKCGCWPVLKRGVRGSRKSSASRDSANSIPRTSLVYDAATETRYLNASNRELCAPNEAQLSYDNPHPPPTDTKSLCQSLQFTFQELKSATGNFRPDSILGEGGFGYVFKGWIEEHGTAPAKPGSGITVAVKSLKPDGLQGHREWVAEVDFLGQLHHPNLVKLIGYCIEDDQRLLVYEFMTRGSLENHLFRRTIPLPWSNRIKIALGAAKGLAFLHGGPEPVIYRDFKTSNILLDSEYNAKLSDFGLAKAGPQGDKTHVSTRVVGTYGYAAPEYVMTGHLTSKSDVYSFGVVLLEILTGRRSMDKKRPSGEQNLVTWARPYLADKRKMYQLVDPRLELNYSLKGVQKVSQLAFSCLSRDSYSRPTMDEVVKVLTPLQDLNDLAILSYHSRLSQQGKRKKKSEGTQKHTNVSSKSIRDSPLNTGKQRFR

SEQ ID NO: 2764 - DNA, 1230 bp, Populus balsamifera subsp. trichocarpa
  misc_feature (1)..(1230): Ceres ANNOT ID no. 1515247
  misc_feature: Utility: PEG Useful for making plants with increased tolerance to drought
  misc_feature 310424:<222: Transcription Factor
  misc_feature: Phenotype: WHOLE PLANT - PEG Useful for making plants with increased tolerance to drought
atggaggttagaaacccaaagggggtgaaatggcagaggagcaaactagtaagcttaaggtcaccggtttggattcccacttcagctggccacccattgctaaggcaaagagctacaaagcctaatggtgatgcaaagcaagtttcaacctctcctagcggggaatcatcatttagaagcttgaacaaatctttgattgcatccaaagttgatgtatctgcacatagcaatctcaagtcctttagctttactgatttgaagaatgccaccaagaacttccgttcagaaactttgctcggagagggaggttttgggtgtgttttcaaaggatggattgacttgaacacatttgctccaaccaaacctggaagtggagttattgttgcagtcaagaagctcaagccagaaagctgtcagggtcacaaggagtggcttacagaagtaacctatctcggtcagcttcatcatgaaaatctagtgaaactcattgggtattgttccgagtctgataatagacttctagtctatgaatttatgccgaagggaagtttggagcaacatttatttagaaaaggtgttcagcctatcacttggactatgagaatgaatattgcaattgatgtagcaagggggttgtccttcttgcatgggttggatgccaatgtaatctatcgcgacttgaaggcatccaatgttctacttgattcggattataatgctaagctttcagattttggcttagcaagggatggccctactggagataacacacacgtgtcaaccaaggttttgggaactcggggctatgctgcgccggagtatgtagccacaggtcatttgaccccgaagagtgacgtgtacagctatggtgttgtcttgttagagttgctatcaggccgaagggcaatggatgaagagagaggcggttttgacgacgaaaccctggtggattgggcgaagcctttcttgattgacagtaggcgagttttgagaatcatggacactagactgggtggacagtaccctaagaaagcagcccaagcagcggctgcactcgcgttacagtgcctgcacacagatcccaagaacaggccacccatgattgatgttctaacaactttagaaaaactcatcacatcaaaggacatcccaagaacagcacgtccagttaagctggataatcatgggatcaagcctatgaacagctcttacaggataaccaaaacataa

SEQ ID NO: 2765 - protein, 409 aa, Populus balsamifera subsp. trichocarpa
  misc_feature (1)..(409): Ceres ANNOT ID no. 1515247
  misc_feature (342)..(374): Pfam Name: Pkinase_Tyr Pfam Description: Protein tyrosine kinase
  misc_feature: SWISSPROT Homolog: APK1A_ARATH Protein kinase APK1A, chloroplast precursor (EC 2.7.11.1) with e-value of 1.4e-131 and BLAST sequence identity of 69.6
  misc_feature: SWISSPROT Homolog: APK1B_ARATH Protein kinase APK1B, chloroplast precursor (EC 2.7.11.1) with e-value of 1.4e-131 and BLAST sequence identity of 70.9
  misc_feature: SWISSPROT Homolog: NAK_ARATH Probable serine/threonine-protein kinase NAK chloroplast precursor (EC 2.7.11.1) with e-value of 4.4e-128 and BLAST sequence identity of 70.6
  misc_feature: SWISSPROT Homolog: CX32_ARATH Probable serine/threonine-protein kinase Cx32, chloroplast precursor (EC 2.7.11.1) with e-value of 2.1e-98 and BLAST sequence identity of 51.6
  misc_feature: SWISSPROT Homolog: PBS1_ARATH Serine/threonine-protein kinase PBS1 chloroplast precursor EC 2.7.11.1 (AvrPphB susceptible protein 1) with e-value of 3.1e-81 and BLAST sequence identity of 47.8
  misc_feature: Utility: PEG Useful for making plants with increased tolerance to drought
  misc_feature 310543:<222: Transcription Factor
  misc_feature: Phenotype: WHOLE PLANT - PEG Useful for making plants with increased tolerance to drought
  misc_feature (1)..(409): Functional Homolog of  Ceres CLONE ID no. 256804 at SEQ ID NO. 2792 with e-value of 3.59E-109 and BLAST sequence identity of 60.2
MEVRNPKGVKWQRSKLVSLRSPVWIPTSAGHPLLRQRATKPNGDAKQVSTSPSGESSFRSLNKSLIASKVDVSAHSNLKSFSFTDLKNATKNFRSETLLGEGGFGCVFKGWIDLNTFAPTKPGSGVIVAVKKLKPESCQGHKEWLTEVTYLGQLHHENLVKLIGYCSESDNRLLVYEFMPKGSLEQHLFRKGVQPITWTMRMNIAIDVARGLSFLHGLDANVIYRDLKASNVLLDSDYNAKLSDFGLARDGPTGDNTHVSTKVLGTRGYAAPEYVATGHLTPKSDVYSYGVVLLELLSGRRAMDEERGGFDDETLVDWAKPFLIDSRRVLRIMDTRLGGQYPKKAAQAAAALALQCLHTDPKNRPPMIDVLTTLEKLITSKDIPRTARPVKLDNHGIKPMNSSYRITKT

SEQ ID NO: 2766 - DNA, 1296 bp, Populus balsamifera subsp. trichocarpa
  misc_feature (1)..(1296): Ceres ANNOT ID no. 1536456
  misc_feature: Utility: PEG Useful for making plants with increased tolerance to drought
  misc_feature 310660:<222: Transcription Factor
  misc_feature: Phenotype: WHOLE PLANT - PEG Useful for making plants with increased tolerance to drought
atgggcaattgccttagatctctctttaatgatcctagcactcctagctccatagccaacaacgatcctgccacctcagggacatctaaaatcaattacagcaacaccaccatagatttctcagccacaagtggcagtactgcttgcaagagtcaattctctgaggcagtgagtcatgatgaaggaaatgaagcgacaaataatccaaatggacaaatattggaatcaccaaacttgaaggagttcacttttgcagatttgaagagtacaacaaagaattttaaatcagatactttgttgggcgagggaggttttggtaaagtctataaaggttggattgatgagaggacttatgcaccctctaagtctggcagtggcatggtcgttgctatcaagaaattgaacccagaaagtgtgcaagggtttcaagagtggcagtcagaggtgaactttctaggaaggctatcacaccccaatttggttaagttattgggctattgttgggaggataaagagctactccttgtgtatgagtttatgcagaagggaagcttggagaaccatctttttagaaagaatcctaatattgaacccctctcttgggatatacggctaaagatagccgttggagcagctagaggtctaactttcctgcatacttcggacaagaaagtcatttatagagatttcaaggcctctaatatcctgctggatgggaactacaatgccaaaatatcagattttggcttggcgaaattggggccttcgggtggagagtcacatgtgacaaccagggtcatgggaacttatggttatgctgctcctgagtacattgcaacaggtcatttatatgtaaagagtgatgtgtatggttttggcgttgtgctacttgaaatgctgtcaggccgaagggcacttgatacaaagcggccgactggtcagcaaaatttgatcgaatggttaaagccattgctttcacaaaaaaagaagctcaaaaccaccatcatggatgcaaggatcgagggccaatattcatccaaggcaatggtacaagcagcacagcttactttaaagtgcctggaagcagatcctaaaaacaggccctccatgaaagaagttttagaggtgttggaacagatagaggcaatgaaggaaaaaccaaaggcaaccaaaagcacttttggttcctcgctgtcggaaccccatcgcagaggccaacaaccaaacctgcatcgttttccgtttcattccaggtcaaatgagcaggaaacattcaaaaacaacaaaaagaagtaa

SEQ ID NO: 2767 - protein, 431 aa, Populus balsamifera subsp. trichocarpa
  misc_feature (1)..(431): Ceres ANNOT ID no. 1536456
  misc_feature (354)..(377): Pfam Name: Pkinase_Tyr Pfam Description: Protein tyrosine kinase
  misc_feature: SWISSPROT Homolog: APK1A_ARATH Protein kinase APK1A, chloroplast precursor (EC 2.7.11.1) with e-value of 1.4e-131 and BLAST sequence identity of 69.6
  misc_feature: SWISSPROT Homolog: APK1B_ARATH Protein kinase APK1B, chloroplast precursor (EC 2.7.11.1) with e-value of 1.4e-131 and BLAST sequence identity of 70.9
  misc_feature: SWISSPROT Homolog: NAK_ARATH Probable serine/threonine-protein kinase NAK chloroplast precursor (EC 2.7.11.1) with e-value of 4.4e-128 and BLAST sequence identity of 70.6
  misc_feature: SWISSPROT Homolog: CX32_ARATH Probable serine/threonine-protein kinase Cx32, chloroplast precursor (EC 2.7.11.1) with e-value of 2.1e-98 and BLAST sequence identity of 51.6
  misc_feature: SWISSPROT Homolog: PBS1_ARATH Serine/threonine-protein kinase PBS1 chloroplast precursor EC 2.7.11.1 (AvrPphB susceptible protein 1) with e-value of 3.1e-81 and BLAST sequence identity of 47.8
  misc_feature: Utility: PEG Useful for making plants with increased tolerance to drought
  misc_feature 310781:<222: Transcription Factor
  misc_feature: Phenotype: WHOLE PLANT - PEG Useful for making plants with increased tolerance to drought
  misc_feature (1)..(431): Functional Homolog of  Ceres CLONE ID no. 256804 at SEQ ID NO. 2792 with e-value of 4.09E-108 and BLAST sequence identity of 56.9
MGNCLRSLFNDPSTPSSIANNDPATSGTSKINYSNTTIDFSATSGSTACKSQFSEAVSHDEGNEATNNPNGQILESPNLKEFTFADLKSTTKNFKSDTLLGEGGFGKVYKGWIDERTYAPSKSGSGMVVAIKKLNPESVQGFQEWQSEVNFLGRLSHPNLVKLLGYCWEDKELLLVYEFMQKGSLENHLFRKNPNIEPLSWDIRLKIAVGAARGLTFLHTSDKKVIYRDFKASNILLDGNYNAKISDFGLAKLGPSGGESHVTTRVMGTYGYAAPEYIATGHLYVKSDVYGFGVVLLEMLSGRRALDTKRPTGQQNLIEWLKPLLSQKKKLKTTIMDARIEGQYSSKAMVQAAQLTLKCLEADPKNRPSMKEVLEVLEQIEAMKEKPKATKSTFGSSLSEPHRRGQQPNLHRFPFHSRSNEQETFKNNKKK

SEQ ID NO: 2768 - DNA, 1356 bp, Populus balsamifera subsp. trichocarpa
  misc_feature (1)..(1356): Ceres ANNOT ID no. 1451195
  misc_feature: Utility: PEG Useful for making plants with increased tolerance to drought
  misc_feature 310901:<222: Transcription Factor
  misc_feature: Phenotype: WHOLE PLANT - PEG Useful for making plants with increased tolerance to drought
atgggtaactgcctaagatctttcttttatgatcctagtcctagctccatagccaacaacaatccttccaccccagggacatccaatagtacttacagcagcaccaccatagatgtctcagccactagtagtagtattgtttgcaggagtcaattctctgaggcagcgagtcatgatgaaggaaatgaagtgataagtaatgcaaatgggcaaatattggaatcatcaaatttggaggagttcactttttcagatttgaagagggcaacaaagaattttaaatcagatactttgttgggcgagggaggttttggtaaagtctataaaggttggattgatcagaagacttatgcgccctctaagtccggcagtggcatggtggttgctataaagaaattgaactcaggaagtatgcaaggacttgaagagtggcagtcagaggtgaactttctaggaaggctatcgcatcccaacttggttaagttattgggcttttgttgggaggataaagagctactccttgtgtatgaatttatgccgaagggaagcttggagaaccatctgtttagaaggaatattgaacccctctcttgggatatacggctaaagatagccattggagcagctcgaggtctagcttttctacatgcctcagagaagcaagtcatttatagagatttcaaggcctctaatatcctacttgatgggaaatacaatgccaaaatatcagattttggcctggcgaagttggggccttctggtggagagtcacatgtgacaaccagggtcatgggaacctatggttatgctgctcctgagtacattgcaacaggtcatttgtatgtaaaaagtgatgtgtatggttttggtgtcgtgctacttgaaatgctgtcaggccaaagggcgctcgataggaagcgaccaactggtcagcaaaatctggttgaatggttgaagccattgctctcacacaaaaagaagctcaaaaccaccattatggattcaaggattgagggccaatattcggccaaggcgatggtacaagcagcacaactaactttaaagtgcctgaaagcagatcctaaaaaccgcccctccatgaaagaagttgtagaggtgttggaacagatagaggcaatgaaggaaaaaccaaaggcgaccaaaagcactttcgcttcctcacattctaaaccccatcgccgtggccaacaaccaactcagcatcgtcccctcttcattccaggtcgcagggggcctaaatacgagcacgaagtgaacattcgtaaaataacaaaaaagttgccatttgtattcagtgagatgatgatgttgccacttgaaaaacaagaagtgtga

SEQ ID NO: 2769 - protein, 451 aa, Populus balsamifera subsp. trichocarpa
  misc_feature (1)..(451): Ceres ANNOT ID no. 1451195
  misc_feature (355)..(374): Pfam Name: Pkinase Pfam Description: Protein kinase domain
  misc_feature: SWISSPROT Homolog: APK1A_ARATH Protein kinase APK1A, chloroplast precursor (EC 2.7.11.1) with e-value of 1.4e-131 and BLAST sequence identity of 69.6
  misc_feature: SWISSPROT Homolog: APK1B_ARATH Protein kinase APK1B, chloroplast precursor (EC 2.7.11.1) with e-value of 1.4e-131 and BLAST sequence identity of 70.9
  misc_feature: SWISSPROT Homolog: NAK_ARATH Probable serine/threonine-protein kinase NAK chloroplast precursor (EC 2.7.11.1) with e-value of 4.4e-128 and BLAST sequence identity of 70.6
  misc_feature: SWISSPROT Homolog: CX32_ARATH Probable serine/threonine-protein kinase Cx32, chloroplast precursor (EC 2.7.11.1) with e-value of 2.1e-98 and BLAST sequence identity of 51.6
  misc_feature: SWISSPROT Homolog: PBS1_ARATH Serine/threonine-protein kinase PBS1 chloroplast precursor EC 2.7.11.1 (AvrPphB susceptible protein 1) with e-value of 3.1e-81 and BLAST sequence identity of 47.8
  misc_feature: Utility: PEG Useful for making plants with increased tolerance to drought
  misc_feature 311024:<222: Transcription Factor
  misc_feature: Phenotype: WHOLE PLANT - PEG Useful for making plants with increased tolerance to drought
  misc_feature (1)..(451): Functional Homolog of  Ceres CLONE ID no. 256804 at SEQ ID NO. 2792 with e-value of 1.60E-106 and BLAST sequence identity of 55.5
MGNCLRSFFYDPSPSSIANNNPSTPGTSNSTYSSTTIDVSATSSSIVCRSQFSEAASHDEGNEVISNANGQILESSNLEEFTFSDLKRATKNFKSDTLLGEGGFGKVYKGWIDQKTYAPSKSGSGMVVAIKKLNSGSMQGLEEWQSEVNFLGRLSHPNLVKLLGFCWEDKELLLVYEFMPKGSLENHLFRRNIEPLSWDIRLKIAIGAARGLAFLHASEKQVIYRDFKASNILLDGKYNAKISDFGLAKLGPSGGESHVTTRVMGTYGYAAPEYIATGHLYVKSDVYGFGVVLLEMLSGQRALDRKRPTGQQNLVEWLKPLLSHKKKLKTTIMDSRIEGQYSAKAMVQAAQLTLKCLKADPKNRPSMKEVVEVLEQIEAMKEKPKATKSTFASSHSKPHRRGQQPTQHRPLFIPGRRGPKYEHEVNIRKITKKLPFVFSEMMMLPLEKQEV

SEQ ID NO: 2770 - DNA, 1365 bp, Populus balsamifera subsp. trichocarpa
  misc_feature (1)..(1365): Ceres ANNOT ID no. 1482990
  misc_feature: Utility: PEG Useful for making plants with increased tolerance to drought
  misc_feature 311150:<222: Transcription Factor
  misc_feature: Phenotype: WHOLE PLANT - PEG Useful for making plants with increased tolerance to drought
atgggcaattgccttagatctctctttaatgatcctagcactcctagctccatagccaacaacgatcctgccacctcagggacatctaaaatcaattacagcaacaccaccatagatttctcagccacaagtggcagtactgcttgcaagagtcaattctctgaggcagtgagtcatgatgaaggaaatgaagcgacaaataatccaaatggacaaatattggaatcaccaaacttgaaggagttcacttttgcagatttgaagagtacaacaaagaattttaaatcagatactttgttgggcgagggaggttttggtaaagtctataaaggttggattgatgagaggacttatgcaccctctaagtctggcagtggcatggtcgttgctatcaagaaattgaacccagaaagtgtgcaagggtttcaagagtggcagcatgactttttgcatgctattgaatggaatttcaatggtgtggctggtagaaggtgctcttgtcataagtcagaggtgaactttctaggaaggctatcacaccccaatttggttaagttattgggctattgttgggaggataaagagctactccttgtgtatgagtttatgcagaagggaagcttggagaaccatctttttagaaagaatcctaatattgaacccctctcttgggatatacggctaaagatagccgttggagcagctagaggtctaactttcctgcatacttcggacaagaaagtcatttatagagatttcaaggcctctaatatcctgctggatgggaactacaatgccaaaatatcagattttggcttggcgaaattggggccttcgggtggagagtcacatgtgacaaccagggtcatgggaacttatggttatgctgctcctgagtacattgcaacaggtcatttatatgtaaagagtgatgtgtatggttttggcgttgtgctacttgaaatgctgtcaggccgaagggcacttgatacaaagcggccgactggtcagcaaaatttgatcgaatggttaaagccattgctttcacaaaaaaagaagctcaaaaccaccatcatggatgcaaggatcgagggccaatattcatccaaggcaatggtacaagcagcacagcttactttaaagtgcctggaagcagatcctaaaaacaggccctccatgaaagaagttttagaggtgttggaacagatagaggcaatgaaggaaaaaccaaaggcaaccaaaagcacttttggttcctcgctgtcggaaccccatcgcagaggccaacaaccaaacctgcatcgttttccgtttcattccaggtcaaatgagcaggaaacattcaaaaacaacaaaaagaagtaa

SEQ ID NO: 2771 - protein, 454 aa, Populus balsamifera subsp. trichocarpa
  misc_feature (1)..(454): Ceres ANNOT ID no. 1482990
  misc_feature (377)..(400): Pfam Name: Pkinase_Tyr Pfam Description: Protein tyrosine kinase
  misc_feature: SWISSPROT Homolog: APK1A_ARATH Protein kinase APK1A, chloroplast precursor (EC 2.7.11.1) with e-value of 1.4e-131 and BLAST sequence identity of 69.6
  misc_feature: SWISSPROT Homolog: APK1B_ARATH Protein kinase APK1B, chloroplast precursor (EC 2.7.11.1) with e-value of 1.4e-131 and BLAST sequence identity of 70.9
  misc_feature: SWISSPROT Homolog: NAK_ARATH Probable serine/threonine-protein kinase NAK chloroplast precursor (EC 2.7.11.1) with e-value of 4.4e-128 and BLAST sequence identity of 70.6
  misc_feature: SWISSPROT Homolog: CX32_ARATH Probable serine/threonine-protein kinase Cx32, chloroplast precursor (EC 2.7.11.1) with e-value of 2.1e-98 and BLAST sequence identity of 51.6
  misc_feature: SWISSPROT Homolog: PBS1_ARATH Serine/threonine-protein kinase PBS1 chloroplast precursor EC 2.7.11.1 (AvrPphB susceptible protein 1) with e-value of 3.1e-81 and BLAST sequence identity of 47.8
  misc_feature: Utility: PEG Useful for making plants with increased tolerance to drought
  misc_feature 311273:<222: Transcription Factor
  misc_feature: Phenotype: WHOLE PLANT - PEG Useful for making plants with increased tolerance to drought
  misc_feature (1)..(454): Functional Homolog of  Ceres CLONE ID no. 256804 at SEQ ID NO. 2792 with e-value of 1.70E-102 and BLAST sequence identity of 56.9
MGNCLRSLFNDPSTPSSIANNDPATSGTSKINYSNTTIDFSATSGSTACKSQFSEAVSHDEGNEATNNPNGQILESPNLKEFTFADLKSTTKNFKSDTLLGEGGFGKVYKGWIDERTYAPSKSGSGMVVAIKKLNPESVQGFQEWQHDFLHAIEWNFNGVAGRRCSCHKSEVNFLGRLSHPNLVKLLGYCWEDKELLLVYEFMQKGSLENHLFRKNPNIEPLSWDIRLKIAVGAARGLTFLHTSDKKVIYRDFKASNILLDGNYNAKISDFGLAKLGPSGGESHVTTRVMGTYGYAAPEYIATGHLYVKSDVYGFGVVLLEMLSGRRALDTKRPTGQQNLIEWLKPLLSQKKKLKTTIMDARIEGQYSSKAMVQAAQLTLKCLEADPKNRPSMKEVLEVLEQIEAMKEKPKATKSTFGSSLSEPHRRGQQPNLHRFPFHSRSNEQETFKNNKKK

SEQ ID NO: 2772 - DNA, 1344 bp, Populus balsamifera subsp. trichocarpa
  misc_feature (1)..(1344): Ceres ANNOT ID no. 1461956
  misc_feature: Utility: PEG Useful for making plants with increased tolerance to drought
  misc_feature 311399:<222: Transcription Factor
  misc_feature: Phenotype: WHOLE PLANT - PEG Useful for making plants with increased tolerance to drought
atggaggttagaaacccaaagggggtgaaatggcagaggagcaaactagtaagcttaaggtcaccggtttggattcccacttcagctggccacccattgctaaggcaaagagctacaaagcctaatggtgatgcaaagcaagtttcaacctctcctagcggggaatcatcatttagaagcttgaacaaatctttgattgcatccaaagttgatgtatctgcacatagcaatctcaagtcctttagctttactgatttgaagaatgccaccaagaacttccgttcagaaactttgctcggagagggaggttttgggtgtgttttcaaaggatggattgacttgaacacatttgctccaaccaaacctggaagtggagttattgttgcagtcaagaagctcaagccagaaagctgtcagggtcacaaggagtggcttacagaagtaacctatctcggtcagcttcatcatgaaaatctagtgaaactcattgggtattgttccgagtctgataatagacttctagtctatgaatttatgccgaagggaagtttggagcaacatttatttagaagctcttttgtgttgggattgcgaggtgtaatgcatgaacaattggatgaagatgatgaggattggattgaagggagagcggaaaaattctttgaagaatttaatctatttcttaaaggtgttcagcctatcacttggactatgagaatgaatattgcaattgatgtagcaagggggttgtccttcttgcatgggttggatgccaatgtaatctatcgcgacttgaaggcatccaatgttctacttgattcggattataatgctaagctttcagattttggcttagcaagggatggccctactggagataacacacacgtgtcaaccaaggttttgggaactcggggctatgctgcgccggagtatgtagccacaggtcatttgaccccgaagagtgacgtgtacagctatggtgttgtcttgttagagttgctatcaggccgaagggcaatggatgaagagagaggcggttttgacgacgaaaccctggtggattgggcgaagcctttcttgattgacagtaggcgagttttgagaatcatggacactagactgggtggacagtaccctaagaaagcagcccaagcagcggctgcactcgcgttacagtgcctgcacacagatcccaagaacaggccacccatgattgatgttctaacaactttagaaaaactcatcacatcaaaggacatcccaagaacagcacgtccagttaagctggataatcatgggatcaagcctatgaacagctcttacaggataaccaaaacataa

SEQ ID NO: 2773 - protein, 447 aa, Populus balsamifera subsp. trichocarpa
  misc_feature (1)..(447): Ceres ANNOT ID no. 1461956
  misc_feature (380)..(412): Pfam Name: Pkinase_Tyr Pfam Description: Protein tyrosine kinase
  misc_feature: SWISSPROT Homolog: APK1A_ARATH Protein kinase APK1A, chloroplast precursor (EC 2.7.11.1) with e-value of 1.4e-131 and BLAST sequence identity of 69.6
  misc_feature: SWISSPROT Homolog: APK1B_ARATH Protein kinase APK1B, chloroplast precursor (EC 2.7.11.1) with e-value of 1.4e-131 and BLAST sequence identity of 70.9
  misc_feature: SWISSPROT Homolog: NAK_ARATH Probable serine/threonine-protein kinase NAK chloroplast precursor (EC 2.7.11.1) with e-value of 4.4e-128 and BLAST sequence identity of 70.6
  misc_feature: SWISSPROT Homolog: CX32_ARATH Probable serine/threonine-protein kinase Cx32, chloroplast precursor (EC 2.7.11.1) with e-value of 2.1e-98 and BLAST sequence identity of 51.6
  misc_feature: SWISSPROT Homolog: PBS1_ARATH Serine/threonine-protein kinase PBS1 chloroplast precursor EC 2.7.11.1 (AvrPphB susceptible protein 1) with e-value of 3.1e-81 and BLAST sequence identity of 47.8
  misc_feature: Utility: PEG Useful for making plants with increased tolerance to drought
  misc_feature 311522:<222: Transcription Factor
  misc_feature: Phenotype: WHOLE PLANT - PEG Useful for making plants with increased tolerance to drought
  misc_feature (1)..(447): Functional Homolog of  Ceres CLONE ID no. 256804 at SEQ ID NO. 2792 with e-value of 1.19E-101 and BLAST sequence identity of 60.1
MEVRNPKGVKWQRSKLVSLRSPVWIPTSAGHPLLRQRATKPNGDAKQVSTSPSGESSFRSLNKSLIASKVDVSAHSNLKSFSFTDLKNATKNFRSETLLGEGGFGCVFKGWIDLNTFAPTKPGSGVIVAVKKLKPESCQGHKEWLTEVTYLGQLHHENLVKLIGYCSESDNRLLVYEFMPKGSLEQHLFRSSFVLGLRGVMHEQLDEDDEDWIEGRAEKFFEEFNLFLKGVQPITWTMRMNIAIDVARGLSFLHGLDANVIYRDLKASNVLLDSDYNAKLSDFGLARDGPTGDNTHVSTKVLGTRGYAAPEYVATGHLTPKSDVYSYGVVLLELLSGRRAMDEERGGFDDETLVDWAKPFLIDSRRVLRIMDTRLGGQYPKKAAQAAAALALQCLHTDPKNRPPMIDVLTTLEKLITSKDIPRTARPVKLDNHGIKPMNSSYRITKT

SEQ ID NO: 2774 - protein, 191 aa, Arabidopsis thaliana
  misc_feature (1)..(191): Ceres CLONE ID no. 262460
  misc_feature (2)..(43): Pfam Name: Myb_DNA-binding Pfam Description: Myb-like DNA-binding domain
  misc_feature: Phenotype: ROSETTE LEAVES - Cup-shaped Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: WHOLE PLANT - Other Useful for making bigger plants
  misc_feature: Phenotype: ROSETTE LEAVES - Other Useful for making ornamental plants with modified leaves
MEEDLILINYIANHGEGVWNSLAKSAGLKRTGKSCRLRWLNYLRPDVRRGNITPEEQLTIMELHAKWGNRWSKIAKHLPGRTDNEIKNFWRTKIQKYIIKSGETTTVGSQSSEFINHHATTSHVMNDTQETMDMYSPTTSYQHASNINQQLNYGNYVPESSSIMMPLSVDQSEQNYWSVDDLWPMNIYNGN

SEQ ID NO: 2775 - DNA, 573 bp, Populus balsamifera subsp. trichocarpa
  misc_feature (1)..(573): Ceres ANNOT ID no. 1530053
  misc_feature 311752:<222: Transcription Factor
  misc_feature: Phenotype: ROSETTE LEAVES - Cup-shaped Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: WHOLE PLANT - Other Useful for making bigger plants
  misc_feature: Phenotype: ROSETTE LEAVES - Other Useful for making ornamental plants with modified leaves
atggataaaacaccatccaactctcaggatgttgaagtaagaaaagggccatggaccttggaagaagacttgatcttaaccaaccacatcgcgaaccacggtgaaggtgtatggaactcgcttgctaaagctgcaggtctgaaacgtacaggaaagagttgccggctccgttggctcaactacttgcggcccgaccttcgaagagggaatattacacctgaagaacagctcttgatcatggaactgcatgctaagtggggaaacaggtggtcgaagattgcaaagcatcttccagggaggaccgacaacgaaataaagaattactggagaactagaatccagaagcacatcaagcaagctgaaacatttgccgcacagagttctgagacgaatgaacatgggagcagtagcagccaagtttccagcacaaccgaattaatggtgtccaattgtctgccatcctaccaaggagatgtggaggccttttcaggggggaatatacctcaagaactgaacgaaaattattggagcatggaggatctgtggtccatgcagttacttaatggcgattaa

SEQ ID NO: 2776 - protein, 190 aa, Populus balsamifera subsp. trichocarpa
  misc_feature (1)..(190): Ceres ANNOT ID no. 1530053
  misc_feature (15)..(62): Pfam Name: Myb_DNA-binding Pfam Description: Myb-like DNA-binding domain
  misc_feature: SWISSPROT Homolog: MYB21_ARATH Transcription factor MYB21 (Myb-related protein 21) (AtMYB21) (Myb homolog 3) (AtMyb3) with e-value of 7.6e-69 and BLAST sequence identity of 70.0
  misc_feature: SWISSPROT Homolog: MYBP_MAIZE Myb-related protein P with e-value of 3.1e-33 and BLAST sequence identity of 67.0
  misc_feature: SWISSPROT Homolog: MYB86_ARATH Transcription factor MYB86 (Myb-related protein 86) (AtMYB86) (Myb homolog 4) (AtMyb4) with e-value of 2.2e-32 and BLAST sequence identity of 53.0
  misc_feature: SWISSPROT Homolog: MYB4_ARATH Transcription repressor MYB4 (Myb-related protein 4) (AtMYB4) with e-value of 1.5e-31 and BLAST sequence identity of 62.4
  misc_feature: SWISSPROT Homolog: GL1_ARALY Trichome differentiation protein GL1 (GLABROUS1 protein) with e-value of 3.2e-31 and BLAST sequence identity of 40.1
  misc_feature 311891:<222: Transcription Factor
  misc_feature: Phenotype: ROSETTE LEAVES - Cup-shaped Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: WHOLE PLANT - Other Useful for making bigger plants
  misc_feature: Phenotype: ROSETTE LEAVES - Other Useful for making ornamental plants with modified leaves
  misc_feature (1)..(190): Functional Homolog of  Ceres CLONE ID no. 262460 at SEQ ID NO. 2821 with e-value of 3.40E-56 and BLAST sequence identity of 69.0
MDKTPSNSQDVEVRKGPWTLEEDLILTNHIANHGEGVWNSLAKAAGLKRTGKSCRLRWLNYLRPDLRRGNITPEEQLLIMELHAKWGNRWSKIAKHLPGRTDNEIKNYWRTRIQKHIKQAETFAAQSSETNEHGSSSSQVSSTTELMVSNCLPSYQGDVEAFSGGNIPQELNENYWSMEDLWSMQLLNGD

SEQ ID NO: 2777 - DNA, 573 bp, Populus balsamifera subsp. trichocarpa
  misc_feature (1)..(573): Ceres ANNOT ID no. 1493414
  misc_feature 312009:<222: Transcription Factor
  misc_feature: Phenotype: ROSETTE LEAVES - Cup-shaped Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: WHOLE PLANT - Other Useful for making bigger plants
  misc_feature: Phenotype: ROSETTE LEAVES - Other Useful for making ornamental plants with modified leaves
atggataaaagtccatgcaactctcaggatgttgaagtgagaaaagggccatggaccttggaagaagacttgatcttaaccaactacatcgcgaaccatggtgaaggtgtatggaactcgcttgcaaaagctgcaggtctgaaacgtaccggaaagagttgtaggctccgttggctcaactacttgcggcctgaccttcgaagagggaatattactcctgaagaacagctcttgatcatggaactgcatgctaagttgggaaacaggtggtcgaaaattgcaaagcatcttccagggaggaccgacaacgagataaagaattactggagaactagaatcaagaagcatactaagcaaactgaaccatttgcggcggggagttctgagactaatgaacatgggagcagtacttgccaagtttccagcgcaaccgaccaaatggagacctattgtccaccattctatcaaggagacgtaggggccttttctggtgggaatatacctcaagaactgaacgaaaactattggagcatggaggatctctggtccatgcaactgcttaatggcgattaa

SEQ ID NO: 2778 - protein, 190 aa, Populus balsamifera subsp. trichocarpa
  misc_feature (1)..(190): Ceres ANNOT ID no. 1493414
  misc_feature (15)..(62): Pfam Name: Myb_DNA-binding Pfam Description: Myb-like DNA-binding domain
  misc_feature: SWISSPROT Homolog: MYB21_ARATH Transcription factor MYB21 (Myb-related protein 21) (AtMYB21) (Myb homolog 3) (AtMyb3) with e-value of 7.6e-69 and BLAST sequence identity of 70.0
  misc_feature: SWISSPROT Homolog: MYBP_MAIZE Myb-related protein P with e-value of 3.1e-33 and BLAST sequence identity of 67.0
  misc_feature: SWISSPROT Homolog: MYB86_ARATH Transcription factor MYB86 (Myb-related protein 86) (AtMYB86) (Myb homolog 4) (AtMyb4) with e-value of 2.2e-32 and BLAST sequence identity of 53.0
  misc_feature: SWISSPROT Homolog: MYB4_ARATH Transcription repressor MYB4 (Myb-related protein 4) (AtMYB4) with e-value of 1.5e-31 and BLAST sequence identity of 62.4
  misc_feature: SWISSPROT Homolog: GL1_ARALY Trichome differentiation protein GL1 (GLABROUS1 protein) with e-value of 3.2e-31 and BLAST sequence identity of 40.1
  misc_feature 312148:<222: Transcription Factor
  misc_feature: Phenotype: ROSETTE LEAVES - Cup-shaped Useful for making ornamental plants with altered leaf shape
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: WHOLE PLANT - Other Useful for making bigger plants
  misc_feature: Phenotype: ROSETTE LEAVES - Other Useful for making ornamental plants with modified leaves
  misc_feature (1)..(190): Functional Homolog of  Ceres CLONE ID no. 262460 at SEQ ID NO. 2821 with e-value of 2.00E-53 and BLAST sequence identity of 67.2
MDKSPCNSQDVEVRKGPWTLEEDLILTNYIANHGEGVWNSLAKAAGLKRTGKSCRLRWLNYLRPDLRRGNITPEEQLLIMELHAKLGNRWSKIAKHLPGRTDNEIKNYWRTRIKKHTKQTEPFAAGSSETNEHGSSTCQVSSATDQMETYCPPFYQGDVGAFSGGNIPQELNENYWSMEDLWSMQLLNGD

SEQ ID NO: 2779 - protein, 106 aa, Arabidopsis thaliana
  misc_feature (1)..(106): Ceres CLONE ID no. 264705
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Short Petioles Useful for modulating plant size
MASRFMSRSSISSLKSAIRSSFRNSPIGTGSSPAAASFAGFRIPSKPAASPLPRFSFSRCPSELGCVQSLLPLHSTVAAARLTSCLSTTSRSSRALTQEMGLSVPR

SEQ ID NO: 2780 - DNA, 333 bp, Populus balsamifera subsp. trichocarpa
  misc_feature (1)..(333): Ceres ANNOT ID no. 1485750
  misc_feature 312323:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Short Petioles Useful for modulating plant size
atggcctcctcctcttcatcttgcaggaaatttatctccaaatcatctctatcgtccatcaaatcatccatcagatcatctaaggctcctaaatctccctccacccccaccagatctgccaccgcttctcacttccttctcccatccaaaccaccaacctcctctcgattctccttttccagggcaccatgtgagttgggatgcgttcagtcgctgctgccactacacagcgcggtggcggcgtcgaggatgacatcatgcttaagtaccacatccaggaatttccgagcgctctctcagggtacactctgctgcacctctcccggcctctaa

SEQ ID NO: 2781 - protein, 110 aa, Populus balsamifera subsp. trichocarpa
  misc_feature (1)..(110): Ceres ANNOT ID no. 1485750
  misc_feature 312374:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Short Petioles Useful for modulating plant size
  misc_feature (1)..(110): Functional Homolog of  Ceres CLONE ID no. 264705 at SEQ ID NO. 2826 with e-value of 5.09E-23 and BLAST sequence identity of 62.6
MASSSSSCRKFISKSSLSSIKSSIRSSKAPKSPSTPTRSATASHFLLPSKPPTSSRFSFSRAPCELGCVQSLLPLHSAVAASRMTSCLSTTSRNFRALSQGTLCCTSPGL

SEQ ID NO: 2782 - DNA, 324 bp, Populus balsamifera subsp. trichocarpa
  misc_feature (1)..(324): Ceres ANNOT ID no. 1440730
  misc_feature 312442:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Short Petioles Useful for modulating plant size
atggctttctcctcatcttgcaggagatttatctccaaatcatctctatcgtccatcaaatcagccatcaggtcatccaacgttcctaaatctccctccatgcccaccagatctgctactgctctcccatcatccaaaccaccaacctcccctcaattctccttttccagggctccatgtgagttgggatgcgttcagtcgctgctgccactacacagcgcggtggcggcgtcgaggatgacatcatgcttaagcactacatccaggagttgccgtgcgctctctcagggtacactctgctgcactcttttattgcttctctag

SEQ ID NO: 2783 - protein, 107 aa, Populus balsamifera subsp. trichocarpa
  misc_feature (1)..(107): Ceres ANNOT ID no. 1440730
  misc_feature 312493:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Short Petioles Useful for modulating plant size
  misc_feature (1)..(107): Functional Homolog of  Ceres CLONE ID no. 264705 at SEQ ID NO. 2826 with e-value of 8.20E-23 and BLAST sequence identity of 70.1
MAFSSSCRRFISKSSLSSIKSAIRSSNVPKSPSMPTRSATALPSSKPPTSPQFSFSRAPCELGCVQSLLPLHSAVAASRMTSCLSTTSRSCRALSQGTLCCTLLLLL

SEQ ID NO: 2784 - protein, 80 aa, Arabidopsis thaliana
  misc_feature (1)..(80): Ceres CLONE ID no. 266142
  misc_feature: Phenotype: WHOLE PLANT - Small Useful for modulating plant size
MGNESKSNLGGGGIRAKMEHYVYSGEKKHVLAGIGIISIIFGIPWYLMNQGSKHRSHQDYLEKADKARKARLSSSSSSDK

SEQ ID NO: 2785 - DNA, 249 bp, Populus balsamifera subsp. trichocarpa
  misc_feature (1)..(249): Ceres ANNOT ID no. 1449110
  misc_feature 312601:<222: Transcription Factor
  misc_feature: Phenotype: WHOLE PLANT - Small Useful for modulating plant size
atgggaagcgaggctaaaaaacaaggccaacagcgaaggattcaagtcaagagtaaatcgtacttgcatagtggggacacaaagcatgtcatagctggcatgggcctcatcactcttgtctttggtgtcccttggtacctcataaacagagatgatcgacggttgagttacagagaagtattgctttgtgttaaagagttaattactcaaagtgctgctgctgttgggtttgatttgtttggttcctaa

SEQ ID NO: 2786 - protein, 82 aa, Populus balsamifera subsp. trichocarpa
  misc_feature (1)..(82): Ceres ANNOT ID no. 1449110
  misc_feature 312636:<222: Transcription Factor
  misc_feature: Phenotype: WHOLE PLANT - Small Useful for modulating plant size
  misc_feature (1)..(82): Functional Homolog of  Ceres CLONE ID no. 266142 at SEQ ID NO. 2831 with e-value of 2.89E-11 and BLAST sequence identity of 40.9
MGSEAKKQGQQRRIQVKSKSYLHSGDTKHVIAGMGLITLVFGVPWYLINRDDRRLSYREVLLCVKELITQSAAAVGFDLFGS

SEQ ID NO: 2787 - DNA, 216 bp, Populus balsamifera subsp. trichocarpa
  misc_feature (1)..(216): Ceres ANNOT ID no. 1448105
  misc_feature 312687:<222: Transcription Factor
  misc_feature: Phenotype: WHOLE PLANT - Small Useful for modulating plant size
atgggaagcgaggcaaaaagcaatggtattgccaacagtgaaggattcaagtcaagagtaaatcgttacttgcatagtggagacacaaagcatgtcatggctggcatggtcatcatcactcttgtctttggtgtcccttggttcctcatgaacagaggaattgactcaaattgtcggagcagaagtgttgttgctgaattaagttgggatccttga

SEQ ID NO: 2788 - protein, 71 aa, Populus balsamifera subsp. trichocarpa
  misc_feature (1)..(71): Ceres ANNOT ID no. 1448105
  misc_feature 312720:<222: Transcription Factor
  misc_feature: Phenotype: WHOLE PLANT - Small Useful for modulating plant size
  misc_feature (1)..(71): Functional Homolog of  Ceres CLONE ID no. 266142 at SEQ ID NO. 2831 with e-value of 3.70E-11 and BLAST sequence identity of 49.0
MGSEAKSNGIANSEGFKSRVNRYLHSGDTKHVMAGMVIITLVFGVPWFLMNRGIDSNCRSRSVVAELSWDP

SEQ ID NO: 2789 - protein, 76 aa, Arabidopsis thaliana
  misc_feature (1)..(76): Ceres CLONE ID no. 267564
  misc_feature (6)..(76): Pfam Name: UQ_con Pfam Description: Ubiquitin-conjugating enzyme
  misc_feature: Phenotype: CAULINE LEAVES - Cup-shaped Useful for making ornamental plants with altered leaf shape
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Other Useful for making ornamental plants with modified flowers
MIDFSRIQKELQDCERNQDSSGIRVCPKSDNLTRLTGTIPGPIGTPYEGGTFQIDITMPDGYPFEPPKMQFSTKVW

SEQ ID NO: 2790 - DNA, 585 bp, Populus balsamifera subsp. trichocarpa
  misc_feature (1)..(585): Ceres ANNOT ID no. 1473933
  misc_feature 312832:<222: Transcription Factor
  misc_feature: Phenotype: CAULINE LEAVES - Cup-shaped Useful for making ornamental plants with altered leaf shape
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Other Useful for making ornamental plants with modified flowers
atgatcgactttgctcgtgttcagaaggagctccaagaatgcagcagagacatggaagcttctggcattaaagtagcacctaaatctgacaatcttggtcgattaaccggcactattcctggtccaattggcactccttatgaaggtggcacttttcaaattgatatcactctcccagatggatacccctttgagcctccaaaaatgcagtttgcgacaaaagtctggcaccctaacattagcagtcaaagtggggcaatctgcctggacattttgaaggaccagtggagcccagcactcactctaaagacagcacttctttctgtccaagcattactctctgctcctgaacctgatgaccctcaagatgctgttgtagcgcaacagtatcttagagactaccagacctttgttggcacagctcgctactggacggaaacttttgccaagacctcatcgcttggggtcgaggaaaaggtacaaaaactcgtggagatgggtttccctgaatctttggcgagaggtgcgctagaatctgttggtggtgacgagaacttggctcttgaaaagctttgttctggttaa

SEQ ID NO: 2791 - protein, 194 aa, Populus balsamifera subsp. trichocarpa
  misc_feature (1)..(194): Ceres ANNOT ID no. 1473933
  misc_feature (155)..(194): Pfam Name: UBA Pfam Description: UBA/TS-N domain
  misc_feature (6)..(145): Pfam Name: UQ_con Pfam Description: Ubiquitin-conjugating enzyme
  misc_feature: SWISSPROT Homolog: UBC1_BOVIN Ubiquitin-conjugating enzyme E2-25 kDa with e-value of 5.9e-14 and BLAST sequence identity of 42.9
  misc_feature: SWISSPROT Homolog: UBC1_BOVIN EC 6.3.2.19 (Ubiquitin-protein ligase) Ubiquitin carrier protein (E2(25K)) Huntingtin-interacting protein 2 (HIP-2)
  misc_feature: SWISSPROT Homolog: UBC1_HUMAN Ubiquitin-conjugating enzyme E2-25 kDa with e-value of 5.9e-14 and BLAST sequence identity of 42.9
  misc_feature: SWISSPROT Homolog: UBC1_HUMAN EC 6.3.2.19 (Ubiquitin-protein ligase) Ubiquitin carrier protein (E2(25K)) Huntingtin-interacting protein 2 (HIP-2)
  misc_feature: SWISSPROT Homolog: UBC1_MOUSE Ubiquitin-conjugating enzyme E2-25 kDa with e-value of 5.9e-14 and BLAST sequence identity of 42.9
  misc_feature: SWISSPROT Homolog: UBC1_MOUSE EC 6.3.2.19 (Ubiquitin-protein ligase) Ubiquitin carrier protein (E2(25K)) Huntingtin-interacting protein 2 (HIP-2)
  misc_feature: SWISSPROT Homolog: UBCD4_DROME Ubiquitin-conjugating enzyme E2-22 kDa (EC 6.3.2.19) (Ubiquitin-protein ligase) (Ubiquitin carrier protein) with e-value of 4.2e-13 and BLAST sequence identity of 41.9
  misc_feature: SWISSPROT Homolog: COP10_ARATH Constitutive photomorphogenesis protein 10 with e-value of 1.1e-12 and BLAST sequence identity of 48.6
  misc_feature 312973:<222: Transcription Factor
  misc_feature: Phenotype: CAULINE LEAVES - Cup-shaped Useful for making ornamental plants with altered leaf shape
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Other Useful for making ornamental plants with modified flowers
  misc_feature (1)..(194): Functional Homolog of  Ceres CLONE ID no. 267564 at SEQ ID NO. 2836 with e-value of 2.10E-33 and BLAST sequence identity of 82.8
MIDFARVQKELQECSRDMEASGIKVAPKSDNLGRLTGTIPGPIGTPYEGGTFQIDITLPDGYPFEPPKMQFATKVWHPNISSQSGAICLDILKDQWSPALTLKTALLSVQALLSAPEPDDPQDAVVAQQYLRDYQTFVGTARYWTETFAKTSSLGVEEKVQKLVEMGFPESLARGALESVGGDENLALEKLCSG

SEQ ID NO: 2792 - DNA, 585 bp, Populus balsamifera subsp. trichocarpa
  misc_feature (1)..(585): Ceres ANNOT ID no. 1468704
  misc_feature 313066:<222: Transcription Factor
  misc_feature: Phenotype: CAULINE LEAVES - Cup-shaped Useful for making ornamental plants with altered leaf shape
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Other Useful for making ornamental plants with modified flowers
atgatcgactttgctcgtgttcaaaaggagctgcaagaatgcagcagagacatggaggcttctggcatcaaagtggcacctaaatctgacaatcttgctcgattaaccggaactattcctggtcctatcagctctccttatgaaggtggcacttttcaaattgatatcactctcccagatggatacccctttgagcctccaaaaatgcagtttgcaacaaaagtctggcaccctaatattagcagccaaagtggggcaatctgcctggacattttgaaggaccagtggagcccagcactcaccctaaagacagcacttctttctgtccaagcattgctctctgctcctgaacctgacgatcctcaagatgctgttgtagcacaacagtatcttagagaccgtcagacctttgttggcacagctcgctactggacagaaacttttgccaagacctcatcgcttggggttgaggaaaaggttcaaaaacttgtggagatgggtttccctgaagctctggcgagaagtgcactagaatctgttggtggtgatgaaaactcggctcttgaaaagctttgttctggttaa

SEQ ID NO: 2793 - protein, 194 aa, Populus balsamifera subsp. trichocarpa
  misc_feature (1)..(194): Ceres ANNOT ID no. 1468704
  misc_feature (155)..(194): Pfam Name: UBA Pfam Description: UBA/TS-N domain
  misc_feature (6)..(145): Pfam Name: UQ_con Pfam Description: Ubiquitin-conjugating enzyme
  misc_feature: SWISSPROT Homolog: UBC1_BOVIN Ubiquitin-conjugating enzyme E2-25 kDa with e-value of 5.9e-14 and BLAST sequence identity of 42.9
  misc_feature: SWISSPROT Homolog: UBC1_BOVIN EC 6.3.2.19 (Ubiquitin-protein ligase) Ubiquitin carrier protein (E2(25K)) Huntingtin-interacting protein 2 (HIP-2)
  misc_feature: SWISSPROT Homolog: UBC1_HUMAN Ubiquitin-conjugating enzyme E2-25 kDa with e-value of 5.9e-14 and BLAST sequence identity of 42.9
  misc_feature: SWISSPROT Homolog: UBC1_HUMAN EC 6.3.2.19 (Ubiquitin-protein ligase) Ubiquitin carrier protein (E2(25K)) Huntingtin-interacting protein 2 (HIP-2)
  misc_feature: SWISSPROT Homolog: UBC1_MOUSE Ubiquitin-conjugating enzyme E2-25 kDa with e-value of 5.9e-14 and BLAST sequence identity of 42.9
  misc_feature: SWISSPROT Homolog: UBC1_MOUSE EC 6.3.2.19 (Ubiquitin-protein ligase) Ubiquitin carrier protein (E2(25K)) Huntingtin-interacting protein 2 (HIP-2)
  misc_feature: SWISSPROT Homolog: UBCD4_DROME Ubiquitin-conjugating enzyme E2-22 kDa (EC 6.3.2.19) (Ubiquitin-protein ligase) (Ubiquitin carrier protein) with e-value of 4.2e-13 and BLAST sequence identity of 41.9
  misc_feature: SWISSPROT Homolog: COP10_ARATH Constitutive photomorphogenesis protein 10 with e-value of 1.1e-12 and BLAST sequence identity of 48.6
  misc_feature 313207:<222: Transcription Factor
  misc_feature: Phenotype: CAULINE LEAVES - Cup-shaped Useful for making ornamental plants with altered leaf shape
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Other Useful for making ornamental plants with modified flowers
  misc_feature (1)..(194): Functional Homolog of  Ceres CLONE ID no. 267564 at SEQ ID NO. 2836 with e-value of 1.50E-32 and BLAST sequence identity of 80.2
MIDFARVQKELQECSRDMEASGIKVAPKSDNLARLTGTIPGPISSPYEGGTFQIDITLPDGYPFEPPKMQFATKVWHPNISSQSGAICLDILKDQWSPALTLKTALLSVQALLSAPEPDDPQDAVVAQQYLRDRQTFVGTARYWTETFAKTSSLGVEEKVQKLVEMGFPEALARSALESVGGDENSALEKLCSG

SEQ ID NO: 2794 - protein, 244 aa, Arabidopsis thaliana
  misc_feature (1)..(244): Ceres CLONE ID no. 267626
  misc_feature (90)..(160): Pfam Name: RRM_1 Pfam Description: RNA recognition motif. (a.k.a. RRM RBD, or RNP domain)
  misc_feature: Phenotype: WHOLE PLANT - Small Useful for modulating plant size
  misc_feature: Phenotype: WHOLE PLANT - Yellow-Green Viable 2 Useful for making lethal plants for genetic confinement systems
  misc_feature: Phenotype: WHOLE PLANT - Yellow-Green Viable 3 Useful for making lethal plants for genetic confinement systems
  misc_feature: Phenotype: ROSETTE LEAVES - Serrate Margins Useful for making plants with increased biomass and foliage
MSTGLDMSLDDMIAKNRKSRGGAGPARGTGSGSGPGPTRRNNPNRKSTRSAPYQSAKAPESTWGHDMFSDRSEDHRSGRSSAGIETGTKLYISNLDYGVMNEDIKELFAEVGELKRYTVHFDRSGRSKGTAEVVYSRRGDALAAVKKYNDVQLDGKPMKIEIVGTNLQTAAAPSGRPANGNSNGAPWRGGQGRGGQQRGGGRGGGGRGGGGRGRRPGKGPAEKISAEDLDADLDKYHSGDMETN

SEQ ID NO: 2795 - DNA, 738 bp, Populus balsamifera subsp. trichocarpa; identical to SEQ ID NO: 1044
  misc_feature (1)..(738): Ceres ANNOT ID no. 1484074
  misc_feature 313398:<222: Transcription Factor
  misc_feature: Phenotype: WHOLE PLANT - Small Useful for modulating plant size
  misc_feature: Phenotype: WHOLE PLANT - Yellow-Green Viable 2 Useful for making lethal plants for genetic confinement systems
  misc_feature: Phenotype: WHOLE PLANT - Yellow-Green Viable 3 Useful for making lethal plants for genetic confinement systems
  misc_feature: Phenotype: ROSETTE LEAVES - Serrate Margins Useful for making plants with increased biomass and foliage

SEQ ID NO: 2796 - protein, 245 aa, Populus balsamifera subsp. trichocarpa; identical to SEQ ID NO: 1045
  misc_feature (1)..(245): Ceres ANNOT ID no. 1484074
  misc_feature (90)..(160): Pfam Name: RRM_1 Pfam Description: RNA recognition motif. (a.k.a. RRM RBD, or RNP domain)
  misc_feature: SWISSPROT Homolog: THOC4_MOUSE THO complex subunit 4 (Tho4) (RNA and export factor- binding protein 1) (REF1-I) (Ally of AML-1 and LEF-1) with e-value of 3.1e-47 and BLAST sequence identity of 44.3
  misc_feature: SWISSPROT Homolog: THOC4_HUMAN THO complex subunit 4 (Tho4) (Ally of AML-1 and LEF-1) (Transcriptional coactivator Aly/REF) (bZIP-enhancing factor BEF) with e-value of 5.1e-47 and BLAST sequence identity of 43.9
  misc_feature: SWISSPROT Homolog: REFP2_MOUSE RNA and export factor-binding protein 2 with e-value of 1.2e-40 and BLAST sequence identity of 45.0
  misc_feature: SWISSPROT Homolog: MLO3_SCHPO Protein mlo3 with e-value of 3.5e-17 and BLAST sequence identity of 34.2
  misc_feature: SWISSPROT Homolog: TRA2A_MOUSE Transformer-2 protein homolog (TRA-2 alpha) with e-value of 1.0e-16 and BLAST sequence identity of 33.5
  misc_feature 313515:<222: Transcription Factor
  misc_feature: Phenotype: WHOLE PLANT - Small Useful for modulating plant size
  misc_feature: Phenotype: WHOLE PLANT - Yellow-Green Viable 2 Useful for making lethal plants for genetic confinement systems
  misc_feature: Phenotype: WHOLE PLANT - Yellow-Green Viable 3 Useful for making lethal plants for genetic confinement systems
  misc_feature: Phenotype: ROSETTE LEAVES - Serrate Margins Useful for making plants with increased biomass and foliage
  misc_feature (1)..(245): Functional Homolog of  Ceres CLONE ID no. 267626 at SEQ ID NO. 2841 with e-value of 2.89E-66 and BLAST sequence identity of 62.9

SEQ ID NO: 2797 - DNA, 753 bp, Populus balsamifera subsp. trichocarpa; identical to SEQ ID NO: 1048
  misc_feature (1)..(753): Ceres ANNOT ID no. 1518242
  misc_feature 313617:<222: Transcription Factor
  misc_feature: Phenotype: WHOLE PLANT - Small Useful for modulating plant size
  misc_feature: Phenotype: WHOLE PLANT - Yellow-Green Viable 2 Useful for making lethal plants for genetic confinement systems
  misc_feature: Phenotype: WHOLE PLANT - Yellow-Green Viable 3 Useful for making lethal plants for genetic confinement systems
  misc_feature: Phenotype: ROSETTE LEAVES - Serrate Margins Useful for making plants with increased biomass and foliage

SEQ ID NO: 2798 - protein, 250 aa, Populus balsamifera subsp. trichocarpa; identical to SEQ ID NO: 1049
  misc_feature (1)..(250): Ceres ANNOT ID no. 1518242
  misc_feature (87)..(157): Pfam Name: RRM_1 Pfam Description: RNA recognition motif. (a.k.a. RRM RBD, or RNP domain)
  misc_feature: SWISSPROT Homolog: THOC4_MOUSE THO complex subunit 4 (Tho4) (RNA and export factor- binding protein 1) (REF1-I) (Ally of AML-1 and LEF-1) with e-value of 3.1e-47 and BLAST sequence identity of 44.3
  misc_feature: SWISSPROT Homolog: THOC4_HUMAN THO complex subunit 4 (Tho4) (Ally of AML-1 and LEF-1) (Transcriptional coactivator Aly/REF) (bZIP-enhancing factor BEF) with e-value of 5.1e-47 and BLAST sequence identity of 43.9
  misc_feature: SWISSPROT Homolog: REFP2_MOUSE RNA and export factor-binding protein 2 with e-value of 1.2e-40 and BLAST sequence identity of 45.0
  misc_feature: SWISSPROT Homolog: MLO3_SCHPO Protein mlo3 with e-value of 3.5e-17 and BLAST sequence identity of 34.2
  misc_feature: SWISSPROT Homolog: TRA2A_MOUSE Transformer-2 protein homolog (TRA-2 alpha) with e-value of 1.0e-16 and BLAST sequence identity of 33.5
  misc_feature 313734:<222: Transcription Factor
  misc_feature: Phenotype: WHOLE PLANT - Small Useful for modulating plant size
  misc_feature: Phenotype: WHOLE PLANT - Yellow-Green Viable 2 Useful for making lethal plants for genetic confinement systems
  misc_feature: Phenotype: WHOLE PLANT - Yellow-Green Viable 3 Useful for making lethal plants for genetic confinement systems
  misc_feature: Phenotype: ROSETTE LEAVES - Serrate Margins Useful for making plants with increased biomass and foliage
  misc_feature (1)..(250): Functional Homolog of  Ceres CLONE ID no. 267626 at SEQ ID NO. 2841 with e-value of 2.40E-48 and BLAST sequence identity of 50.8

SEQ ID NO: 2799 - DNA, 792 bp, Populus balsamifera subsp. trichocarpa
  misc_feature (1)..(792): Ceres ANNOT ID no. 1464923
  misc_feature 313836:<222: Transcription Factor
  misc_feature: Phenotype: WHOLE PLANT - Small Useful for modulating plant size
  misc_feature: Phenotype: WHOLE PLANT - Yellow-Green Viable 2 Useful for making lethal plants for genetic confinement systems
  misc_feature: Phenotype: WHOLE PLANT - Yellow-Green Viable 3 Useful for making lethal plants for genetic confinement systems
  misc_feature: Phenotype: ROSETTE LEAVES - Serrate Margins Useful for making plants with increased biomass and foliage
atgtccagcttactggatatgtcacttgacgacctcatccgcaagggcaaagaaaatggagggcgtgacagtgatttcagaggcagtggcagaggagcaggctccggttcggttttgggtccgggccccgatcgtttggtcttccgtcgtgacccgacccgacccaaaccctactcagtaagaccagtgcaggtaatgcaagtgcagcaggagccattaatgttagcagcaagtgaagggtctaatggagaggctaagttatatatatcaaacttggattatggtgtttctaatgaggatatcaagggcagtaggcactataattttcatgtgctatacattatggtgcttttctccgaggttggtgaattgttgaggtactcacttcattatgatatgagtgggagatcaaagggaacagctgaagttgtattttcacgccaaacagatgctctagcagctatcaggagatataataatgttcagcttgatgggaagccactgaaaattgagcttgtaggagttaatgtgataacccctgtccctgttaccgtgcctgtaactgcaattaccaatgtggcaaacccaaatggtgctgttagaagtgttcatgaaagaattggtgcaaggggaagaggccatggtggtggtgctggcggcaggggcggtggcagtgttcaagaatttgccaggggccaggggcaggtgagacgccgtgtcgagaagctaactgcagaagcacttgattctgacttggacaaataccactttgaagccatgaaattaaagtga

SEQ ID NO: 2800 - protein, 263 aa, Populus balsamifera subsp. trichocarpa
  misc_feature (1)..(263): Ceres ANNOT ID no. 1464923
  misc_feature (87)..(102): Pfam Name: RRM_1 Pfam Description: RNA recognition motif. (a.k.a. RRM RBD, or RNP domain)
  misc_feature: SWISSPROT Homolog: THOC4_MOUSE THO complex subunit 4 (Tho4) (RNA and export factor- binding protein 1) (REF1-I) (Ally of AML-1 and LEF-1) with e-value of 3.1e-47 and BLAST sequence identity of 44.3
  misc_feature: SWISSPROT Homolog: THOC4_HUMAN THO complex subunit 4 (Tho4) (Ally of AML-1 and LEF-1) (Transcriptional coactivator Aly/REF) (bZIP-enhancing factor BEF) with e-value of 5.1e-47 and BLAST sequence identity of 43.9
  misc_feature: SWISSPROT Homolog: REFP2_MOUSE RNA and export factor-binding protein 2 with e-value of 1.2e-40 and BLAST sequence identity of 45.0
  misc_feature: SWISSPROT Homolog: MLO3_SCHPO Protein mlo3 with e-value of 3.5e-17 and BLAST sequence identity of 34.2
  misc_feature: SWISSPROT Homolog: TRA2A_MOUSE Transformer-2 protein homolog (TRA-2 alpha) with e-value of 1.0e-16 and BLAST sequence identity of 33.5
  misc_feature 313955:<222: Transcription Factor
  misc_feature: Phenotype: WHOLE PLANT - Small Useful for modulating plant size
  misc_feature: Phenotype: WHOLE PLANT - Yellow-Green Viable 2 Useful for making lethal plants for genetic confinement systems
  misc_feature: Phenotype: WHOLE PLANT - Yellow-Green Viable 3 Useful for making lethal plants for genetic confinement systems
  misc_feature: Phenotype: ROSETTE LEAVES - Serrate Margins Useful for making plants with increased biomass and foliage
  misc_feature (1)..(263): Functional Homolog of  Ceres CLONE ID no. 267626 at SEQ ID NO. 2841 with e-value of 7.49E-45 and BLAST sequence identity of 50.8
MSSLLDMSLDDLIRKGKENGGRDSDFRGSGRGAGSGSVLGPGPDRLVFRRDPTRPKPYSVRPVQVMQVQQEPLMLAASEGSNGEAKLYISNLDYGVSNEDIKGSRHYNFHVLYIMVLFSEVGELLRYSLHYDMSGRSKGTAEVVFSRQTDALAAIRRYNNVQLDGKPLKIELVGVNVITPVPVTVPVTAITNVANPNGAVRSVHERIGARGRGHGGGAGGRGGGSVQEFARGQGQVRRRVEKLTAEALDSDLDKYHFEAMKLK

SEQ ID NO: 2801 - protein, 272 aa, Arabidopsis thaliana
  misc_feature (1)..(272): Ceres CLONE ID no. 267657
  misc_feature (33)..(265): Pfam Name: Glyco_hydro_19 Pfam Description: Chitinase class I
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: CAULINE LEAVES - Small Useful for making plants with increased biomass and foliage
  misc_feature: Phenotype: INFLORESCENCE - Weak Useful for making stronger plants
MAQQHSFLLLCFFLSISYLLSSAQTEATSIERLVPRDLYNKIFIHKDNTACPANGFYTYESFVQATRRFPRFGSVGSPVTQRLEVAAFLAQISHETTGGWATAPDGPYAWGLCFKEEVSPQSTYCDSSNTQWPCFPNKTYQGRGPIQLSWNYNYGPAGRALGFDGLRNPETVSNNSVIAFQTALWFWMTPQSPKPSCHDVMIGKYRPTAADLAANRTGGFGLTTNIINGGLECGIPGDGRVNDRIGFFQRYTGLFKVATGPNLDCENQRPYA

SEQ ID NO: 2802 - DNA, 825 bp, Populus balsamifera subsp. trichocarpa
  misc_feature (1)..(825): Ceres ANNOT ID no. 1471473
  misc_feature 314163:<222: Transcription Factor
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: CAULINE LEAVES - Small Useful for making plants with increased biomass and foliage
  misc_feature: Phenotype: INFLORESCENCE - Weak Useful for making stronger plants
atggcatcttctgctcatactttcttgtcattcgttttttacaccatcttcctctcgtttggatcatataaagctgaagctaggagattcaatgacatctcttctcttgttagtaaaggcctctttgattccatattcctacacaaggacaacaacgcatgccctgctaaaggtttttacacgtacaactccttcattcaagcatctagatgttttcctcaatttggcaggacaggtagttccattacgaggaagcgagaagttgcagcttttcttgctcaaatatcccatgagaccacaggtgggtgggctaccgcacccgatggaccatttgcatgggggttatgcttcaaggaagaagtgagtccacagagtaattactgtgactcaagcaacactcaatggccatgctctccgggcaaatcctacaaaggaagaggacctattcaactatcatggaattacaattatggaccagcaggcaaggccctgggatttgatgggcttaacaacccagacatagtgtctaacaattccttaattgccttcaagacagctctttggttttggatgactgagcagaacccaaaaccatcttgccacaacgtcatgatcgggaaatataagccaacagcggctgatgtaatagctaatcggacggccggctacgggttggtgactaacattatcaatggtggtcttgaatgtggaatacctaatgatggacgagtcaatgatcggatcggatattttcagagatatgctacattattcaatgttagcaccgggtctaacttggattgtgaagatcagaaatccttttaa

SEQ ID NO: 2803 - protein, 274 aa, Populus balsamifera subsp. trichocarpa
  misc_feature (1)..(274): Ceres ANNOT ID no. 1471473
  misc_feature (36)..(268): Pfam Name: Glyco_hydro_19 Pfam Description: Chitinase class I
  misc_feature: SWISSPROT Homolog: CHI2_BRANA Endochitinase CH25 precursor (EC 3.2.1.14) with e-value of 1.6e-82 and BLAST sequence identity of 58.8
  misc_feature: SWISSPROT Homolog: CHIB_ARATH Basic endochitinase B precursor (EC 3.2.1.14) (Pathogenesis-related protein 3) (PR-3) (AtChiB) with e-value of 3.5e-80 and BLAST sequence identity of 58.6
  misc_feature: SWISSPROT Homolog: CHIA_SECCE Basic endochitinase A precursor (EC 3.2.1.14) Rye seed chitinase-a (RSC-a) with e-value of 7.3e-80 and BLAST sequence identity of 58.0
  misc_feature: SWISSPROT Homolog: CHI2_TOBAC Endochitinase B precursor (EC 3.2.1.14) (CHN-B) with e-value of 8.3e-79 and BLAST sequence identity of 56.9
  misc_feature: SWISSPROT Homolog: CHIC_SECCE Basic endochitinase C precursor (EC 3.2.1.14) Rye seed chitinase-c (RSC-c) with e-value of 8.3e-79 and BLAST sequence identity of 57.8
  misc_feature 314283:<222: Transcription Factor
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: CAULINE LEAVES - Small Useful for making plants with increased biomass and foliage
  misc_feature: Phenotype: INFLORESCENCE - Weak Useful for making stronger plants
  misc_feature (1)..(274): Functional Homolog of  Ceres CLONE ID no. 267657 at SEQ ID NO. 2848 with e-value of 4.39E-111 and BLAST sequence identity of 73.3
MASSAHTFLSFVFYTIFLSFGSYKAEARRFNDISSLVSKGLFDSIFLHKDNNACPAKGFYTYNSFIQASRCFPQFGRTGSSITRKREVAAFLAQISHETTGGWATAPDGPFAWGLCFKEEVSPQSNYCDSSNTQWPCSPGKSYKGRGPIQLSWNYNYGPAGKALGFDGLNNPDIVSNNSLIAFKTALWFWMTEQNPKPSCHNVMIGKYKPTAADVIANRTAGYGLVTNIINGGLECGIPNDGRVNDRIGYFQRYATLFNVSTGSNLDCEDQKSF

SEQ ID NO: 2804 - DNA, 828 bp, Populus balsamifera subsp. trichocarpa
  misc_feature (1)..(828): Ceres ANNOT ID no. 1444931
  misc_feature 314391:<222: Transcription Factor
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: CAULINE LEAVES - Small Useful for making plants with increased biomass and foliage
  misc_feature: Phenotype: INFLORESCENCE - Weak Useful for making stronger plants
atggcatctcctgcttatactttgttgtcattcactttttacaccatcttcctctcgtctggatcatataaagctgaagcttggagattcaatgacatctcttctcttgttagtaaaggcctctttgattccatatttctacacaaggacaacaacgcatgccctgctaaagatttttacacgtacagctccttcattcaagcatctagatcttttcctcggttcggcaggacaggtagttctataaagaggaagcgagaaattgcagcttttcttgctcagatatcccatgagaccacaggtgggtggcctaccgcacccgatggaccatttgcatggggtttgtgcttcaaggaagaagtgagtccacaaggtaattactgtaactcaagcaacactcgatggccatgctcccctgggaaatcctacaaaggaagagggcctattcaactatcatggaattacaattatggaccagcaggcaaggcattaggatttgatgggcttaacaacccagatatagtgtctaacaactccttaatcgccttcaagacagctctttggttttggatgactaagcagagcccaaaaccatcttgccacaacgtcatgattggaaaatataagccaacagcagctagtgtggcagctaatcggactgccggctacgggttggtgactaacatcatcaacggtggtcttgaatgtggaatacctaacgatgcgcgagttaatgatcggattgggttttttcagagatacgcagcattgtttaatgtaagtactgggcctaacttagattgtgtaaatcagaagccctttacttag

SEQ ID NO: 2805 - protein, 275 aa, Populus balsamifera subsp. trichocarpa
  misc_feature (1)..(275): Ceres ANNOT ID no. 1444931
  misc_feature (36)..(268): Pfam Name: Glyco_hydro_19 Pfam Description: Chitinase class I
  misc_feature: SWISSPROT Homolog: CHI2_BRANA Endochitinase CH25 precursor (EC 3.2.1.14) with e-value of 1.6e-82 and BLAST sequence identity of 58.8
  misc_feature: SWISSPROT Homolog: CHIB_ARATH Basic endochitinase B precursor (EC 3.2.1.14) (Pathogenesis-related protein 3) (PR-3) (AtChiB) with e-value of 3.5e-80 and BLAST sequence identity of 58.6
  misc_feature: SWISSPROT Homolog: CHIA_SECCE Basic endochitinase A precursor (EC 3.2.1.14) Rye seed chitinase-a (RSC-a) with e-value of 7.3e-80 and BLAST sequence identity of 58.0
  misc_feature: SWISSPROT Homolog: CHI2_TOBAC Endochitinase B precursor (EC 3.2.1.14) (CHN-B) with e-value of 8.3e-79 and BLAST sequence identity of 56.9
  misc_feature: SWISSPROT Homolog: CHIC_SECCE Basic endochitinase C precursor (EC 3.2.1.14) Rye seed chitinase-c (RSC-c) with e-value of 8.3e-79 and BLAST sequence identity of 57.8
  misc_feature 314511:<222: Transcription Factor
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: CAULINE LEAVES - Small Useful for making plants with increased biomass and foliage
  misc_feature: Phenotype: INFLORESCENCE - Weak Useful for making stronger plants
  misc_feature (1)..(275): Functional Homolog of  Ceres CLONE ID no. 267657 at SEQ ID NO. 2848 with e-value of 2.79E-109 and BLAST sequence identity of 72.1
MASPAYTLLSFTFYTIFLSSGSYKAEAWRFNDISSLVSKGLFDSIFLHKDNNACPAKDFYTYSSFIQASRSFPRFGRTGSSIKRKREIAAFLAQISHETTGGWPTAPDGPFAWGLCFKEEVSPQGNYCNSSNTRWPCSPGKSYKGRGPIQLSWNYNYGPAGKALGFDGLNNPDIVSNNSLIAFKTALWFWMTKQSPKPSCHNVMIGKYKPTAASVAANRTAGYGLVTNIINGGLECGIPNDARVNDRIGFFQRYAALFNVSTGPNLDCVNQKPFT

SEQ ID NO: 2806 - protein, 76 aa, Arabidopsis thaliana
  misc_feature (1)..(76): Ceres CLONE ID no. 268505
  misc_feature: Phenotype: WHOLE PLANT - Misc. Dwarf Useful for modulating plant size
  misc_feature: Phenotype: WHOLE PLANT - Small Useful for modulating plant size
MGCFSCFDGTQKEQRKEEERQASAGARAKAAEAAQQRKEQFDKSAAGRAAQAQLQQMAKQSANTNKGEPVLKWQMT

SEQ ID NO: 2807 - DNA, 270 bp, Populus balsamifera subsp. trichocarpa
  misc_feature (1)..(270): Ceres ANNOT ID no. 1496682
  misc_feature 314663:<222: Transcription Factor
  misc_feature: Phenotype: WHOLE PLANT - Misc. Dwarf Useful for modulating plant size
  misc_feature: Phenotype: WHOLE PLANT - Small Useful for modulating plant size
atggggctatcgtgcttcgtttgctttgacgggggaagaaagcaacagagaagagaagaagagagactggcctccgcagaagctcgtgctaaagcggctgaagctgcccagaaacggcaagagcaattcgaaaagtctgcagcaggaagagctgcctgcgcacagctacaggggatggcaaagcaatctgcaaactctaacaaaggcgaaccagttctaaagttatataaatcttatatttcaagacgtctgttaatcgaattaatctga

SEQ ID NO: 2808 - protein, 89 aa, Populus balsamifera subsp. trichocarpa
  misc_feature (1)..(89): Ceres ANNOT ID no. 1496682
  misc_feature 314705:<222: Transcription Factor
  misc_feature: Phenotype: WHOLE PLANT - Misc. Dwarf Useful for modulating plant size
  misc_feature: Phenotype: WHOLE PLANT - Small Useful for modulating plant size
  misc_feature (1)..(89): Functional Homolog of  Ceres CLONE ID no. 268505 at SEQ ID NO. 2853 with e-value of 4.89E-25 and BLAST sequence identity of 79.1
MGLSCFVCFDGGRKQQRREEERLASAEARAKAAEAAQKRQEQFEKSAAGRAACAQLQGMAKQSANSNKGEPVLKLYKSYISRRLLIELI

SEQ ID NO: 2809 - DNA, 225 bp, Populus balsamifera subsp. trichocarpa
  misc_feature (1)..(225): Ceres ANNOT ID no. 1443744
  misc_feature 314763:<222: Transcription Factor
  misc_feature: Phenotype: WHOLE PLANT - Misc. Dwarf Useful for modulating plant size
  misc_feature: Phenotype: WHOLE PLANT - Small Useful for modulating plant size
atggggctatcgtgcttcgtttgctttgacgggggaagaaagcaacagagaagagaagaagagagactggcctccgcagaagctcgtgctaaagcggctgaagctgcccagaaacggcaagagcaattcgaaaagtctgcagcaggaagagctgcctgcgcacagctacaggggatggcaaagcaatctgcaaactctaacaaaggcgaaccagttctaaagtag

SEQ ID NO: 2810 - protein, 74 aa, Populus balsamifera subsp. trichocarpa
  misc_feature (1)..(74): Ceres ANNOT ID no. 1443744
  misc_feature 314803:<222: Transcription Factor
  misc_feature: Phenotype: WHOLE PLANT - Misc. Dwarf Useful for modulating plant size
  misc_feature: Phenotype: WHOLE PLANT - Small Useful for modulating plant size
  misc_feature (1)..(74): Functional Homolog of  Ceres CLONE ID no. 268505 at SEQ ID NO. 2853 with e-value of 4.89E-25 and BLAST sequence identity of 79.1
MGLSCFVCFDGGRKQQRREEERLASAEARAKAAEAAQKRQEQFEKSAAGRAACAQLQGMAKQSANSNKGEPVLK

SEQ ID NO: 2811 - protein, 256 aa, Arabidopsis thaliana
  misc_feature (1)..(256): Ceres CLONE ID no. 270875
  misc_feature (29)..(250): Pfam Name: Abhydrolase_1 Pfam Description: alpha/beta hydrolase fold
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
MKHYVLVHGGCHGAWCWYKVKPMLEHSGHRVTVFDLTAHGVNMSRVEDIQTLEDFAKPLLEVLESFGSDDKVVLVAHSLGGIPAALAADMFPSKISVAVFVTSFMPDTTNPPSYVFEKFLGSITEEERMDFELGSYGTDDHPLKTAFLGPNYLKNMYLLSPIEDYELAKMLMRVTPAITSNLTGTKSLTAQGYGSISRVYIVCGEDKGIRVDFQRWMIENSPVKEVMEIKDADHMPMFSKPHELCDRLLKIADKYP

SEQ ID NO: 2812 - DNA, 792 bp, Populus balsamifera subsp. trichocarpa; identical to SEQ ID NO: 996
  misc_feature (1)..(792): Ceres ANNOT ID no. 1457048
  misc_feature 314944:<222: Transcription Factor
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences

SEQ ID NO: 2813 - protein, 263 aa, Populus balsamifera subsp. trichocarpa; identical to SEQ ID NO: 997
  misc_feature (1)..(263): Ceres ANNOT ID no. 1457048
  misc_feature (35)..(257): Pfam Name: Abhydrolase_1 Pfam Description: alpha/beta hydrolase fold
  misc_feature: SWISSPROT Homolog: PNAE_RAUSE Polyneuridine-aldehyde esterase precursor (EC 3.1.1.78) (Polyneuridine aldehyde esterase) with e-value of 1.4e-60 and BLAST sequence identity of 45.1
  misc_feature: SWISSPROT Homolog: PIR7A_ORYSA Putative esterase PIR7A (EC 3.1.-.-) with e-value of 5.0e-49 and BLAST sequence identity of 41.2
  misc_feature: SWISSPROT Homolog: PIR7B_ORYSA Putative esterase PIR7B (EC 3.1.-.-) with e-value of 1.2e-47 and BLAST sequence identity of 40.5
  misc_feature: SWISSPROT Homolog: HNL_HEVBR S-acetone-cyanohydrin lyase with e-value of 4.2e-45 and BLAST sequence identity of 38.6
  misc_feature: SWISSPROT Homolog: HNL_HEVBR EC 4.1.2.39 ((S)-hydroxynitrile lyase) ((S)- hydroxynitrilase) (Oxynitrilase)
  misc_feature: SWISSPROT Homolog: HNL_MANES (S)-acetone-cyanohydrin lyase (EC 4.1.2.39) (( S)-hydroxynitrile lyase) ((S)-hydroxynitrilase) (Oxynitrilase) with e-value of 6.1e-44 and BLAST sequence identity of 37.4
  misc_feature 315057:<222: Transcription Factor
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
  misc_feature (1)..(263): Functional Homolog of  Ceres CLONE ID no. 270875 at SEQ ID NO. 2858 with e-value of 2.59E-65 and BLAST sequence identity of 49.6

SEQ ID NO: 2814 - DNA, 792 bp, Populus balsamifera subsp. trichocarpa; identical to SEQ ID NO: 998
  misc_feature (1)..(792): Ceres ANNOT ID no. 1510252
  misc_feature 315148:<222: Transcription Factor
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences

SEQ ID NO: 2815 - protein, 263 aa, Populus balsamifera subsp. trichocarpa; identical to SEQ ID NO: 999
  misc_feature (1)..(263): Ceres ANNOT ID no. 1510252
  misc_feature (35)..(257): Pfam Name: Abhydrolase_1 Pfam Description: alpha/beta hydrolase fold
  misc_feature: SWISSPROT Homolog: PNAE_RAUSE Polyneuridine-aldehyde esterase precursor (EC 3.1.1.78) (Polyneuridine aldehyde esterase) with e-value of 1.4e-60 and BLAST sequence identity of 45.1
  misc_feature: SWISSPROT Homolog: PIR7A_ORYSA Putative esterase PIR7A (EC 3.1.-.-) with e-value of 5.0e-49 and BLAST sequence identity of 41.2
  misc_feature: SWISSPROT Homolog: PIR7B_ORYSA Putative esterase PIR7B (EC 3.1.-.-) with e-value of 1.2e-47 and BLAST sequence identity of 40.5
  misc_feature: SWISSPROT Homolog: HNL_HEVBR S-acetone-cyanohydrin lyase with e-value of 4.2e-45 and BLAST sequence identity of 38.6
  misc_feature: SWISSPROT Homolog: HNL_HEVBR EC 4.1.2.39 ((S)-hydroxynitrile lyase) ((S)- hydroxynitrilase) (Oxynitrilase)
  misc_feature: SWISSPROT Homolog: HNL_MANES (S)-acetone-cyanohydrin lyase (EC 4.1.2.39) (( S)-hydroxynitrile lyase) ((S)-hydroxynitrilase) (Oxynitrilase) with e-value of 6.1e-44 and BLAST sequence identity of 37.4
  misc_feature 315260:<222: Transcription Factor
  misc_feature: Phenotype: FLOWER - Reduced fertility Useful for sterility, genetic confinement systems
  misc_feature: Phenotype: INFLORESCENCE - Tall Useful for making taller plants and plants with longer inflorescences
  misc_feature (1)..(263): Functional Homolog of  Ceres CLONE ID no. 270875 at SEQ ID NO. 2858 with e-value of 2.40E-64 and BLAST sequence identity of 49.2

SEQ ID NO: 2816 - protein, 92 aa, Arabidopsis thaliana [sequence omitted]

SEQ ID NO: 2817 - DNA, 279 bp, Populus balsamifera subsp. trichocarpa
  misc_feature (1)..(279): Ceres ANNOT ID no. 1485385
  misc_feature: Utility: Cold Germination Useful for making plants with increased tolerance to cold stress
  misc_feature 315409:<222: Transcription Factor
  misc_feature: Phenotype: WHOLE PLANT - Cold Germination Useful for making plants with increased tolerance to cold stress
atgactaagagaactaagaaggccgggattgttggaaaatatggtacccgttatggtgccagtctgcgtaagcagataaaaaagatggaggttagtcagcacagcaagtttttctgtgaattttgtgggaagtatgctgtgaagaggaaggctgttgggatttggggatgcaaggactgtgggaaagtcaaagcaggtggtgcctacacattgaacactgccagtgctgtgacagtgaggagcacaattcgcaggctgagggagcaaactgagagctga

SEQ ID NO: 2818 - protein, 92 aa, Populus balsamifera subsp. trichocarpa
  misc_feature (1)..(92): Ceres ANNOT ID no. 1485385
  misc_feature (2)..(91): Pfam Name: Ribosomal_L37ae Pfam Description: Ribosomal L37ae protein family
  misc_feature: SWISSPROT Homolog: RL37A_BRARA 60S ribosomal protein L37a with e-value of 6.8e-45 and BLAST sequence identity of 98.9
  misc_feature: SWISSPROT Homolog: RL37A_PSEMZ 60S ribosomal protein L37a with e-value of 1.9e-42 and BLAST sequence identity of 90.2
  misc_feature: SWISSPROT Homolog: RL37A_GOSHI 60S ribosomal protein L37a with e-value of 2.4e-42 and BLAST sequence identity of 92.3
  misc_feature: SWISSPROT Homolog: RL37A_ARATH 60S ribosomal protein L37a with e-value of 6.3e-42 and BLAST sequence identity of 91.2
  misc_feature: SWISSPROT Homolog: RL37A_CRYST 60S ribosomal protein L37a with e-value of 5.0e-33 and BLAST sequence identity of 73.3
  misc_feature: Utility: Cold Germination Useful for making plants with increased tolerance to cold stress
  misc_feature 315491:<222: Transcription Factor
  misc_feature: Phenotype: WHOLE PLANT - Cold Germination Useful for making plants with increased tolerance to cold stress
  misc_feature (1)..(92): Functional Homolog of  Ceres CLONE ID no. 271922 at SEQ ID NO. 2863 with e-value of 7.70E-43 and BLAST sequence identity of 92.3
MTKRTKKAGIVGKYGTRYGASLRKQIKKMEVSQHSKFFCEFCGKYAVKRKAVGIWGCKDCGKVKAGGAYTLNTASAVTVRSTIRRLREQTES

SEQ ID NO: 2819 - DNA, 279 bp, Populus balsamifera subsp. trichocarpa
  misc_feature (1)..(279): Ceres ANNOT ID no. 1486234
  misc_feature: Utility: Cold Germination Useful for making plants with increased tolerance to cold stress
  misc_feature 315548:<222: Transcription Factor
  misc_feature: Phenotype: WHOLE PLANT - Cold Germination Useful for making plants with increased tolerance to cold stress
atgaccaagagaaccaagaaggccggtattgttgggaagtatggtacccgttatggtgctagtttgaggaagcagattaagaagatggaggtcagtcagcacagcaagttcttctgtgagttctgcggcaagtatgctgttaagaggaaggctgttggtatctggggttgcaaggattgtggcaaagtgaaagctggaggtgcttacactttgaatactgctagtgccgtgactgtcaggagtaccatccgtaggctgagggagcagaccgagagttaa

SEQ ID NO: 2820 - protein, 92 aa, Populus balsamifera subsp. trichocarpa; identical to SEQ ID NO: 2818
  misc_feature (1)..(92): Ceres ANNOT ID no. 1486234
  misc_feature (2)..(91): Pfam Name: Ribosomal_L37ae Pfam Description: Ribosomal L37ae protein family
  misc_feature: SWISSPROT Homolog: RL37A_BRARA 60S ribosomal protein L37a with e-value of 6.8e-45 and BLAST sequence identity of 98.9
  misc_feature: SWISSPROT Homolog: RL37A_PSEMZ 60S ribosomal protein L37a with e-value of 1.9e-42 and BLAST sequence identity of 90.2
  misc_feature: SWISSPROT Homolog: RL37A_GOSHI 60S ribosomal protein L37a with e-value of 2.4e-42 and BLAST sequence identity of 92.3
  misc_feature: SWISSPROT Homolog: RL37A_ARATH 60S ribosomal protein L37a with e-value of 6.3e-42 and BLAST sequence identity of 91.2
  misc_feature: SWISSPROT Homolog: RL37A_CRYST 60S ribosomal protein L37a with e-value of 5.0e-33 and BLAST sequence identity of 73.3
  misc_feature: Utility: Cold Germination Useful for making plants with increased tolerance to cold stress
  misc_feature 315630:<222: Transcription Factor
  misc_feature: Phenotype: WHOLE PLANT - Cold Germination Useful for making plants with increased tolerance to cold stress
  misc_feature (1)..(92): Functional Homolog of  Ceres CLONE ID no. 271922 at SEQ ID NO. 2863 with e-value of 7.70E-43 and BLAST sequence identity of 92.3

SEQ ID NO: 2821 - protein, 173 aa, Zea mays
  misc_feature (1)..(173): Ceres CLONE ID no. 272716
  misc_feature (1)..(173): Also Known As Ceres CDNA ID no. 23748760
  misc_feature (1)..(173): Also Known As Ceres GEMINI ID 536A11
  misc_feature (22)..(151): Pfam Name: DUF538 Pfam Description: Protein of unknown function, DUF538
  misc_feature 315701:<222: Transcription Factor
  misc_feature: Phenotype: Activates expression of the gene endogenous to the AtDXPR (SEQ ID NO 4143) regalutory region Useful for modulating Terpenoid Biosynthesis
MLAHRLLLLLAVAAASGTAFAKPTAYEALADYDFPPGILPKGVVAYTLDNATGAFTATLDASASGSGSSVCEFSIQGSYSLRYQTKITGKIAPDHLTDLEGVSVKVLFFWLNIVEVTRRGDNLEFSVGIVSADFGIENFLECPTCGCGFDCNNLLMLQKPGAATAKLRLRGAF

SEQ ID NO: 2822 - DNA, 504 bp, Populus balsamifera subsp. trichocarpa
  misc_feature (1)..(504): Ceres ANNOT ID no. 1497642
  misc_feature 315759:<222: Transcription Factor
  misc_feature: Phenotype: Activates expression of the gene endogenous to the AtDXPR (SEQ ID NO 4143) regalutory region Useful for modulating Terpenoid Biosynthesis
atgtctatcaccgccaatttgaccttcttcttcgtactcctatcatcgctcgccatctcatccttcaccgacaatctcccaactacttacgatgtcctctccggatacaacttcccgatcggtattcttccgaaaggagccacaggctacgatctggacaaagccactggcagatttcgcgcctatctgaatggttcgtgcagtttctctttggaaggttcgtatcagcttaagtacaagtccacagtcagtggttacataagcgagaacaggctgacggatttgagcggagtaagtgtgaagattttgtttttttggttagatattgttgaggttgttagaaaaggagatgagcttgaattttctgtcggaattacttctgccagttttgcaattgataatttctacgagtgtccacagtgtgggtgtgggtttaattgcaacaatgttgagcgagcaaccaagcttagatccggctccggcccttttgtttcctctttttag

SEQ ID NO: 2823 - protein, 167 aa, Populus balsamifera subsp. trichocarpa
  misc_feature (1)..(167): Ceres ANNOT ID no. 1497642
  misc_feature (7)..(147): Pfam Name: DUF538 Pfam Description: Protein of unknown function, DUF538
  misc_feature: SWISSPROT Homolog: Y5161_ARATH Protein At5g01610 with e-value of 1.3e-09 and BLAST sequence identity of 29.6
  misc_feature 315815:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(167): Functional Homolog of  Ceres CLONE ID no. 272716 at SEQ ID NO. 2868 with e-value of 2.70E-40 and BLAST sequence identity of 58.9
MSITANLTFFFVLLSSLAISSFTDNLPTTYDVLSGYNFPIGILPKGATGYDLDKATGRFRAYLNGSCSFSLEGSYQLKYKSTVSGYISENRLTDLSGVSVKILFFWLDIVEVVRKGDELEFSVGITSASFAIDNFYECPQCGCGFNCNNVERATKLRSGSGPFVSSF

SEQ ID NO: 2824 - DNA, 522 bp, Populus balsamifera subsp. trichocarpa
  misc_feature (1)..(522): Ceres ANNOT ID no. 1471648
  misc_feature 315881:<222: Transcription Factor
  misc_feature: Phenotype: Activates expression of the gene endogenous to the AtDXPR (SEQ ID NO 4143) regalutory region Useful for modulating Terpenoid Biosynthesis
atgggttcgcctttccgctcaagatccatctctcccatggcttccctctggccaactttcttggttctagctctctcagcatcttcactcgtcaatgcagacgacacatcaacagtatacgaagttctccaggaatacgactttcctatcggtctccttcccgcaggagtaacgagctacgaatttgacaactcaacaggtaagttcacagtccatcttaatggcacttgctcattcaaaatcgattcatatgagctcaagtacaagtccactgttaagggtgtgatagccaaagacaagctctcaaaattaagtgggattcaagtgaaggtgctcttcctgtggcttagcattgttgaagtgactcgtgatgaagatgaactagaattttctgtggggattgcttctgctaattttcctgtgagtaattttgttgagtgccccatttgtggatgtggctttgattgtaaagatgtcgacttgaggaaaggcaggctcagtcgtcgattctcttcttcttag

SEQ ID NO: 2825 - protein, 173 aa, Populus balsamifera subsp. trichocarpa
  misc_feature (1)..(173): Ceres ANNOT ID no. 1471648
  misc_feature (17)..(156): Pfam Name: DUF538 Pfam Description: Protein of unknown function, DUF538
  misc_feature: SWISSPROT Homolog: Y5161_ARATH Protein At5g01610 with e-value of 1.3e-09 and BLAST sequence identity of 29.6
  misc_feature 315937:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(173): Functional Homolog of  Ceres CLONE ID no. 272716 at SEQ ID NO. 2868 with e-value of 4.19E-35 and BLAST sequence identity of 55.7
MGSPFRSRSISPMASLWPTFLVLALSASSLVNADDTSTVYEVLQEYDFPIGLLPAGVTSYEFDNSTGKFTVHLNGTCSFKIDSYELKYKSTVKGVIAKDKLSKLSGIQVKVLFLWLSIVEVTRDEDELEFSVGIASANFPVSNFVECPICGCGFDCKDVDLRKGRLSRRFSSS

SEQ ID NO: 2826 - protein, 319 aa, Zea mays
  misc_feature (1)..(319): Ceres CLONE ID no. 280039
  misc_feature (165)..(244): Pfam Name: C2 Pfam Description: C2 domain
  misc_feature (3)..(119): Pfam Name: ArfGap Pfam Description: Putative GTPase activating protein for Arf
  misc_feature: Utility: PEG Useful for making plants with increased tolerance to drought
  misc_feature: Phenotype: WHOLE PLANT - PEG Useful for making plants with increased tolerance to drought
MMRKLRELLQKSDNRVCADCGAPDPKWASANIGVFICLKCSGVHRSLGTHVSKVLSVTLDQWTDDEINSMIEVGGNSYANAIYEAFLPEGYQKPHPDSSQEERADFIRSKYELQEFLKPSLRLVSSNKGSLEATSTSSRKHKDNTVSLSASFSSEAGMVEFIGILKVKVIRGTKLAVRDLMSSDPYIVLTLGQQKAKTSVSKRNLNPVWNEELKLSVPQQYGPLKLQVFDHDMLSKDDEMGDAEIDLQPMISAATAFGDPDLLADMQIGKWLRSPDNALARDSAVNVVGGKVKQEVSLRLQNVESGEVELELEWIPLNQ

SEQ ID NO: 2827 - DNA, 1110 bp, Populus balsamifera subsp. trichocarpa
  misc_feature (1)..(1110): Ceres ANNOT ID no. 1494544
  misc_feature: Utility: PEG Useful for making plants with increased tolerance to drought
  misc_feature 316109:<222: Transcription Factor
  misc_feature: Phenotype: WHOLE PLANT - PEG Useful for making plants with increased tolerance to drought
atgttgatgcctgctcaggttcgtgggcttgtagcactgctagagggcattctacatgcttcatcatggagttgcttttgccagttgccaagcacaaatcctgggatggctttatgttttctaaaaattgggaaaagcaaagcaatgagccgtttgtcagagcttcagcaggttgcctcaggtaaaagaagattaaaagatctattgctccaaagtgataatcgcttttgtgctgattgtggtgctccggatccaaaatgggcatcagcaaatattggggttttcatatgcttaaaatgctgtggtgtgcacagaagtcttggtacacatatctctaaggttttatccgtgacgttggatgaatggtctgatgatgaaatcgatgccatgattgaagttggaggaaacttgtctgctaattcaatttatgaggcctttttacctgaaggagtttcaaagccagggccaaattccagtaatgaggagcgtacgaggttcatcaggtcaaagtatgagcttcaagaatttttgaaacctagtttgcggatcacatcggggaagacttcctcctcttctctcaagtcaaacttggataacattgagaaattgttacaggatggcatagtagagtttatgggaatattgaaggttaaagttataaaaggtacaaatttagctattagagatatgatgtcaagtgatccctatgtgatcgttgctcttgggaaacagactgctcaaaccaccgtgatgaagagcaacttgaatccagtctggaatgaagaactcatgctatctgttccacaggattttgggcccataaagttgagcgtttttgatcatgacacattttctgccgatgacataatgggggaagcagagattgacatccagccattgatcacatcagcaatggcattcggggatccagaaatgtttggaaatatgcagattggaaaatggctgaaatcaaacgacaacgccctcatagatgatagcatcataaacattgttgacgggaaggtgaaacaggagatctcattgaaactccagaatgttgaatctggggaactacaagtagaactggagtggatgcctcttgaccagtaa

SEQ ID NO: 2828 - protein, 334 aa, Populus balsamifera subsp. trichocarpa
  misc_feature (1)..(334): Ceres ANNOT ID no. 1494544
  misc_feature (180)..(259): Pfam Name: C2 Pfam Description: C2 domain
  misc_feature (27)..(149): Pfam Name: ArfGap Pfam Description: Putative GTPase activating protein for Arf
  misc_feature: SWISSPROT Homolog: CENA1_HUMAN Centaurin-alpha 1 (Putative MAPK-activating protein PM25) with e-value of 3.0e-26 and BLAST sequence identity of 50.4
  misc_feature: SWISSPROT Homolog: CEG1A_DROME Centaurin-gamma 1A with e-value of 2.4e-24 and BLAST sequence identity of 48.1
  misc_feature: SWISSPROT Homolog: CENG1_HUMAN Centaurin-gamma 1 with e-value of 6.0e-24 and BLAST sequence identity of 50.0
  misc_feature: SWISSPROT Homolog: CENB5_HUMAN Centaurin-beta 5 (Cnt-b5) with e-value of 1.0e-23 and BLAST sequence identity of 46.1
  misc_feature: SWISSPROT Homolog: CENB1_HUMAN Centaurin-beta 1 (Cnt-b1) with e-value of 2.6e-23 and BLAST sequence identity of 44.9
  misc_feature: Utility: PEG Useful for making plants with increased tolerance to drought
  misc_feature 316228:<222: Transcription Factor
  misc_feature: Phenotype: WHOLE PLANT - PEG Useful for making plants with increased tolerance to drought
  misc_feature (1)..(334): Functional Homolog of  Ceres CLONE ID no. 280039 at SEQ ID NO. 2873 with e-value of 2.20E-116 and BLAST sequence identity of 70.3
MALCFLKIGKSKAMSRLSELQQVASGKRRLKDLLLQSDNRFCADCGAPDPKWASANIGVFICLKCCGVHRSLGTHISKVLSVTLDEWSDDEIDAMIEVGGNLSANSIYEAFLPEGVSKPGPNSSNEERTRFIRSKYELQEFLKPSLRITSGKTSSSSLKSNLDNIEKLLQDGIVEFMGILKVKVIKGTNLAIRDMMSSDPYVIVALGKQTAQTTVMKSNLNPVWNEELMLSVPQDFGPIKLSVFDHDTFSADDIMGEAEIDIQPLITSAMAFGDPEMFGNMQIGKWLKSNDNALIDDSIINIVDGKVKQEISLKLQNVESGELQVELEWMPLDQ

SEQ ID NO: 2829 - DNA, 1314 bp, Populus balsamifera subsp. trichocarpa
  misc_feature (1)..(1314): Ceres ANNOT ID no. 1437855
  misc_feature: Utility: PEG Useful for making plants with increased tolerance to drought
  misc_feature 316330:<222: Transcription Factor
  misc_feature: Phenotype: WHOLE PLANT - PEG Useful for making plants with increased tolerance to drought
atgcctatcagacacgagaattccgaaggatctgccccttgtccagatgatctcttatgttcgaacaaacaaagttgcagcaacggaaaagatcaactgaaatcttctggatcggcttccagtccagatgatcttttaaatccagaccaacaaagttgcagcagcagaaaagttcagcggaaaccttccggattggctccttgtctaaatgatctcgtacgttcaggcaaacaaagttgcagcagcaggaaagataaacagaaatctcctggtccactaaaaagactggagagattgctaagtcaatcaggaaacaagacttgtgccgattgtggatctccagatccaaaatgggtgtcattaagttatggagtttttatttgtatcaagtgttcaggcgttcatagaagccttggggtacatctatcgaaggttctatcaatcaagctagatgaatggacagatgaacaggtgaacgctctgatagatttgggtggcaatactgctgcaaacaagaaatatgaagcttctatgcccgacgattatagaaaaccaagaccagatgcctctacagaggagcgttatgattttattaggagaaaatatgagctgaaggaattttcgaactgtgatgaacaaatgtccagcccatttccaggttctataagttcattacccactccttcaaataattgtccttcccaagacaagaaacagtatgaaaaacaagcaaccaggcatcgtattgggaatgcatttcgtaacagctggggaagaaaagactccgagcacaagcacacaaaaaagagctactctttggcaggcatggttgaatttattggattaatcaaggttaatgtagtcaaaggaactaacctagctgtccgggatgtgatgactagcgatccatatgtaatcatttccttgggccagcaatcagtgaggacacgcgtcataaagaacaacctgaatccaatctggaatgaaagtctaatgttgtcaattccagaacagattcctcccctgaaagtgcttgtttatgacaaggatacattcacaaccgatgacttcatgggggaggctgagatagacattcaaccacttgttgctgctgctaaagcgtatgagaattcaaccatcaccgagtcaatgcagcttggtaaatggatagcaggccaggaaaacacccttgttaaagatggaattatcacactagtagacggaaaggtaaagcaagaaatcagcctcaagctaaagaatgtagagagaggggtgctggagattgagcttgaatgtgttcctcttacccaatag

SEQ ID NO: 2830 - protein, 437 aa, Populus balsamifera subsp. trichocarpa
  misc_feature (1)..(437): Ceres ANNOT ID no. 1437855
  misc_feature (283)..(362): Pfam Name: C2 Pfam Description: C2 domain
  misc_feature (93)..(215): Pfam Name: ArfGap Pfam Description: Putative GTPase activating protein for Arf
  misc_feature: SWISSPROT Homolog: CENA1_HUMAN Centaurin-alpha 1 (Putative MAPK-activating protein PM25) with e-value of 3.0e-26 and BLAST sequence identity of 50.4
  misc_feature: SWISSPROT Homolog: CEG1A_DROME Centaurin-gamma 1A with e-value of 2.4e-24 and BLAST sequence identity of 48.1
  misc_feature: SWISSPROT Homolog: CENG1_HUMAN Centaurin-gamma 1 with e-value of 6.0e-24 and BLAST sequence identity of 50.0
  misc_feature: SWISSPROT Homolog: CENB5_HUMAN Centaurin-beta 5 (Cnt-b5) with e-value of 1.0e-23 and BLAST sequence identity of 46.1
  misc_feature: SWISSPROT Homolog: CENB1_HUMAN Centaurin-beta 1 (Cnt-b1) with e-value of 2.6e-23 and BLAST sequence identity of 44.9
  misc_feature: Utility: PEG Useful for making plants with increased tolerance to drought
  misc_feature 316455:<222: Transcription Factor
  misc_feature: Phenotype: WHOLE PLANT - PEG Useful for making plants with increased tolerance to drought
  misc_feature (1)..(437): Functional Homolog of  Ceres CLONE ID no. 280039 at SEQ ID NO. 2873 with e-value of 5.39E-90 and BLAST sequence identity of 53.7
MPIRHENSEGSAPCPDDLLCSNKQSCSNGKDQLKSSGSASSPDDLLNPDQQSCSSRKVQRKPSGLAPCLNDLVRSGKQSCSSRKDKQKSPGPLKRLERLLSQSGNKTCADCGSPDPKWVSLSYGVFICIKCSGVHRSLGVHLSKVLSIKLDEWTDEQVNALIDLGGNTAANKKYEASMPDDYRKPRPDASTEERYDFIRRKYELKEFSNCDEQMSSPFPGSISSLPTPSNNCPSQDKKQYEKQATRHRIGNAFRNSWGRKDSEHKHTKKSYSLAGMVEFIGLIKVNVVKGTNLAVRDVMTSDPYVIISLGQQSVRTRVIKNNLNPIWNESLMLSIPEQIPPLKVLVYDKDTFTTDDFMGEAEIDIQPLVAAAKAYENSTITESMQLGKWIAGQENTLVKDGIITLVDGKVKQEISLKLKNVERGVLEIELECVPLTQ

SEQ ID NO: 2831 - DNA, 1533 bp, Populus balsamifera subsp. trichocarpa
  misc_feature (1)..(1533): Ceres ANNOT ID no. 1448245
  misc_feature: Utility: PEG Useful for making plants with increased tolerance to drought
  misc_feature 316578:<222: Transcription Factor
  misc_feature: Phenotype: WHOLE PLANT - PEG Useful for making plants with increased tolerance to drought
atgtgcaagacacgagcaagtgaaagcgcgtgggaccaggatttagttttgtctgaaaaggggattttctttggctatgatgagattatagcagcgattcatgtaatttctgtttccattgtttggaggatggagatgcctatcagtcacaagaattctgaaggtttggttccttgcctacacgatctcttacattcagacgaacagagttgcagcagcagtaaagaggaacaaaaattttctggatcgcctccttgtccagatgatctcttacattcaaacaaacaaagtgacagcagtggaagagatcgacacaaatcttctggttcggcttcttggcttgataatcttttaaattcagatgaacaaagttgcagcagcaaaaaagatcaacggaaacattctggatcggctccttgtctagatgatctcttacattctggcagaagaagttgccgcagcagtagagatccacagaaatcttctggtccacaaaaaagactggagcaattgctaagtcaatcagggaacaagatttgtgctgattgtggatctccagatccaaaatgggtgtcaataagttttggagtttttatttgtatcaagtgttcaggcgttcatagaagcctcggggtgcatctaacgaaggttctatcaatcaaattagatgaatggacagatgaacaagtgaacactctgatagatttgggtggcaatactgctgcaaacaagaaatatgaagcttttattcctgatgattatcaaaaaccaaaatcagatgcctcaatagaggagcgatctgattttattaggagaaaatatgagcagaagcaattttcaaactgtgatggacaaatgtcctgcccatttccgggtcctagaagtacattatcctctagttgttcaagtcattgttcaccccaagataagaaacagtatgaaaaacaagcaaccaggcatcgtattgggaatgcatttcgtaacagctggggaagaaaagacactgagtacaagaacaataaaaagagcaactctttggcagctatggttgaatttgttggattaatcaaggttaatgtagtcaaaggaaccaacctagctgtccgggatgtgttgactagtgacccatatgttgtccttacattgggccagcaatcagtgaggactcgcgtcataaagaacaatttgaatccaatttggaatgaaagtctaatgttgtcaattccagaacagattcctcctctaaaagtgcttgtttacgacaaggataaattcacaactgatgacttcatgggtgaggctgagatagacattcaaccacttgtttctgctgccaaagcttatgagaattcaaccatcaccgagtcgatgcagcttggtaaatggatagcaggccaggataacacccttgttaaagatggcattatctcactagcagacggaaaggtaaaacaagaaatcagtctcaagctaaagaacgttgagagaggggtgctggagattgagcttgaatgtgttcctctcactcaatag

SEQ ID NO: 2832 - protein, 465 aa, Populus balsamifera subsp. trichocarpa
  misc_feature (1)..(465): Ceres ANNOT ID no. 1448245
  misc_feature (120)..(242): Pfam Name: ArfGap Pfam Description: Putative GTPase activating protein for Arf
  misc_feature (311)..(390): Pfam Name: C2 Pfam Description: C2 domain
  misc_feature: SWISSPROT Homolog: CENA1_HUMAN Centaurin-alpha 1 (Putative MAPK-activating protein PM25) with e-value of 3.0e-26 and BLAST sequence identity of 50.4
  misc_feature: SWISSPROT Homolog: CEG1A_DROME Centaurin-gamma 1A with e-value of 2.4e-24 and BLAST sequence identity of 48.1
  misc_feature: SWISSPROT Homolog: CENG1_HUMAN Centaurin-gamma 1 with e-value of 6.0e-24 and BLAST sequence identity of 50.0
  misc_feature: SWISSPROT Homolog: CENB5_HUMAN Centaurin-beta 5 (Cnt-b5) with e-value of 1.0e-23 and BLAST sequence identity of 46.1
  misc_feature: SWISSPROT Homolog: CENB1_HUMAN Centaurin-beta 1 (Cnt-b1) with e-value of 2.6e-23 and BLAST sequence identity of 44.9
  misc_feature: Utility: PEG Useful for making plants with increased tolerance to drought
  misc_feature 316711:<222: Transcription Factor
  misc_feature: Phenotype: WHOLE PLANT - PEG Useful for making plants with increased tolerance to drought
  misc_feature (1)..(465): Functional Homolog of  Ceres CLONE ID no. 280039 at SEQ ID NO. 2873 with e-value of 1.79E-89 and BLAST sequence identity of 54.2
MPISHKNSEGLVPCLHDLLHSDEQSCSSSKEEQKFSGSPPCPDDLLHSNKQSDSSGRDRHKSSGSASWLDNLLNSDEQSCSSKKDQRKHSGSAPCLDDLLHSGRRSCRSSRDPQKSSGPQKRLEQLLSQSGNKICADCGSPDPKWVSISFGVFICIKCSGVHRSLGVHLTKVLSIKLDEWTDEQVNTLIDLGGNTAANKKYEAFIPDDYQKPKSDASIEERSDFIRRKYEQKQFSNCDGQMSCPFPGPRSTLSSSCSSHCSPQDKKQYEKQATRHRIGNAFRNSWGRKDTEYKNNKKSNSLAAMVEFVGLIKVNVVKGTNLAVRDVLTSDPYVVLTLGQQSVRTRVIKNNLNPIWNESLMLSIPEQIPPLKVLVYDKDKFTTDDFMGEAEIDIQPLVSAAKAYENSTITESMQLGKWIAGQDNTLVKDGIISLADGKVKQEISLKLKNVERGVLEIELECVPLTQ

SEQ ID NO: 2833 - protein, 301 aa, Zea mays
  misc_feature (1)..(301): Ceres CLONE ID no. 283597
  misc_feature (1)..(301): Also Known As Ceres CDNA ID no. 23758447
  misc_feature (1)..(301): Also Known As Ceres GEMINI ID 555E3
  misc_feature (135)..(212): Pfam Name: MBD Pfam Description: Methyl-CpG binding domain
  misc_feature (75)..(128): Pfam Name: zf-CW Pfam Description: CW-type Zinc Finger
  misc_feature 316860:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: INFLORESCENCE - Asecondary Branching Useful for making ornamental plants with modified flowers
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: SILIQUES - Other Useful for increasing seed/fruit yield or modifying fruit content
METSKSPQSSKNSHIVVPSDSNGPRFDNDGFSSEAASNQMVVFNSEAGDKEQDELGENRLQKSIITRGISPSIGAFTVQCAKCFKWRLIPTKEKYEEIRERIIEEPFVCKRAREWRPDVTCNDPEDISQDGSRLWAIDKPNIAQPPRGWERQIRIRGEGGTKFADVYYTSPTGRKLRSLVEVDRFLQENPEYGAQGVTLAQFSFQIPRPLRQDYVKKKPKLINPSDEASMIASKSFQPEEVKPIAWAVATKHEGDASEEASLTDEAPTSEVMLARKRKAGSSLSIEPNHLSDELEPKLEDA

SEQ ID NO: 2834 - DNA, 1032 bp, Populus balsamifera subsp. trichocarpa; identical to SEQ ID NO: 1908
  misc_feature (1)..(1032): Ceres ANNOT ID no. 1482074
  misc_feature 316970:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: INFLORESCENCE - Asecondary Branching Useful for making ornamental plants with modified flowers
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: SILIQUES - Other Useful for increasing seed/fruit yield or modifying fruit content

SEQ ID NO: 2835 - protein, 343 aa, Populus balsamifera subsp. trichocarpa; identical to SEQ ID NO: 1909
  misc_feature (1)..(343): Ceres ANNOT ID no. 1482074
  misc_feature (109)..(162): Pfam Name: zf-CW Pfam Description: CW-type Zinc Finger
  misc_feature (169)..(246): Pfam Name: MBD Pfam Description: Methyl-CpG binding domain
  misc_feature 317071:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: INFLORESCENCE - Asecondary Branching Useful for making ornamental plants with modified flowers
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: SILIQUES - Other Useful for increasing seed/fruit yield or modifying fruit content
  misc_feature (1)..(343): Functional Homolog of  Ceres CLONE ID no. 283597 at SEQ ID NO. 2880 with e-value of 4.80E-66 and BLAST sequence identity of 59.2

SEQ ID NO: 2836 - DNA, 987 bp, Populus balsamifera subsp. trichocarpa; identical to SEQ ID NO: 1910
  misc_feature (1)..(987): Ceres ANNOT ID no. 1453923
  misc_feature 317198:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: INFLORESCENCE - Asecondary Branching Useful for making ornamental plants with modified flowers
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: SILIQUES - Other Useful for increasing seed/fruit yield or modifying fruit content

SEQ ID NO: 2837 - protein, 328 aa, Populus balsamifera subsp. trichocarpa; identical to SEQ ID NO: 1911
  misc_feature (1)..(328): Ceres ANNOT ID no. 1453923
  misc_feature (108)..(161): Pfam Name: zf-CW Pfam Description: CW-type Zinc Finger
  misc_feature (168)..(245): Pfam Name: MBD Pfam Description: Methyl-CpG binding domain
  misc_feature 317297:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: INFLORESCENCE - Asecondary Branching Useful for making ornamental plants with modified flowers
  misc_feature: Phenotype: ROSETTE LEAVES - Disorganized Rosette Useful for making plants with increased biomass
  misc_feature: Phenotype: WHOLE PLANT - Small Useful for modulating plant size
  misc_feature: Phenotype: SILIQUES - Other Useful for increasing seed/fruit yield or modifying fruit content
  misc_feature (1)..(328): Functional Homolog of  Ceres CLONE ID no. 283597 at SEQ ID NO. 2880 with e-value of 9.99E-64 and BLAST sequence identity of 57.6

SEQ ID NO: 2838 - protein, 331 aa, Zea mays
  misc_feature (1)..(331): Ceres CLONE ID no. 286402
  misc_feature (1)..(331): Also Known As Ceres CDNA ID no. 23779979
  misc_feature (1)..(331): Also Known As Ceres GEMINI ID 538H2
  misc_feature (24)..(137): Pfam Name: Mov34 Pfam Description: Mov34/MPN/PAD-1 family
  misc_feature 317441:<222: Transcription Factor
  misc_feature: Phenotype: Activates expression of the gene endogenous to the AtATTPS3 (SEQ ID NO 4165) regalutory region Useful for modulating Terpenoid Biosynthesis
MERLQRIFGASGMGQPPTDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKRFDTHSKTNEQTVQEMLNLAIKYNKAVQEEDELPPEKLAIANVGRQGCKKAFGRACVVVRCCWFLCRRCSASVGTASCNLARTCLFVNHQHFVVDHLCSKF

SEQ ID NO: 2839 - DNA, 978 bp, Populus balsamifera subsp. trichocarpa; identical to SEQ ID NO: 2318
  misc_feature (1)..(978): Ceres ANNOT ID no. 1539856
  misc_feature 317529:<222: Transcription Factor
  misc_feature: Phenotype: Activates expression of the gene endogenous to the AtATTPS3 (SEQ ID NO 4165) regalutory region Useful for modulating Terpenoid Biosynthesis

SEQ ID NO: 2840 - protein, 325 aa, Populus balsamifera subsp. trichocarpa
  misc_feature (1)..(325): Ceres ANNOT ID no. 1539856
  misc_feature (26)..(139): Pfam Name: Mov34 Pfam Description: Mov34/MPN/PAD-1 family
  misc_feature: SWISSPROT Homolog: PSDE_ARATH 26S proteasome non-ATPase regulatory subunit 14 (26S proteasome regulatory subunit rpn11) with e-value of 5.0e-136 and BLAST sequence identity of 91.8
  misc_feature: SWISSPROT Homolog: PSDE_HUMAN 26S proteasome non-ATPase regulatory subunit 14 with e-value of 4.5e-119 and BLAST sequence identity of 80.1
  misc_feature: SWISSPROT Homolog: PSDE_HUMAN A 26S proteasome regulatory subunit rpn11) ( A 26S proteasome-associated PAD1 homolog 1)
  misc_feature: SWISSPROT Homolog: PSDE_MOUSE 26S proteasome non-ATPase regulatory subunit 14 (26S proteasome regulatory subunit rpn11) (MAD1) with e-value of 4.5e-119 and BLAST sequence identity of 80.1
  misc_feature: SWISSPROT Homolog: PSDE_DROME 26S proteasome non-ATPase regulatory subunit 14 with e-value of 5.2e-118 and BLAST sequence identity of 77.9
  misc_feature: SWISSPROT Homolog: PSDE_DROME A 26S proteasome regulatory subunit rpn11 ( A 26S proteasome regulatory complex subunit p37B) ( Yippee-interacting protein 5)
  misc_feature: SWISSPROT Homolog: RPN11_SCHPO 26S proteasome regulatory subunit rpn11 (Protein pad1) with e-value of 2.6e-107 and BLAST sequence identity of 73.0
  misc_feature 317649:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(325): Functional Homolog of  Ceres CLONE ID no. 286402 at SEQ ID NO. 2885 with e-value of 3.40E-136 and BLAST sequence identity of 95.0
MERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMIDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLKRFDTHSKTNEQTVQGNAIRMFDCPLNVCSLEMLNLAIKYNKAVQEEDELPPEKLAIANVGRQDAKKHLEEHVSNLMSSNIVQTLGTMLDTVVF

SEQ ID NO: 2841 - DNA, 987 bp, Populus balsamifera subsp. trichocarpa
  misc_feature (1)..(987): Ceres ANNOT ID no. 1486441
  misc_feature 317745:<222: Transcription Factor
  misc_feature: Phenotype: Activates expression of the gene endogenous to the AtATTPS3 (SEQ ID NO 4165) regalutory region Useful for modulating Terpenoid Biosynthesis
atgtcaggtatggagagactgcaaagaatgtttgcaggtgcaggaggtgcgttgggccatccaccaccagattctccaacacttgattcctctgagcaggtctacatctcctctcttgccctcctcaaaatgcttaaacacggcagagctggggtaccgatggaagttatgggtttgatgcttggagagtttgtggatgaatatacagttcgcgttgttgatgtattcgccatgccacaaagtggtactggtgtgagtgttgaagctgttgatcatgtgtttcagactaatatgattgacatgcttaaacagactggaaggccggagatggttgtggggtggtaccattcacatcctggatttggctgttggctttccggtgttgatataaatacccagcagagttttgaagctctgaatcaacgtgctgtggcagtggtcgtggatccaatccagagtgttaaaggaaaggtggtaattgatgccttccgtttgattaacccacaaacaatgatgcttggccaagaaccacggcagacaacttccaatcttgggcatctgaataagccatccattcaagcattgatccatggattgaatagacattattactcaatagccattaattacagaaagaatgaacttgaggaaaagatgcttcttaatcttcacaagaagaaatggacagacggtttgacacttaagcggtttgatactcattcaaaaaccaatgagcagactgttcagggcaatgccattagaatgtttgattgccctttgaatgtttgtagtctggaaatgctgaacttagctattaaatacaacaaggctgtgcaagaggaagatgagctgccacctgaaaagctggcaattgcgaacgtgggaaggcaagatgcgaagaaacaccttgaagaacatgtctcaaacttaatgtcttccaacatagttcagacattgggtactatgctcgacacggttgtgttctag

SEQ ID NO: 2842 - protein, 325 aa, Populus balsamifera subsp. trichocarpa; identical to SEQ ID NO: 2840
  misc_feature (1)..(325): Ceres ANNOT ID no. 1486441
  misc_feature (26)..(139): Pfam Name: Mov34 Pfam Description: Mov34/MPN/PAD-1 family
  misc_feature: SWISSPROT Homolog: PSDE_ARATH 26S proteasome non-ATPase regulatory subunit 14 (26S proteasome regulatory subunit rpn11) with e-value of 5.0e-136 and BLAST sequence identity of 91.8
  misc_feature: SWISSPROT Homolog: PSDE_HUMAN 26S proteasome non-ATPase regulatory subunit 14 with e-value of 4.5e-119 and BLAST sequence identity of 80.1
  misc_feature: SWISSPROT Homolog: PSDE_HUMAN A 26S proteasome regulatory subunit rpn11) ( A 26S proteasome-associated PAD1 homolog 1)
  misc_feature: SWISSPROT Homolog: PSDE_MOUSE 26S proteasome non-ATPase regulatory subunit 14 (26S proteasome regulatory subunit rpn11) (MAD1) with e-value of 4.5e-119 and BLAST sequence identity of 80.1
  misc_feature: SWISSPROT Homolog: PSDE_DROME 26S proteasome non-ATPase regulatory subunit 14 with e-value of 5.2e-118 and BLAST sequence identity of 77.9
  misc_feature: SWISSPROT Homolog: PSDE_DROME A 26S proteasome regulatory subunit rpn11 ( A 26S proteasome regulatory complex subunit p37B) ( Yippee-interacting protein 5)
  misc_feature: SWISSPROT Homolog: RPN11_SCHPO 26S proteasome regulatory subunit rpn11 (Protein pad1) with e-value of 2.6e-107 and BLAST sequence identity of 73.0
  misc_feature 317865:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(325): Functional Homolog of  Ceres CLONE ID no. 286402 at SEQ ID NO. 2885 with e-value of 3.40E-136 and BLAST sequence identity of 95.0

SEQ ID NO: 2843 - DNA, 990 bp, Populus balsamifera subsp. trichocarpa; identical to SEQ ID NO: 2320
  misc_feature (1)..(990): Ceres ANNOT ID no. 1443875
  misc_feature 317961:<222: Transcription Factor
  misc_feature: Phenotype: Activates expression of the gene endogenous to the AtATTPS3 (SEQ ID NO 4165) regalutory region Useful for modulating Terpenoid Biosynthesis

SEQ ID NO: 2844 - protein, 329 aa, Populus balsamifera subsp. trichocarpa
  misc_feature (1)..(329): Ceres ANNOT ID no. 1443875
  misc_feature (26)..(139): Pfam Name: Mov34 Pfam Description: Mov34/MPN/PAD-1 family
  misc_feature: SWISSPROT Homolog: PSDE_ARATH 26S proteasome non-ATPase regulatory subunit 14 (26S proteasome regulatory subunit rpn11) with e-value of 5.0e-136 and BLAST sequence identity of 91.8
  misc_feature: SWISSPROT Homolog: PSDE_HUMAN 26S proteasome non-ATPase regulatory subunit 14 with e-value of 4.5e-119 and BLAST sequence identity of 80.1
  misc_feature: SWISSPROT Homolog: PSDE_HUMAN A 26S proteasome regulatory subunit rpn11) ( A 26S proteasome-associated PAD1 homolog 1)
  misc_feature: SWISSPROT Homolog: PSDE_MOUSE 26S proteasome non-ATPase regulatory subunit 14 (26S proteasome regulatory subunit rpn11) (MAD1) with e-value of 4.5e-119 and BLAST sequence identity of 80.1
  misc_feature: SWISSPROT Homolog: PSDE_DROME 26S proteasome non-ATPase regulatory subunit 14 with e-value of 5.2e-118 and BLAST sequence identity of 77.9
  misc_feature: SWISSPROT Homolog: PSDE_DROME A 26S proteasome regulatory subunit rpn11 ( A 26S proteasome regulatory complex subunit p37B) ( Yippee-interacting protein 5)
  misc_feature: SWISSPROT Homolog: RPN11_SCHPO 26S proteasome regulatory subunit rpn11 (Protein pad1) with e-value of 2.6e-107 and BLAST sequence identity of 73.0
  misc_feature 318081:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(329): Functional Homolog of  Ceres CLONE ID no. 286402 at SEQ ID NO. 2885 with e-value of 1.09E-128 and BLAST sequence identity of 91.4
MERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRIVFHYSSSNIRTIASRETGWGWGSNSDRLAESLEMLSLAIKYNKAVQEEDELPPEKLAIANVGRQDAKKHLEEHVSNLMSSNIVQTLGTMLDTVVF

SEQ ID NO: 2845 - protein, 110 aa, Zea mays
  misc_feature (1)..(110): Ceres CLONE ID no. 288251
  misc_feature (1)..(106): Pfam Name: PHF5 Pfam Description: PHF5-like protein
  misc_feature: Phenotype: SILIQUES - Short Useful for increasing seed/fruit yield or modifying fruit content
MAKHHPDLIMCRKQPGIAIGRLCEKCDGKCVVCDSYVRPCTLVRVCDECNYGSFQGRCVICGGVGISDAYYCKECTQQEKDRDGCPKIVNLGSAKTDLFYERKKYGFKKR

SEQ ID NO: 2846 - DNA, 333 bp, Populus balsamifera subsp. trichocarpa
  misc_feature (1)..(333): Ceres ANNOT ID no. 1493218
  misc_feature 318226:<222: Transcription Factor
  misc_feature: Phenotype: SILIQUES - Short Useful for increasing seed/fruit yield or modifying fruit content
atggcaaagcatcatcctgatttgattatgtgcaggaagcaacctggaattgccattggacgactctgtgaaaaggatgatgggaaatgtgtaatctgcgactcctatgtgcgcccctgcacgcttgtgcgaatctgtgatgagtgcaattatggatccttccaaggtcgatgtgttatttgtggaggagtgggaatctccgatgcttactattgcaaagagtgcacccagttggagaaagatagggatggatgtcccaagatcgtcaatttagggagtgccaagacggatctgttctatgaacgcaagaaatatggttttaagaaaagatga

SEQ ID NO: 2847 - protein, 110 aa, Populus balsamifera subsp. trichocarpa
  misc_feature (1)..(110): Ceres ANNOT ID no. 1493218
  misc_feature (1)..(106): Pfam Name: PHF5 Pfam Description: PHF5-like protein
  misc_feature: SWISSPROT Homolog: PHF5_ARATH Hypothetical protein At1g07170/At2g30000 with e-value of 4.2e-61 and BLAST sequence identity of 98.2
  misc_feature: SWISSPROT Homolog: PHF5A_HUMAN PHD finger-like domain-containing protein 5A with e-value of 2.1e-57 and BLAST sequence identity of 90.9
  misc_feature: SWISSPROT Homolog: PHF5A_HUMAN PHD finger-like domain protein 5A Splicing factor 3B-associated 14 kDa protein (SF3b14b)
  misc_feature: SWISSPROT Homolog: PHF5A_MOUSE PHD finger-like domain protein 5A (Splicing factor 3B-associated 14 kDa protein) (SF3b14b) with e-value of 2.1e-57 and BLAST sequence identity of 90.9
  misc_feature: SWISSPROT Homolog: PHF5A_RAT PHD finger-like domain-containing protein 5A (Splicing factor 3B-associated 14 kDa protein) (SF3b14b) with e-value of 2.1e-57 and BLAST sequence identity of 90.9
  misc_feature: SWISSPROT Homolog: PHF5_DROME Hypothetical protein CG9548 with e-value of 1.7e-55 and BLAST sequence identity of 89.0
  misc_feature 318314:<222: Transcription Factor
  misc_feature: Phenotype: SILIQUES - Short Useful for increasing seed/fruit yield or modifying fruit content
  misc_feature (1)..(110): Functional Homolog of  Ceres CLONE ID no. 288251 at SEQ ID NO. 2892 with e-value of 3.69E-59 and BLAST sequence identity of 96.3
MAKHHPDLIMCRKQPGIAIGRLCEKDDGKCVICDSYVRPCTLVRICDECNYGSFQGRCVICGGVGISDAYYCKECTQLEKDRDGCPKIVNLGSAKTDLFYERKKYGFKKR

SEQ ID NO: 2848 - DNA, 333 bp, Populus balsamifera subsp. trichocarpa
  misc_feature (1)..(333): Ceres ANNOT ID no. 1514617
  misc_feature 318368:<222: Transcription Factor
  misc_feature: Phenotype: SILIQUES - Short Useful for increasing seed/fruit yield or modifying fruit content
atggcaaagcatcatccagatttgattatgtgtcggaagcagccaggaattgccattggaagagtttgtgagaaagatgatgggaaatgtgtcatctgcgactccctggtgcgtccctgcacacttgtgcgaatttgtgatgagtgcaattatggatccttccaaggtcgatgtgttatttgtggaggagtgggaatctctgatgcttactattgcaaagagtgcacacagctggagaaagatagggatggatgtccaaaaatcgttaatttagggagtgcgaagacagatctgttttatgaacgtaagaaatatggttttaagaaaagatga

SEQ ID NO: 2849 - protein, 110 aa, Populus balsamifera subsp. trichocarpa
  misc_feature (1)..(110): Ceres ANNOT ID no. 1514617
  misc_feature (1)..(106): Pfam Name: PHF5 Pfam Description: PHF5-like protein
  misc_feature: SWISSPROT Homolog: PHF5_ARATH Hypothetical protein At1g07170/At2g30000 with e-value of 4.2e-61 and BLAST sequence identity of 98.2
  misc_feature: SWISSPROT Homolog: PHF5A_HUMAN PHD finger-like domain-containing protein 5A with e-value of 2.1e-57 and BLAST sequence identity of 90.9
  misc_feature: SWISSPROT Homolog: PHF5A_HUMAN PHD finger-like domain protein 5A Splicing factor 3B-associated 14 kDa protein (SF3b14b)
  misc_feature: SWISSPROT Homolog: PHF5A_MOUSE PHD finger-like domain protein 5A (Splicing factor 3B-associated 14 kDa protein) (SF3b14b) with e-value of 2.1e-57 and BLAST sequence identity of 90.9
  misc_feature: SWISSPROT Homolog: PHF5A_RAT PHD finger-like domain-containing protein 5A (Splicing factor 3B-associated 14 kDa protein) (SF3b14b) with e-value of 2.1e-57 and BLAST sequence identity of 90.9
  misc_feature: SWISSPROT Homolog: PHF5_DROME Hypothetical protein CG9548 with e-value of 1.7e-55 and BLAST sequence identity of 89.0
  misc_feature 318456:<222: Transcription Factor
  misc_feature: Phenotype: SILIQUES - Short Useful for increasing seed/fruit yield or modifying fruit content
  misc_feature (1)..(110): Functional Homolog of  Ceres CLONE ID no. 288251 at SEQ ID NO. 2892 with e-value of 5.40E-58 and BLAST sequence identity of 94.5
MAKHHPDLIMCRKQPGIAIGRVCEKDDGKCVICDSLVRPCTLVRICDECNYGSFQGRCVICGGVGISDAYYCKECTQLEKDRDGCPKIVNLGSAKTDLFYERKKYGFKKR

SEQ ID NO: 2850 - DNA, 360 bp, Populus balsamifera subsp. trichocarpa
  misc_feature (1)..(360): Ceres ANNOT ID no. 1461345
  misc_feature 318510:<222: Transcription Factor
  misc_feature: Phenotype: SILIQUES - Short Useful for increasing seed/fruit yield or modifying fruit content
atggcaaagcatcatccagatttgattatgtgtcggaagcagccaggaattgccattggaagagtttgtgagaaagatgatgggaaatgtgtcatctgcgactccctggtgcgtccctgcacacttgtgcgaatttgtgatgagtgcaattatggatccttccaaggtcgatgtgttatttgtggaggagtgggaatctctgatgcttactattgcaaagagtgcacacagctggagaaagatagggatggatgtccaaaaatcgttaatttagggagtgcgaagacagatctgttttatgaaccatggtcgttcgttatgtcttcttcaattgctgcaaatcacagtcgaacaggttag

SEQ ID NO: 2851 - protein, 119 aa, Populus balsamifera subsp. trichocarpa
  misc_feature (1)..(119): Ceres ANNOT ID no. 1461345
  misc_feature (1)..(106): Pfam Name: PHF5 Pfam Description: PHF5-like protein
  misc_feature: SWISSPROT Homolog: PHF5_ARATH Hypothetical protein At1g07170/At2g30000 with e-value of 4.2e-61 and BLAST sequence identity of 98.2
  misc_feature: SWISSPROT Homolog: PHF5A_HUMAN PHD finger-like domain-containing protein 5A with e-value of 2.1e-57 and BLAST sequence identity of 90.9
  misc_feature: SWISSPROT Homolog: PHF5A_HUMAN PHD finger-like domain protein 5A Splicing factor 3B-associated 14 kDa protein (SF3b14b)
  misc_feature: SWISSPROT Homolog: PHF5A_MOUSE PHD finger-like domain protein 5A (Splicing factor 3B-associated 14 kDa protein) (SF3b14b) with e-value of 2.1e-57 and BLAST sequence identity of 90.9
  misc_feature: SWISSPROT Homolog: PHF5A_RAT PHD finger-like domain-containing protein 5A (Splicing factor 3B-associated 14 kDa protein) (SF3b14b) with e-value of 2.1e-57 and BLAST sequence identity of 90.9
  misc_feature: SWISSPROT Homolog: PHF5_DROME Hypothetical protein CG9548 with e-value of 1.7e-55 and BLAST sequence identity of 89.0
  misc_feature 318600:<222: Transcription Factor
  misc_feature: Phenotype: SILIQUES - Short Useful for increasing seed/fruit yield or modifying fruit content
  misc_feature (1)..(119): Functional Homolog of  Ceres CLONE ID no. 288251 at SEQ ID NO. 2892 with e-value of 8.40E-53 and BLAST sequence identity of 94.0
MAKHHPDLIMCRKQPGIAIGRVCEKDDGKCVICDSLVRPCTLVRICDECNYGSFQGRCVICGGVGISDAYYCKECTQLEKDRDGCPKIVNLGSAKTDLFYEPWSFVMSSSIAANHSRTG

SEQ ID NO: 2852 - protein, 377 aa, Zea mays
  misc_feature (1)..(377): Ceres CLONE ID no. 292789
  misc_feature (8)..(377): Pfam Name: Actin Pfam Description: Actin
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Other Useful for making ornamental plants with modified leaves
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTTAEREIVRDIKEKLAYVALDYDQELENAKSSSSVEKSYELPDGQVITIGAERFRCPEVLFQPSFIGMEAPGIHETTYNSIMKCDVDIRKDLYGNIVLSGGTTMFPGIADRMSKEITALAPSSMKIKVVAPPERKYSVWIGGSILASLSTFQQMWISKAEYDESGPAIVHRKCF

SEQ ID NO: 2853 - DNA, 1134 bp, Populus balsamifera subsp. trichocarpa; identical to SEQ ID NO: 166
  misc_feature (1)..(1134): Ceres ANNOT ID no. 1442040
  misc_feature 318792:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Other Useful for making ornamental plants with modified leaves

SEQ ID NO: 2854 - protein, 377 aa, Populus balsamifera subsp. trichocarpa; identical to SEQ ID NO: 167
  misc_feature (1)..(377): Ceres ANNOT ID no. 1442040
  misc_feature (8)..(377): Pfam Name: Actin Pfam Description: Actin
  misc_feature: SWISSPROT Homolog: ACT7_ARATH Actin-7 (Actin-2) with e-value of 3.5e-199 and BLAST sequence identity of 97.9
  misc_feature: SWISSPROT Homolog: ACT3_ORYSA Actin-3 with e-value of 1.5e-198 and BLAST sequence identity of 97.1
  misc_feature: SWISSPROT Homolog: ACT2_ORYSA Actin-2 with e-value of 5.1e-198 and BLAST sequence identity of 97.1
  misc_feature: SWISSPROT Homolog: ACT1_ORYSA Actin-1 with e-value of 1.1e-197 and BLAST sequence identity of 96.8
  misc_feature: SWISSPROT Homolog: ACT_GOSHI Actin with e-value of 1.4e-197 and BLAST sequence identity of 96.3
  misc_feature 318932:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(377): Functional Homolog of  Ceres CLONE ID no. 292789 at SEQ ID NO. 2899 with e-value of 5.59E-198 and BLAST sequence identity of 97.0

SEQ ID NO: 2855 - DNA, 1134 bp, Populus balsamifera subsp. trichocarpa; identical to SEQ ID NO: 156
  misc_feature (1)..(1134): Ceres ANNOT ID no. 1482966
  misc_feature 319072:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Other Useful for making ornamental plants with modified leaves

SEQ ID NO: 2856 - protein, 377 aa, Populus balsamifera subsp. trichocarpa; identical to SEQ ID NO: 157
  misc_feature (1)..(377): Ceres ANNOT ID no. 1482966
  misc_feature (8)..(377): Pfam Name: Actin Pfam Description: Actin
  misc_feature: SWISSPROT Homolog: ACT7_ARATH Actin-7 (Actin-2) with e-value of 3.5e-199 and BLAST sequence identity of 97.9
  misc_feature: SWISSPROT Homolog: ACT3_ORYSA Actin-3 with e-value of 1.5e-198 and BLAST sequence identity of 97.1
  misc_feature: SWISSPROT Homolog: ACT2_ORYSA Actin-2 with e-value of 5.1e-198 and BLAST sequence identity of 97.1
  misc_feature: SWISSPROT Homolog: ACT1_ORYSA Actin-1 with e-value of 1.1e-197 and BLAST sequence identity of 96.8
  misc_feature: SWISSPROT Homolog: ACT_GOSHI Actin with e-value of 1.4e-197 and BLAST sequence identity of 96.3
  misc_feature 319212:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(377): Functional Homolog of  Ceres CLONE ID no. 292789 at SEQ ID NO. 2899 with e-value of 5.09E-197 and BLAST sequence identity of 96.8

SEQ ID NO: 2857 - DNA, 1134 bp, Populus balsamifera subsp. trichocarpa; identical to SEQ ID NO: 158
  misc_feature (1)..(1134): Ceres ANNOT ID no. 1454656
  misc_feature 319352:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Other Useful for making ornamental plants with modified leaves

SEQ ID NO: 2858 - protein, 377 aa, Populus balsamifera subsp. trichocarpa; identical to SEQ ID NO: 159
  misc_feature (1)..(377): Ceres ANNOT ID no. 1454656
  misc_feature (8)..(377): Pfam Name: Actin Pfam Description: Actin
  misc_feature: SWISSPROT Homolog: ACT7_ARATH Actin-7 (Actin-2) with e-value of 3.5e-199 and BLAST sequence identity of 97.9
  misc_feature: SWISSPROT Homolog: ACT3_ORYSA Actin-3 with e-value of 1.5e-198 and BLAST sequence identity of 97.1
  misc_feature: SWISSPROT Homolog: ACT2_ORYSA Actin-2 with e-value of 5.1e-198 and BLAST sequence identity of 97.1
  misc_feature: SWISSPROT Homolog: ACT1_ORYSA Actin-1 with e-value of 1.1e-197 and BLAST sequence identity of 96.8
  misc_feature: SWISSPROT Homolog: ACT_GOSHI Actin with e-value of 1.4e-197 and BLAST sequence identity of 96.3
  misc_feature 319492:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(377): Functional Homolog of  Ceres CLONE ID no. 292789 at SEQ ID NO. 2899 with e-value of 1.09E-196 and BLAST sequence identity of 96.2

SEQ ID NO: 2859 - DNA, 1134 bp, Populus balsamifera subsp. trichocarpa; identical to SEQ ID NO: 164
  misc_feature (1)..(1134): Ceres ANNOT ID no. 1458103
  misc_feature 319632:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Other Useful for making ornamental plants with modified leaves

SEQ ID NO: 2860 - protein, 377 aa, Populus balsamifera subsp. trichocarpa; identical to SEQ ID NO: 165
  misc_feature (1)..(377): Ceres ANNOT ID no. 1458103
  misc_feature (8)..(377): Pfam Name: Actin Pfam Description: Actin
  misc_feature: SWISSPROT Homolog: ACT7_ARATH Actin-7 (Actin-2) with e-value of 3.5e-199 and BLAST sequence identity of 97.9
  misc_feature: SWISSPROT Homolog: ACT3_ORYSA Actin-3 with e-value of 1.5e-198 and BLAST sequence identity of 97.1
  misc_feature: SWISSPROT Homolog: ACT2_ORYSA Actin-2 with e-value of 5.1e-198 and BLAST sequence identity of 97.1
  misc_feature: SWISSPROT Homolog: ACT1_ORYSA Actin-1 with e-value of 1.1e-197 and BLAST sequence identity of 96.8
  misc_feature: SWISSPROT Homolog: ACT_GOSHI Actin with e-value of 1.4e-197 and BLAST sequence identity of 96.3
  misc_feature 319772:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(377): Functional Homolog of  Ceres CLONE ID no. 292789 at SEQ ID NO. 2899 with e-value of 2.19E-196 and BLAST sequence identity of 96.0

SEQ ID NO: 2861 - DNA, 1134 bp, Populus balsamifera subsp. trichocarpa; identical to SEQ ID NO: 162
  misc_feature (1)..(1134): Ceres ANNOT ID no. 1464899
  misc_feature 319912:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Other Useful for making ornamental plants with modified leaves

SEQ ID NO: 2862 - protein, 377 aa, Populus balsamifera subsp. trichocarpa; identical to SEQ ID NO: 163
  misc_feature (1)..(377): Ceres ANNOT ID no. 1464899
  misc_feature (8)..(377): Pfam Name: Actin Pfam Description: Actin
  misc_feature: SWISSPROT Homolog: ACT7_ARATH Actin-7 (Actin-2) with e-value of 3.5e-199 and BLAST sequence identity of 97.9
  misc_feature: SWISSPROT Homolog: ACT3_ORYSA Actin-3 with e-value of 1.5e-198 and BLAST sequence identity of 97.1
  misc_feature: SWISSPROT Homolog: ACT2_ORYSA Actin-2 with e-value of 5.1e-198 and BLAST sequence identity of 97.1
  misc_feature: SWISSPROT Homolog: ACT1_ORYSA Actin-1 with e-value of 1.1e-197 and BLAST sequence identity of 96.8
  misc_feature: SWISSPROT Homolog: ACT_GOSHI Actin with e-value of 1.4e-197 and BLAST sequence identity of 96.3
  misc_feature 320052:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(377): Functional Homolog of  Ceres CLONE ID no. 292789 at SEQ ID NO. 2899 with e-value of 5.79E-196 and BLAST sequence identity of 95.7

SEQ ID NO: 2863 - DNA, 1212 bp, Populus balsamifera subsp. trichocarpa
  misc_feature (1)..(1212): Ceres ANNOT ID no. 1474837
  misc_feature 320192:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atggcagagagtgaggatattcagcctcttgtttgcgacaatggtaccggaatggtcaaggctgggtttgctggggatgatgcaccaagggctgtttttccaagcatcgtgggtcgcccacgccacactggagtgatggttggcatgggtcaaaaagatgcctatgttggcgatgaggctcaatcaaagagaggtattttgactttgaaatacccaattgagcatggtatcgttagcaactgggatgatatggagaagatttggcatcacaccttctacaatgagctccgtgtggctcctgaagagcatccagttctccttacagaagctcctcttaaccccaaggccaatcgtgagaaaatgacccagatcatgtttgagaccttcaacactcctgcaatgtatgtcgctatccaggctgtcctttccctctatgccagtggtcgtacaactgataacttctcaaacctcaatgtttctagtttggatcatgatcatgaaaaccaaagaactgtctttgacaagcatgtaggtattgttctggactctggagatggtgtgagtcacacggttcccatctatgaaggctatgccctcccacatgccattctgcgtcttgacctggcaggtcgtgatctcactgatgccctcatgaaaatcttgactgagcgtggctactctttcacaaccacagcagagcgtgaaattgtaagggacatgaaggaaaaactagcctacattgctcttgattatgaacaagagctagagacagcaaagaccagctcatctgttgagaagagctatgagctgccagatgggcaggttatcactattggagctgaacgtttccgttgtcctgaagtcctcttccaaccatccatgataggaatggaagctgcgggcatacatgaaacaacatacaattctatcatgaagtgtgatgtcgatattaggaaggatctctatggcaatattgtcctcagtggtggttctaccatgttcccaggcattgcggataggatgagcaaggaaattacagcattagctcccagtagcatgaagattaaggtggttgcaccacctgaaaggaagtacagtgtctggataggaggttccattttggcatccctcagcaccttccagcagatgtggattgcaaaggctgagtatgatgagtctgggccatcaattgtccacaggaagtgcttttaa

SEQ ID NO: 2864 - protein, 403 aa, Populus balsamifera subsp. trichocarpa
  misc_feature (1)..(403): Ceres ANNOT ID no. 1474837
  misc_feature (8)..(151): Pfam Name: Actin Pfam Description: Actin
  misc_feature: SWISSPROT Homolog: ACT7_ARATH Actin-7 (Actin-2) with e-value of 3.5e-199 and BLAST sequence identity of 97.9
  misc_feature: SWISSPROT Homolog: ACT3_ORYSA Actin-3 with e-value of 1.5e-198 and BLAST sequence identity of 97.1
  misc_feature: SWISSPROT Homolog: ACT2_ORYSA Actin-2 with e-value of 5.1e-198 and BLAST sequence identity of 97.1
  misc_feature: SWISSPROT Homolog: ACT1_ORYSA Actin-1 with e-value of 1.1e-197 and BLAST sequence identity of 96.8
  misc_feature: SWISSPROT Homolog: ACT_GOSHI Actin with e-value of 1.4e-197 and BLAST sequence identity of 96.3
  misc_feature 320336:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(403): Functional Homolog of  Ceres CLONE ID no. 292789 at SEQ ID NO. 2899 with e-value of 1.90E-190 and BLAST sequence identity of 96.2
MAESEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTDNFSNLNVSSLDHDHENQRTVFDKHVGIVLDSGDGVSHTVPIYEGYALPHAILRLDLAGRDLTDALMKILTERGYSFTTTAEREIVRDMKEKLAYIALDYEQELETAKTSSSVEKSYELPDGQVITIGAERFRCPEVLFQPSMIGMEAAGIHETTYNSIMKCDVDIRKDLYGNIVLSGGSTMFPGIADRMSKEITALAPSSMKIKVVAPPERKYSVWIGGSILASLSTFQQMWIAKAEYDESGPSIVHRKCF

SEQ ID NO: 2865 - DNA, 1104 bp, Populus balsamifera subsp. trichocarpa; identical to SEQ ID NO: 168
  misc_feature (1)..(1104): Ceres ANNOT ID no. 1520449
  misc_feature 320482:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Other Useful for making ornamental plants with modified leaves

SEQ ID NO: 2866 - protein, 367 aa, Populus balsamifera subsp. trichocarpa; identical to SEQ ID NO: 169
  misc_feature (1)..(367): Ceres ANNOT ID no. 1520449
  misc_feature (8)..(367): Pfam Name: Actin Pfam Description: Actin
  misc_feature: SWISSPROT Homolog: ACT7_ARATH Actin-7 (Actin-2) with e-value of 3.5e-199 and BLAST sequence identity of 97.9
  misc_feature: SWISSPROT Homolog: ACT3_ORYSA Actin-3 with e-value of 1.5e-198 and BLAST sequence identity of 97.1
  misc_feature: SWISSPROT Homolog: ACT2_ORYSA Actin-2 with e-value of 5.1e-198 and BLAST sequence identity of 97.1
  misc_feature: SWISSPROT Homolog: ACT1_ORYSA Actin-1 with e-value of 1.1e-197 and BLAST sequence identity of 96.8
  misc_feature: SWISSPROT Homolog: ACT_GOSHI Actin with e-value of 1.4e-197 and BLAST sequence identity of 96.3
  misc_feature 320622:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(367): Functional Homolog of  Ceres CLONE ID no. 292789 at SEQ ID NO. 2899 with e-value of 7.50E-187 and BLAST sequence identity of 95.6

SEQ ID NO: 2867 - DNA, 1035 bp, Populus balsamifera subsp. trichocarpa
  misc_feature (1)..(1035): Ceres ANNOT ID no. 1538169
  misc_feature 320759:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atggatttcttagacagcaggccaattgtctgcgacaatggatcaggcttaatgaaggctggttttgccggtgatgatgttccatgtgtggtattccccaatttaataggccgaccacgaaacaagcatgcaatggtcagcatgggacaaaaggatatgtattttggagacgaagcagaagcaaggcgtggagttcttagtttaagctaccccatacatcatggaattgtgagatgctgggaaggaattgaaagcgtttgggagcatacctttgatcaggagctccgagtttccacagaggagcatcctgttcttttaacagaggctccactcaatcccaaaattaacagagaaaagatggtggagatcatgtttgaaggttttaacattcctgcaacctatatagccatccaggcggttttatcgttgtatgccagtggccgaactacaggaaaggacattacggactccctcaccaaaatcctagctgaagacggctacattttcacctctacagctgagaaagaaattgctagagacatcaaagagcgaatttcctacgtggcaatggattttgaaagagagcttgaaacatcaaggaaaagtgcagcactagacaaacaatatgaattgccggatggacaagtcataaccattggagctgcgcagttcaagtgcccggaagttctgtttgatccgagtagagtaggaatggattcaggtggtgtgcatgagattgtggtgaggtcaatcagcaggtgcgatgtagacatcagaagagagatgtttgggaatgtggtgcttagtgggggtaccactgtgataccaggcctcgctgaaaggttggccaaagaggtcagctcattggcgccgcctggtgtgagggtacgagtggttgctccaccagagaggaagtacagtgtttggattggtggctccatcttgggttccttaagcacctttcagcagatgtggatatccaaggaggagtatatggagtctggatcttccattgtgcacatgaaatgtttctga

SEQ ID NO: 2868 - protein, 344 aa, Populus balsamifera subsp. trichocarpa
  misc_feature (1)..(344): Ceres ANNOT ID no. 1538169
  misc_feature (7)..(151): Pfam Name: Actin Pfam Description: Actin
  misc_feature: SWISSPROT Homolog: ACT7_ARATH Actin-7 (Actin-2) with e-value of 3.5e-199 and BLAST sequence identity of 97.9
  misc_feature: SWISSPROT Homolog: ACT3_ORYSA Actin-3 with e-value of 1.5e-198 and BLAST sequence identity of 97.1
  misc_feature: SWISSPROT Homolog: ACT2_ORYSA Actin-2 with e-value of 5.1e-198 and BLAST sequence identity of 97.1
  misc_feature: SWISSPROT Homolog: ACT1_ORYSA Actin-1 with e-value of 1.1e-197 and BLAST sequence identity of 96.8
  misc_feature: SWISSPROT Homolog: ACT_GOSHI Actin with e-value of 1.4e-197 and BLAST sequence identity of 96.3
  misc_feature 320897:<222: Transcription Factor
  misc_feature: Phenotype: ROSETTE LEAVES - Disorganized Rosette Useful for making plants with increased biomass
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(344): Functional Homolog of  Ceres CLONE ID no. 292789 at SEQ ID NO. 2899 with e-value of 1.99E-124 and BLAST sequence identity of 67.0
MDFLDSRPIVCDNGSGLMKAGFAGDDVPCVVFPNLIGRPRNKHAMVSMGQKDMYFGDEAEARRGVLSLSYPIHHGIVRCWEGIESVWEHTFDQELRVSTEEHPVLLTEAPLNPKINREKMVEIMFEGFNIPATYIAIQAVLSLYASGRTTGKDITDSLTKILAEDGYIFTSTAEKEIARDIKERISYVAMDFERELETSRKSAALDKQYELPDGQVITIGAAQFKCPEVLFDPSRVGMDSGGVHEIVVRSISRCDVDIRREMFGNVVLSGGTTVIPGLAERLAKEVSSLAPPGVRVRVVAPPERKYSVWIGGSILGSLSTFQQMWISKEEYMESGSSIVHMKCF

SEQ ID NO: 2869 - protein, 228 aa, Zea mays
  misc_feature (1)..(228): Ceres CLONE ID no. 297374
  misc_feature (1)..(228): Also Known As Ceres CDNA ID no. 23746932
  misc_feature (1)..(228): Also Known As Ceres GEMINI ID 531D10
  misc_feature (107)..(172): Pfam Name: K-box Pfam Description: K-box region
  misc_feature (9)..(59): Pfam Name: SRF-TF Pfam Description: SRF-type transcription factor DNA-binding and dimerisation domain)
  misc_feature 321058:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
MARERREIKRIESAAARQVTFSKRRRGLFKKAQELSVLCDADVALIVFSSTGKLSQFASSSMNEIIDKYNTHSKNLGKTEQPSLDLNLEHSKYANLNEQLAEASLRLRQMRGEELEGLNVEELQQLEKNLESGLHRVLQTKDQQFLEQINDLERKSTQLAEENMQLRNQVSQIPPAGKQAVADTENVIAEEGQSSESVMTALHSGSSQDNDDGSDVSLKLGLPCVAWK

SEQ ID NO: 2870 - DNA, 732 bp, Populus balsamifera subsp. trichocarpa; identical to SEQ ID NO: 2726
  misc_feature (1)..(732): Ceres ANNOT ID no. 1510619
  misc_feature 321143:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis

SEQ ID NO: 2871 - protein, 243 aa, Populus balsamifera subsp. trichocarpa; identical to SEQ ID NO: 2727
  misc_feature (1)..(243): Ceres ANNOT ID no. 1510619
  misc_feature (107)..(173): Pfam Name: K-box Pfam Description: K-box region
  misc_feature (9)..(59): Pfam Name: SRF-TF Pfam Description: SRF-type transcription factor DNA-binding and dimerisation domain)
  misc_feature: SWISSPROT Homolog: MAD22_ORYSA MADS-box transcription factor 22 (OsMADS22) with e-value of 4.2e-100 and BLAST sequence identity of 88.3
  misc_feature: SWISSPROT Homolog: MAD47_ORYSA MADS-box transcription factor 47 (OsMADS47) with e-value of 2.3e-60 and BLAST sequence identity of 59.6
  misc_feature: SWISSPROT Homolog: SVP_ARATH SHORT VEGETATIVE PHASE protein with e-value of 2.1e-59 and BLAST sequence identity of 54.4
  misc_feature: SWISSPROT Homolog: JOIN_LYCES MADS-box JOINTLESS protein (LeMADS) with e-value of 3.5e-57 and BLAST sequence identity of 54.2
  misc_feature: SWISSPROT Homolog: MAD55_ORYSA MADS-box transcription factor 55 (OsMADS55) with e-value of 4.8e-51 and BLAST sequence identity of 76.8
  misc_feature 321261:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(243): Functional Homolog of  Ceres CLONE ID no. 297374 at SEQ ID NO. 2916 with e-value of 9.19E-63 and BLAST sequence identity of 59.9

SEQ ID NO: 2872 - DNA, 669 bp, Populus balsamifera subsp. trichocarpa
  misc_feature (1)..(669): Ceres ANNOT ID no. 1496506
  misc_feature 321357:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
atggctagagagaagatcaagatcaagaagattgacaacgtgactgcaagacaagtaaccttctccaagaggaggcgagggcttttcaagaaagctgaagagctttctgttctttgtgatgctgaggttgctgtcatcatcttctctgctaccggcaagctctttgagtattccagctccagtatgaaggatgtgcttgcaaggtataatctgcactccaataacctcgacaaaataaatccgccgtctcttgagttgcagctagaaaacagcaatcacatgcgattgagcaaggaagtttccgagaagagtcatcagctaaggcggatgagaggtgaagatcttcacggactaaatatagaagaattgcagcaattggagaaggcgcttgaagtaggacttagccgcgtgcttgaaaccaagggagaacgaattatgaatgagatatctacccttgaaaggaagggagtacagcttttggaagagaataagcaactaaaacagaagatcgcaaccatttacaagggaaaaggacccgcccttgtcgatttagacacagcagttcaggaagaagggatgtcatcggagtctacaaccaatgtttgcagctgcagcagtggccctcctgtggaggatgatagctccgatacctctctcaaattagggtga

SEQ ID NO: 2873 - protein, 222 aa, Populus balsamifera subsp. trichocarpa
  misc_feature (1)..(222): Ceres ANNOT ID no. 1496506
  misc_feature (106)..(172): Pfam Name: K-box Pfam Description: K-box region
  misc_feature (9)..(59): Pfam Name: SRF-TF Pfam Description: SRF-type transcription factor DNA-binding and dimerisation domain)
  misc_feature: SWISSPROT Homolog: MAD22_ORYSA MADS-box transcription factor 22 (OsMADS22) with e-value of 4.2e-100 and BLAST sequence identity of 88.3
  misc_feature: SWISSPROT Homolog: MAD47_ORYSA MADS-box transcription factor 47 (OsMADS47) with e-value of 2.3e-60 and BLAST sequence identity of 59.6
  misc_feature: SWISSPROT Homolog: SVP_ARATH SHORT VEGETATIVE PHASE protein with e-value of 2.1e-59 and BLAST sequence identity of 54.4
  misc_feature: SWISSPROT Homolog: JOIN_LYCES MADS-box JOINTLESS protein (LeMADS) with e-value of 3.5e-57 and BLAST sequence identity of 54.2
  misc_feature: SWISSPROT Homolog: MAD55_ORYSA MADS-box transcription factor 55 (OsMADS55) with e-value of 4.8e-51 and BLAST sequence identity of 76.8
  misc_feature: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(222): Functional Homolog of  Ceres CLONE ID no. 297374 at SEQ ID NO. 2916 with e-value of 4.69E-59 and BLAST sequence identity of 54.7
MAREKIKIKKIDNVTARQVTFSKRRRGLFKKAEELSVLCDAEVAVIIFSATGKLFEYSSSSMKDVLARYNLHSNNLDKINPPSLELQLENSNHMRLSKEVSEKSHQLRRMRGEDLHGLNIEELQQLEKALEVGLSRVLETKGERIMNEISTLERKGVQLLEENKQLKQKIATIYKGKGPALVDLDTAVQEEGMSSESTTNVCSCSSGPPVEDDSSDTSLKLG

SEQ ID NO: 2874 - protein, 434 aa, Zea mays
  misc_feature (1)..(434): Ceres CLONE ID no. 299144
  misc_feature (38)..(104): Pfam Name: dsrm Pfam Description: Double-stranded RNA binding motif
  misc_feature: Utility: PEG Useful for making plants with increased tolerance to drought
  misc_feature: Phenotype: WHOLE PLANT - PEG Useful for making plants with increased tolerance to drought
MHGGGAASPDAAICISPEAGPIVGVAPAGIRVENCYVFKSRLQEYAQRVGIPTPEYHTLKEGPSHEPVFKSTVFVNNTKYESLPGFFSRKAAEQSAAEVALMEIAMSAPVTEIRNMPAVQETGLCKNLLQEYAQKMNYAIPSYICTKQASGVAPFVCSVEIGGILYIGAAARTKKEAEIKAARTALLAIQSQSEGGANGAKKYIVVPGQRPDKEANKNPTETPIPLRVKKRGSRKKWNKRKFRRMADRIVDAGKDAEGLGTLVHDDYEEARRIGYELPTDTAMVQFNKEVVMTQPGEGDRIVQLEPPRDPAEFQYNKEARSVEQDPPRDPAEVQHNKEARSVEQDPPRDPAEVQHNKEARTVEQDPPSNTEVWKPDNKATTTEQESVSAYIALRSNGDSTDVEAAPGDTLMMQGEESEATMQEASHAGEQAQPN

SEQ ID NO: 2875 - DNA, 1068 bp, Populus balsamifera subsp. trichocarpa
  misc_feature (1)..(1068): Ceres ANNOT ID no. 1443651
  misc_feature: Utility: PEG Useful for making plants with increased tolerance to drought
  misc_feature 321687:<222: Transcription Factor
  misc_feature: Phenotype: WHOLE PLANT - PEG Useful for making plants with increased tolerance to drought
  misc_feature 321699:<222: Transcription Factor
  misc_feature (788)..(788): n is a, c, t, g, unknown, or other
  misc_feature 321709:<222: Transcription Factor
  misc_feature (789)..(789): n is a, c, t, g, unknown, or other
  misc_feature 321719:<222: Transcription Factor
  misc_feature (857)..(857): n is a, c, t, g, unknown, or other
atgctcaccaacgaaggattctcaggtgtatcgaattgctatgtgttcaagagtcgattgcaggagtatgcacaaaaggctggcttgcctactcctgtatatgagacaatcaaagaaggcccttcccatgagccatccttcaggtccacagtgattgtgaaggatgttagatatgattctttacctggttttttcaatcgaaaggcggcagagcaatcggctgctgaggttgctcttgtggagttggctaaagctggtgaaattaatgaatccacttctcaacctgttaatgaaacaggattgtgcaagaatctacttcaggagtatgctcaaaagatgaattatgcaattccattatatgagtgccaaaaggatgaaacacctggaagaggacttgtttttaaatgcaccgttgagattggggggattcggtatattggagcatcaactaaaacaaaaaaggaagcagagatcaaagctgctagaactgccttgttagcaatccaatcgagtggatctgataaacaaagtggcagctctcaattaacggtaattccttgcagaaagaggggagttgaggctagttttcaagaggaggcggaaaatgttcccaagccaaagaaggctcggtttaaaaagaaaatgttgaaaaagaaactctctagggacaggataaacaatgctcaaagtgaactcactgaaaaattgaatatagtaaatggtcaatcaggatcagaagcagaccaaacagataaatctgccatccgaggagcaaattgcaaactttnnacaatggaaacacaaatgactttccaggatgggaagtcagacaccaacttgaatgggggagaaacatntgatattgaaggggttttgacttcctatgatgctggtaatcctgaaagtgtgcagttggcatctccaaattttaatcaaagcaatcatgggactggtgctgaaatatcagccaaatctaatgcaggcacaggtaaggttactggaattatagaggtggcttcaatggcaaacaattctgtcctcgctcagataggggcttcgaacgcttaa

SEQ ID NO: 2876 - protein, 355 aa, Populus balsamifera subsp. trichocarpa
  misc_feature (1)..(355): Ceres ANNOT ID no. 1443651
  misc_feature (102)..(168): Pfam Name: dsrm Pfam Description: Double-stranded RNA binding motif
  misc_feature: Utility: PEG Useful for making plants with increased tolerance to drought
  misc_feature 321790:<222: Transcription Factor
  misc_feature: Phenotype: WHOLE PLANT - PEG Useful for making plants with increased tolerance to drought
  misc_feature (1)..(355): Functional Homolog of  Ceres CLONE ID no. 299144 at SEQ ID NO. 2921 with e-value of 2.09E-63 and BLAST sequence identity of 61.1
MLTNEGFSGVSNCYVFKSRLQEYAQKAGLPTPVYETIKEGPSHEPSFRSTVIVKDVRYDSLPGFFNRKAAEQSAAEVALVELAKAGEINESTSQPVNETGLCKNLLQEYAQKMNYAIPLYECQKDETPGRGLVFKCTVEIGGIRYIGASTKTKKEAEIKAARTALLAIQSSGSDKQSGSSQLTVIPCRKRGVEASFQEEAENVPKPKKARFKKKMLKKKLSRDRINNAQSELTEKLNIVNGQSGSEADQTDKSAIRGANCKLXTMETQMTFQDGKSDTNLNGGETXDIEGVLTSYDAGNPESVQLASPNFNQSNHGTGAEISAKSNAGTGKVTGIIEVASMANNSVLAQIGASNA

SEQ ID NO: 2877 - protein, 298 aa, Zea mays
  misc_feature (1)..(298): Ceres CLONE ID no. 304523
  misc_feature (1)..(298): Also Known As Ceres CDNA ID no. 23761786
  misc_feature (1)..(298): Also Known As Ceres GEMINI ID 538C4
  misc_feature (193)..(218): Pfam Name: TPR_4 Pfam Description: Tetratricopeptide repeat
  misc_feature 321912:<222: Transcription Factor
  misc_feature: Phenotype: Activates expression of the gene endogenous to the AtDXPR (SEQ ID NO 4143) regalutory region Useful for modulating Terpenoid Biosynthesis
MASSKRRFGAAGGADKKDLFHVVHKVPAGDSPYVVAKHLQLVEKQPDVAIVWFWKAINSGDRVDSALKDMAMVMKQQDRSEEAIEAIRSFRHLCSKQAQESLDNLLIDLYKKCGKVEEQIELLKQKLKSIYLGEAFNGKATKKARSHGKKFQVSIQQETSRILGNLGWAYMQQNNFEAAELVYRKAQAIEPDANRACNLGLCLIKQGRHEEARQALEDVRLRRIYGSEDAKVVARAEQLLRELNPLQCVSSPFQVGLSVHEGIMGEPDLVVMNEWTPFRSRRLPVFEEIATFRDQMAC

SEQ ID NO: 2878 - DNA, 930 bp, Populus balsamifera subsp. trichocarpa
  misc_feature (1)..(930): Ceres ANNOT ID no. 1445647
  misc_feature 321994:<222: Transcription Factor
  misc_feature: Phenotype: Activates expression of the gene endogenous to the AtDXPR (SEQ ID NO 4143) regalutory region Useful for modulating Terpenoid Biosynthesis
atggaagcagcagcagcagcagcagcagcagcaggaagctcaagaaagtgcagtgctaatggtggtaaaaaagagaaggatctgttccatgttattcacaaggttcctgctggtgatggcccttatgttaaagccaagcatgctcagctggtacaaaaagacccagaagcagccatagtttggttctggaaggcgataaatgcaggagacaaagtggatagtgctctgaaggacatggcagttgtcatgaagcaaatagacagaactgaagaagccattgaagctgtcaagtctttcagaggccgttgctcaaagcaagcccaggaatcacttgataacgttcttattgacttgtataagaaatgtgggaaagtagaggagcagatagagttgataaaaaggaagctaagactaatataccaaggagaggcattcaatggcaaacccacaaaaactgcacgctcccatggaaagaagttccaagtttctgttaagcaagagacctccaggttgctgggaaacttaggatgggcctatatgcaaaagccgaacttcatagcagccgaggtagtgtatcagaaagcccagatgattgacccagatgctaacaaggcctgtaacttagccctctgcttgatcaagcaagctcgatacgacgaggctcgttctgttctcctcgatgtctcacagggaagacttcccggttccggtgacgttaagtcaagatcacgggccgaggaattgttgatggaagtgaaatcaagggagacccccgatgagttaacggatatgctgggctttaatcttgatgaggatgatgattttgtgaaagggctagagaaattgatgagtgaatgggccccatctagatccaaaaggcttccaatctttgaagaaatctcttcatttagggacccgttgacttgttaa

SEQ ID NO: 2879 - protein, 309 aa, Populus balsamifera subsp. trichocarpa
  misc_feature (1)..(309): Ceres ANNOT ID no. 1445647
  misc_feature (169)..(202): Pfam Name: TPR_1 Pfam Description: Tetratricopeptide repeat
  misc_feature 322057:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(309): Functional Homolog of  Ceres CLONE ID no. 304523 at SEQ ID NO. 2924 with e-value of 1.19E-101 and BLAST sequence identity of 67.1
MEAAAAAAAAAGSSRKCSANGGKKEKDLFHVIHKVPAGDGPYVKAKHAQLVQKDPEAAIVWFWKAINAGDKVDSALKDMAVVMKQIDRTEEAIEAVKSFRGRCSKQAQESLDNVLIDLYKKCGKVEEQIELIKRKLRLIYQGEAFNGKPTKTARSHGKKFQVSVKQETSRLLGNLGWAYMQKPNFIAAEVVYQKAQMIDPDANKACNLALCLIKQARYDEARSVLLDVSQGRLPGSGDVKSRSRAEELLMEVKSRETPDELTDMLGFNLDEDDDFVKGLEKLMSEWAPSRSKRLPIFEEISSFRDPLTC

SEQ ID NO: 2880 - DNA, 876 bp, Populus balsamifera subsp. trichocarpa
  misc_feature (1)..(876): Ceres ANNOT ID no. 1448043
  misc_feature 322150:<222: Transcription Factor
  misc_feature: Phenotype: Activates expression of the gene endogenous to the AtDXPR (SEQ ID NO 4143) regalutory region Useful for modulating Terpenoid Biosynthesis
atgagcagtcaaagaaacggatcagaagcagctccatatcatgtccttcataaacttcctcctggtgatagtccttatgttagagccaagcatgttcagctagttgagaaggatcctggagcagcaatagctttgttttggaaggcgataaatgctggagatagagtggatagtgctctcaaagacatggcagtggttatgaaacagcaagacagggcagaggaggcaattgaagctataaaggcttttagagatcgctgttcaaagcaagcccaagaatctctagataatgtcctcattgacttgtacaagaaatgtggaaacattgaggagcagatagagctattgaaacagaagctccggatgattcaccaaggagaggccttcaatgggaaggctaccaagactgcacgctctcatggaagaaagttccaggttactgtcaaacaagagacttctcggatactgggaaacttgggttgggcatacatgcagaaaggaaactatttggcagcggaagttgtataccgcaaagctcagtctattgacccagatgccaacaaggcctgcaacttgggcttatgcttaatcaagcaaacacgatatgctgaggcacaagcagtcctcgatgacatattccggggtaagcttttaggatctgatgagccaaaatcaagaaaccgtgcccaggagctgctctgtgaactagagacaagccaatcctcttcgatgttctcggaaccatcaggatcaagcttagaggatgtttttgtggagggccttgatcagttgacgagtcaatggactccatacagatcgaggagactgcccatatttgaagagatctcatcatttagagatcagttagcttgttga

SEQ ID NO: 2881 - protein, 291 aa, Populus balsamifera subsp. trichocarpa
  misc_feature (1)..(291): Ceres ANNOT ID no. 1448043
  misc_feature (153)..(186): Pfam Name: TPR_1 Pfam Description: Tetratricopeptide repeat
  misc_feature (57)..(90): Pfam Name: TPR_2 Pfam Description: Tetratricopeptide repeat
  misc_feature 322217:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(291): Functional Homolog of  Ceres CLONE ID no. 304523 at SEQ ID NO. 2924 with e-value of 9.89E-98 and BLAST sequence identity of 68.2
MSSQRNGSEAAPYHVLHKLPPGDSPYVRAKHVQLVEKDPGAAIALFWKAINAGDRVDSALKDMAVVMKQQDRAEEAIEAIKAFRDRCSKQAQESLDNVLIDLYKKCGNIEEQIELLKQKLRMIHQGEAFNGKATKTARSHGRKFQVTVKQETSRILGNLGWAYMQKGNYLAAEVVYRKAQSIDPDANKACNLGLCLIKQTRYAEAQAVLDDIFRGKLLGSDEPKSRNRAQELLCELETSQSSSMFSEPSGSSLEDVFVEGLDQLTSQWTPYRSRRLPIFEEISSFRDQLAC

SEQ ID NO: 2882 - DNA, 879 bp, Populus balsamifera subsp. trichocarpa
  misc_feature (1)..(879): Ceres ANNOT ID no. 1438053
  misc_feature 322307:<222: Transcription Factor
  misc_feature: Phenotype: Activates expression of the gene endogenous to the AtDXPR (SEQ ID NO 4143) regalutory region Useful for modulating Terpenoid Biosynthesis
atgacccgtcaaagaaaagaatcagaagctccatatcatcatgtaattcataaacttcctcctcctggggatagcccttatgttagagccaagcatgctcagctagttgagaaggatcctgaagcagcaatagctttgttttggaaggcgataaatgccggagacagggtcgatagtgctctcaaagacatggcagtggttatgaaacagcaagacagggcagaggaagctattgaagctgtgaaggcctttagagaccgctgctcgaagcaagcccaagaatctctagataacgtcctcattgacttgtacaagaaatgtggaaaaattgaggagcagatagatctactgaaacagaaacttaagatgattcaccaaggagaggccttcaacaggaaggctaccaagacagcgcggtcacacgggaggaagttccaggttactgtcaaacaagagactagtcggatactgggaaacttgggttgggcatatatgcagcgaggaaactatatggcagcagaagctgtataccacaaagctcagtcttttgatcctgatgctaacaaggcctgcaacttgtgcttgtgcttaatcaagcaaacacgatatgctgaggcaaaatcagttatcgatgacatattgcagggtaagcttttaggatctgatgagcccaagtcaagaaaccgcgcccaggagctgctacgtgaactagagacatgccaatcctcatcgatgttttcagaaccatcaggattaagtttagaagatgcttttgttgagggtcttgaccagttgatgagtcaatggactccatatagatcaagaagactgcccatatttgaagagatctcgccattcatggatcagttagcctgttga

SEQ ID NO: 2883 - protein, 292 aa, Populus balsamifera subsp. trichocarpa
  misc_feature (1)..(292): Ceres ANNOT ID no. 1438053
  misc_feature (154)..(187): Pfam Name: TPR_2 Pfam Description: Tetratricopeptide repeat
  misc_feature (32)..(51): Pfam Name: TPR_1 Pfam Description: Tetratricopeptide repeat
  misc_feature 322374:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(292): Functional Homolog of  Ceres CLONE ID no. 304523 at SEQ ID NO. 2924 with e-value of 4.89E-96 and BLAST sequence identity of 67.3
MTRQRKESEAPYHHVIHKLPPPGDSPYVRAKHAQLVEKDPEAAIALFWKAINAGDRVDSALKDMAVVMKQQDRAEEAIEAVKAFRDRCSKQAQESLDNVLIDLYKKCGKIEEQIDLLKQKLKMIHQGEAFNRKATKTARSHGRKFQVTVKQETSRILGNLGWAYMQRGNYMAAEAVYHKAQSFDPDANKACNLCLCLIKQTRYAEAKSVIDDILQGKLLGSDEPKSRNRAQELLRELETCQSSSMFSEPSGLSLEDAFVEGLDQLMSQWTPYRSRRLPIFEEISPFMDQLAC

SEQ ID NO: 2884 - protein, 228 aa, Zea mays
  misc_feature (1)..(228): Ceres CLONE ID no. 304574
  misc_feature (113)..(208): Pfam Name: Ribosomal_L7Ae Pfam Description: Ribosomal protein L7Ae/L30e/S12e/Gadd45 family
  misc_feature: Phenotype: ROSETTE LEAVES - Curled 3 Useful for making ornamental plants with altered leaf shape
  misc_feature: Phenotype: INFLORESCENCE - Short Useful for modulating plant height
  misc_feature: Phenotype: CAULINE LEAVES - Ovate Shaped Useful for making plants with increased biomass and foliage
  misc_feature: Phenotype: CAULINE LEAVES - Serrate Margins Useful for making plants with increased biomass and foliage
MAPKRGGRAPVPAKKKTDKVTNPLFEKRPKQFGIGGALPPKKDLHRFVKWPKVVRIQRQRRILKQRLKVPPALNQFTRTLDKNLATNLFKMLLKYRPEDKAAKKERLLKRAQAENEGKTVESKKPIVVKYGLNHVTYLIEQNKAQLVVIAHDVDPIELVVWLPALCRKMEVPYCIVKGKARLGSIVHKKNASVLCLTTVKNEDKLEFSKILEAIKANFNDKFDEVRKK

SEQ ID NO: 2885 - DNA, 777 bp, Populus balsamifera subsp. trichocarpa
  misc_feature (1)..(777): Ceres ANNOT ID no. 1481465
  misc_feature 322558:<222: Transcription Factor
  misc_feature: Phenotype: ROSETTE LEAVES - Curled 3 Useful for making ornamental plants with altered leaf shape
  misc_feature: Phenotype: INFLORESCENCE - Short Useful for modulating plant height
  misc_feature: Phenotype: CAULINE LEAVES - Ovate Shaped Useful for making plants with increased biomass and foliage
  misc_feature: Phenotype: CAULINE LEAVES - Serrate Margins Useful for making plants with increased biomass and foliage
atggctcccaaaagaggtgtgaaggccccgctagcagcaaagaaaaaacctgaaaaggttgtgaatcctttgtttgagaagcgaccaaagcagtttggaattggtggtgcccttccacccaagaaggatttgactagatttgtaaagtggccacatgttgttcgtattcagaggcaaagaaggattctgaaacagcgtttgaaggtccctcctgctgttaaccagttcacaaaaacccttgacaagaaccttgccacacaactttttaagttgttgctaaaatatagacctgaggacaaggctgctaagaaggaaaggcttcttaaaagagcacaagctgctgaagaggggaagactgtggaatcaaagaagcctattgtcgttaaatatggtcttaaccatgttacttacctcattgagcagaacaaggcccagttggtggtcatcgcacatgatgtggatccaattgagcttgttgtctggttgccagcattgtgccggaaaatggaggttccttatgcaatcgtgaagggcaagtcacgtcttggagcgattgtccacaagaaaacagcatcagttttgtgccttacatcagtgaagaacgaggataaattagaatttagcaaggttttggaggcagtcaaggctaacttcaacgacaaatttgacgagcacagaaagaaatggggtggtggcatcatgggttccaaatctctggctaagaccaaagctaaggagagagtcttagccaaggaggctgcacagagaatgtcatga

SEQ ID NO: 2886 - protein, 258 aa, Populus balsamifera subsp. trichocarpa
  misc_feature (1)..(258): Ceres ANNOT ID no. 1481465
  misc_feature (113)..(208): Pfam Name: Ribosomal_L7Ae Pfam Description: Ribosomal protein L7Ae/L30e/S12e/Gadd45 family
  misc_feature: SWISSPROT Homolog: RL7A_ORYSA 60S ribosomal protein L7a with e-value of 9.7e-117 and BLAST sequence identity of 97.8
  misc_feature: SWISSPROT Homolog: RL7A_ARATH 60S ribosomal protein L7a with e-value of 2.5e-102 and BLAST sequence identity of 85.2
  misc_feature: SWISSPROT Homolog: RL7A_HUMAN 60S ribosomal protein L7a (Surfeit locus protein 3) (PLA-X polypeptide) with e-value of 1.8e-69 and BLAST sequence identity of 60.5
  misc_feature: SWISSPROT Homolog: RL7A_MOUSE 60S ribosomal protein L7a (Surfeit locus protein 3) with e-value of 1.8e-69 and BLAST sequence identity of 60.5
  misc_feature: SWISSPROT Homolog: RL7A_RAT 60S ribosomal protein L7a with e-value of 1.8e-69 and BLAST sequence identity of 60.5
  misc_feature 322673:<222: Transcription Factor
  misc_feature: Phenotype: ROSETTE LEAVES - Curled 3 Useful for making ornamental plants with altered leaf shape
  misc_feature: Phenotype: INFLORESCENCE - Short Useful for modulating plant height
  misc_feature: Phenotype: CAULINE LEAVES - Ovate Shaped Useful for making plants with increased biomass and foliage
  misc_feature: Phenotype: CAULINE LEAVES - Serrate Margins Useful for making plants with increased biomass and foliage
  misc_feature (1)..(258): Functional Homolog of  Ceres CLONE ID no. 304574 at SEQ ID NO. 2931 with e-value of 2.29E-107 and BLAST sequence identity of 89.9
MAPKRGVKAPLAAKKKPEKVVNPLFEKRPKQFGIGGALPPKKDLTRFVKWPHVVRIQRQRRILKQRLKVPPAVNQFTKTLDKNLATQLFKLLLKYRPEDKAAKKERLLKRAQAAEEGKTVESKKPIVVKYGLNHVTYLIEQNKAQLVVIAHDVDPIELVVWLPALCRKMEVPYAIVKGKSRLGAIVHKKTASVLCLTSVKNEDKLEFSKVLEAVKANFNDKFDEHRKKWGGGIMGSKSLAKTKAKERVLAKEAAQRMS

SEQ ID NO: 2887 - DNA, 777 bp, Populus balsamifera subsp. trichocarpa
  misc_feature (1)..(777): Ceres ANNOT ID no. 1482095
  misc_feature 322778:<222: Transcription Factor
  misc_feature: Phenotype: ROSETTE LEAVES - Curled 3 Useful for making ornamental plants with altered leaf shape
  misc_feature: Phenotype: INFLORESCENCE - Short Useful for modulating plant height
  misc_feature: Phenotype: CAULINE LEAVES - Ovate Shaped Useful for making plants with increased biomass and foliage
  misc_feature: Phenotype: CAULINE LEAVES - Serrate Margins Useful for making plants with increased biomass and foliage
atggctcccaaaagaggtgtgaagggcccactggcagcaaagaagaaacctgaaaaggtagtgaaccctttgtttgaaaaacgtccaaagcagtttggaattggtggtgcacttccaccaaagaaggatttgactagatttgtcaagtggccacatgttgttcgtattcagaggcaaagaaggattctgaaacagcgtttgaaggtccctcctgctgttaaccagttcacaaaaacacttgacaagaacctcgctacgcaacttttcaagttgttcctaaaatatagacctgaggacaaggctgctaagaaggaaaggcttcttaagagagcacaagctgaagctgaggggaagactgtggaaacaaagaagcctattgttattaaatatggtcttaaccatgttacttacctcattgagcagaacaaggcccagctggtcgttattgcacatgatgtagatccaattgagcttgttgtttggttgcctgcattgtgccggaaaatggaggttccttatgccattgtgaagggcaagtcacgacttggagcgattgtccacaagaaaacagcttcagttttgtgccttacttctgtcaagaatgaggacaaattggaatttagcaaggttttggaggcagtcaaggctaacttcaacgacaagtttgatgagcaccgcaagaaatggggtggtggcatcatgggttccaaatctctggccaagagcaaagctaaggagagagttttagccaaggaggctgcgcaaaggatgtcttga

SEQ ID NO: 2888 - protein, 258 aa, Populus balsamifera subsp. trichocarpa
  misc_feature (1)..(258): Ceres ANNOT ID no. 1482095
  misc_feature (113)..(208): Pfam Name: Ribosomal_L7Ae Pfam Description: Ribosomal protein L7Ae/L30e/S12e/Gadd45 family
  misc_feature: SWISSPROT Homolog: RL7A_ORYSA 60S ribosomal protein L7a with e-value of 9.7e-117 and BLAST sequence identity of 97.8
  misc_feature: SWISSPROT Homolog: RL7A_ARATH 60S ribosomal protein L7a with e-value of 2.5e-102 and BLAST sequence identity of 85.2
  misc_feature: SWISSPROT Homolog: RL7A_HUMAN 60S ribosomal protein L7a (Surfeit locus protein 3) (PLA-X polypeptide) with e-value of 1.8e-69 and BLAST sequence identity of 60.5
  misc_feature: SWISSPROT Homolog: RL7A_MOUSE 60S ribosomal protein L7a (Surfeit locus protein 3) with e-value of 1.8e-69 and BLAST sequence identity of 60.5
  misc_feature: SWISSPROT Homolog: RL7A_RAT 60S ribosomal protein L7a with e-value of 1.8e-69 and BLAST sequence identity of 60.5
  misc_feature 322893:<222: Transcription Factor
  misc_feature: Phenotype: ROSETTE LEAVES - Curled 3 Useful for making ornamental plants with altered leaf shape
  misc_feature: Phenotype: INFLORESCENCE - Short Useful for modulating plant height
  misc_feature: Phenotype: CAULINE LEAVES - Ovate Shaped Useful for making plants with increased biomass and foliage
  misc_feature: Phenotype: CAULINE LEAVES - Serrate Margins Useful for making plants with increased biomass and foliage
  misc_feature (1)..(258): Functional Homolog of  Ceres CLONE ID no. 304574 at SEQ ID NO. 2931 with e-value of 1.60E-106 and BLAST sequence identity of 88.5
MAPKRGVKGPLAAKKKPEKVVNPLFEKRPKQFGIGGALPPKKDLTRFVKWPHVVRIQRQRRILKQRLKVPPAVNQFTKTLDKNLATQLFKLFLKYRPEDKAAKKERLLKRAQAEAEGKTVETKKPIVIKYGLNHVTYLIEQNKAQLVVIAHDVDPIELVVWLPALCRKMEVPYAIVKGKSRLGAIVHKKTASVLCLTSVKNEDKLEFSKVLEAVKANFNDKFDEHRKKWGGGIMGSKSLAKSKAKERVLAKEAAQRMS

SEQ ID NO: 2889 - DNA, 873 bp, Populus balsamifera subsp. trichocarpa
  misc_feature (1)..(873): Ceres ANNOT ID no. 1482093
  misc_feature 322998:<222: Transcription Factor
  misc_feature: Phenotype: ROSETTE LEAVES - Curled 3 Useful for making ornamental plants with altered leaf shape
  misc_feature: Phenotype: INFLORESCENCE - Short Useful for modulating plant height
  misc_feature: Phenotype: CAULINE LEAVES - Ovate Shaped Useful for making plants with increased biomass and foliage
  misc_feature: Phenotype: CAULINE LEAVES - Serrate Margins Useful for making plants with increased biomass and foliage
atgtctattggcttaccatcgcaaccaatgcagagctgtagaagtttcaagatgggactgctccagacaaagaatataatctgttgcatgatcaataatgctcccaaaagaggtgtgaaggccccgttagcagcaaagaagaagccagaaaaggtcgtaaaccctttgtttgagaaacgaccaaagcagtttggaattggtggtgcccttccacccaagaaggatttgactagatttgtcaagtggccacatgttgttcgtattcagaggcaaagaaggattctgaaacagcgtttgaaggttcctcctgctgttaaccagttcacaaaaacacttgacaagaaccttgctacacaacttttcaagttgttcctaaaatatagacctgaggacaaggctgctaagaaggaaaggcttcttaagagagcacaagctgaagctgaggggaagactgtggaaacaaagaagcctattgttattaaatatggtcttaaccatgttacttacctcattgagcagaacaaggcccagctggtggttatcgcacatgatgttgatccaattgagcttgttgtttggttgcctgcattgtgccggaaaatggaggttccttatgcaatcgtgaagggcaagtcacgtcttggagcgattgtccacaagaaaacagcatcagttttgtgccttacatcagtgaagaatgaggataaattggaatttagcaaggttttggaggcagtcaaggctaacttcaatgataagtttgatgagcaccgaaagaaatggggcggtggcatcatgggttccaaatctctggctaagaccaaagctaaggagagagtcatagccaaggaggctgcccaaagaatgtcttga

SEQ ID NO: 2890 - protein, 273 aa, Populus balsamifera subsp. trichocarpa
  misc_feature (1)..(273): Ceres ANNOT ID no. 1482093
  misc_feature (128)..(223): Pfam Name: Ribosomal_L7Ae Pfam Description: Ribosomal protein L7Ae/L30e/S12e/Gadd45 family
  misc_feature: SWISSPROT Homolog: RL7A_ORYSA 60S ribosomal protein L7a with e-value of 9.7e-117 and BLAST sequence identity of 97.8
  misc_feature: SWISSPROT Homolog: RL7A_ARATH 60S ribosomal protein L7a with e-value of 2.5e-102 and BLAST sequence identity of 85.2
  misc_feature: SWISSPROT Homolog: RL7A_HUMAN 60S ribosomal protein L7a (Surfeit locus protein 3) (PLA-X polypeptide) with e-value of 1.8e-69 and BLAST sequence identity of 60.5
  misc_feature: SWISSPROT Homolog: RL7A_MOUSE 60S ribosomal protein L7a (Surfeit locus protein 3) with e-value of 1.8e-69 and BLAST sequence identity of 60.5
  misc_feature: SWISSPROT Homolog: RL7A_RAT 60S ribosomal protein L7a with e-value of 1.8e-69 and BLAST sequence identity of 60.5
  misc_feature 323117:<222: Transcription Factor
  misc_feature: Phenotype: ROSETTE LEAVES - Curled 3 Useful for making ornamental plants with altered leaf shape
  misc_feature: Phenotype: INFLORESCENCE - Short Useful for modulating plant height
  misc_feature: Phenotype: CAULINE LEAVES - Ovate Shaped Useful for making plants with increased biomass and foliage
  misc_feature: Phenotype: CAULINE LEAVES - Serrate Margins Useful for making plants with increased biomass and foliage
  misc_feature (1)..(273): Functional Homolog of  Ceres CLONE ID no. 304574 at SEQ ID NO. 2931 with e-value of 1.99E-106 and BLAST sequence identity of 88.9
MGLLQTKNIICCMINNAPKRGVKAPLAAKKKPEKVVNPLFEKRPKQFGIGGALPPKKDLTRFVKWPHVVRIQRQRRILKQRLKVPPAVNQFTKTLDKNLATQLFKLFLKYRPEDKAAKKERLLKRAQAEAEGKTVETKKPIVIKYGLNHVTYLIEQNKAQLVVIAHDVDPIELVVWLPALCRKMEVPYAIVKGKSRLGAIVHKKTASVLCLTSVKNEDKLEFSKVLEAVKANFNDKFDEHRKKWGGGIMGSKSLAKTKAKERVIAKEAAQRMS

SEQ ID NO: 2891 - DNA, 759 bp, Populus balsamifera subsp. trichocarpa
  misc_feature (1)..(759): Ceres ANNOT ID no. 1440823
  misc_feature 323225:<222: Transcription Factor
  misc_feature: Phenotype: ROSETTE LEAVES - Curled 3 Useful for making ornamental plants with altered leaf shape
  misc_feature: Phenotype: INFLORESCENCE - Short Useful for modulating plant height
  misc_feature: Phenotype: CAULINE LEAVES - Ovate Shaped Useful for making plants with increased biomass and foliage
  misc_feature: Phenotype: CAULINE LEAVES - Serrate Margins Useful for making plants with increased biomass and foliage
atggcaccaaagcgaggtggaaagggtccggtggttgccggaaagaagaaaccggagaaggtgccgaatccattgttcgagaagaggccgaagcagtttggaattggaggggctttgccaccaaagagggatctgagccgattcgttaagatgccgaagatggttcagattcagaggcagaggaggattctcaagatgagattgaaggttccacctaccgtgaaccagttcaccaagacccttgacaagaatctcgcatcaaacttgttcaagatgcttttgaagtaccgtcctgaagacaaagcagcaaagaaggagcgcctcttgagaaaggctcaggcagagaccgaaggaaaaactgttgaggctaagaagcctattgttgtgaaatatggtctcaaccataaaaaagcccagttggttgttattgctcatgatgtggaccccattgagttggttgtatggctaccagcattgtgcaggaagatggaaatcccatactgcattgtgaagggaaaatctcgattgggagcaattgtccacaagaagactgcatcagttttgtgcttgaccacagtcaagaatgaagacaagttggagttcagcagaatcttggaagctatcaaggctaacttcaatgacaagtacgatgagtacaggaagaagtggggtggtggaatcatgggttccaaatcccaggccaagagcaaggccaaagacaaggtccttgccaaagaagctgcccagaggatgacctag

SEQ ID NO: 2892 - protein, 252 aa, Populus balsamifera subsp. trichocarpa
  misc_feature (1)..(252): Ceres ANNOT ID no. 1440823
  misc_feature (114)..(202): Pfam Name: Ribosomal_L7Ae Pfam Description: Ribosomal protein L7Ae/L30e/S12e/Gadd45 family
  misc_feature: SWISSPROT Homolog: RL7A_ORYSA 60S ribosomal protein L7a with e-value of 9.7e-117 and BLAST sequence identity of 97.8
  misc_feature: SWISSPROT Homolog: RL7A_ARATH 60S ribosomal protein L7a with e-value of 2.5e-102 and BLAST sequence identity of 85.2
  misc_feature: SWISSPROT Homolog: RL7A_HUMAN 60S ribosomal protein L7a (Surfeit locus protein 3) (PLA-X polypeptide) with e-value of 1.8e-69 and BLAST sequence identity of 60.5
  misc_feature: SWISSPROT Homolog: RL7A_MOUSE 60S ribosomal protein L7a (Surfeit locus protein 3) with e-value of 1.8e-69 and BLAST sequence identity of 60.5
  misc_feature: SWISSPROT Homolog: RL7A_RAT 60S ribosomal protein L7a with e-value of 1.8e-69 and BLAST sequence identity of 60.5
  misc_feature 323340:<222: Transcription Factor
  misc_feature: Phenotype: ROSETTE LEAVES - Curled 3 Useful for making ornamental plants with altered leaf shape
  misc_feature: Phenotype: INFLORESCENCE - Short Useful for modulating plant height
  misc_feature: Phenotype: CAULINE LEAVES - Ovate Shaped Useful for making plants with increased biomass and foliage
  misc_feature: Phenotype: CAULINE LEAVES - Serrate Margins Useful for making plants with increased biomass and foliage
  misc_feature (1)..(252): Functional Homolog of  Ceres CLONE ID no. 304574 at SEQ ID NO. 2931 with e-value of 2.50E-99 and BLAST sequence identity of 87.3
MAPKRGGKGPVVAGKKKPEKVPNPLFEKRPKQFGIGGALPPKRDLSRFVKMPKMVQIQRQRRILKMRLKVPPTVNQFTKTLDKNLASNLFKMLLKYRPEDKAAKKERLLRKAQAETEGKTVEAKKPIVVKYGLNHKKAQLVVIAHDVDPIELVVWLPALCRKMEIPYCIVKGKSRLGAIVHKKTASVLCLTTVKNEDKLEFSRILEAIKANFNDKYDEYRKKWGGGIMGSKSQAKSKAKDKVLAKEAAQRMT

SEQ ID NO: 2893 - protein, 267 aa, Zea mays
  misc_feature (1)..(267): Ceres CLONE ID no. 306497
  misc_feature (1)..(267): Also Known As Ceres CDNA ID no. 23765347
  misc_feature (1)..(267): Also Known As Ceres GEMINI ID 552G5
  misc_feature (49)..(100): Pfam Name: Myb_DNA-binding Pfam Description: Myb-like DNA-binding domain
  misc_feature 323462:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtATTPS3 (SEQ ID NO 4165) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
MFPSLIHHASHGRPDVAVAEDAPRSGCGLGLPGHGGGPSVVLTADPKPRLRWTADLHDRFVDAVAQLGGPDKATPKAIMRTMGVKGLTLFHLKSHLQKYRLGRQSGKELTEQSKDASYLMEAQSGTTLSPRGSTPDVKESQEVKEALRAQMEVQRRLHEQVEVQKHMQIRMEANQKYIDTILDKAFKIVSEQLSGFSISDQDLPILTSARAMLSPADHLSSSVFPQLSVSSVSLHNPGPGGGKGLPHVADSHVFSQRPPEQFKRKSR

SEQ ID NO: 2894 - DNA, 906 bp, Populus balsamifera subsp. trichocarpa
  misc_feature (1)..(906): Ceres ANNOT ID no. 1529923
  misc_feature 323553:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtATTPS3 (SEQ ID NO 4165) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atgtactctgcaatacactcactgcctttggatggacatggggactttcaagcttcattagatggaattaatctgcctggggatgcgtgcttggttctcaccacggatccaaagccaaggctccgctggactgctgagttacatgagagatttgttgatgctgttactcaacttggtggacctgacaaagcaacacctaagacaattatgagaacaatgggggtaaaaggcctcaccctttatcacttgaaatctcacctacagaaataccggttgggaaagcagtcctgcaaggaatcaactgataactccaaggatgaaagtcaggatactggttcatcgacatctgcatcatcaagaatgattgcgcaggatctgaatgatggttaccaggttactgaggctttgagagtgcagatggaagtccaacgaagattgcatgagcagctggaggtgcaacatcatctccaacttcgcattgaagctcaggggaaatacttacagtcaatacttgagaaagcttgtaaagctctgaatgaccaggctgttgcaactgcaggacttgaagctgctagggaagagctttctgaattagcaatcaaggtttccaatgaatgtgcaggaattgccccacttgataccatgaaaatgccttccttatctgaacttgctgctgctttagggaacagaaatgcttccaatgtgcctgctcgcattggtgattgctctgtcgaaagctgcttgacttcaactagtagcccagtttctcccatgggtgtgggctcacaagttgcttccacgaagaaaagatcaaggcctgtgcttggtaacggagattcattgcccttcgaaggcaactttcggcaagaagtagaatggacaatgagtaatattgtggatgaatag

SEQ ID NO: 2895 - protein, 301 aa, Populus balsamifera subsp. trichocarpa
  misc_feature (1)..(301): Ceres ANNOT ID no. 1529923
  misc_feature (40)..(91): Pfam Name: Myb_DNA-binding Pfam Description: Myb-like DNA-binding domain
  misc_feature: SWISSPROT Homolog: MYBF_ARATH Putative Myb family transcription factor At1g14600 with e-value of 3.2e-15 and BLAST sequence identity of 48.4
  misc_feature: SWISSPROT Homolog: ARR18_ARATH Two-component response regulator ARR18 with e-value of 8.9e-09 and BLAST sequence identity of 44.7
  misc_feature: SWISSPROT Homolog: ARR2_ARATH Two-component response regulator ARR2 (Receiver-like protein 5) with e-value of 4.9e-08 and BLAST sequence identity of 45.3
  misc_feature: SWISSPROT Homolog: ARR19_ARATH Putative two-component response regulator ARR19 with e-value of 6.3e-08 and BLAST sequence identity of 33.3
  misc_feature: SWISSPROT Homolog: ARR1_ARATH Two-component response regulator ARR1 with e-value of 1.5e-07 and BLAST sequence identity of 54.5
  misc_feature 323667:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtATTPS3 (SEQ ID NO 4165) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(301): Functional Homolog of  Ceres CLONE ID no. 306497 at SEQ ID NO. 2940 with e-value of 4.70E-52 and BLAST sequence identity of 58.2
MYSAIHSLPLDGHGDFQASLDGINLPGDACLVLTTDPKPRLRWTAELHERFVDAVTQLGGPDKATPKTIMRTMGVKGLTLYHLKSHLQKYRLGKQSCKESTDNSKDESQDTGSSTSASSRMIAQDLNDGYQVTEALRVQMEVQRRLHEQLEVQHHLQLRIEAQGKYLQSILEKACKALNDQAVATAGLEAAREELSELAIKVSNECAGIAPLDTMKMPSLSELAAALGNRNASNVPARIGDCSVESCLTSTSSPVSPMGVGSQVASTKKRSRPVLGNGDSLPFEGNFRQEVEWTMSNIVDE

SEQ ID NO: 2896 - DNA, 924 bp, Populus balsamifera subsp. trichocarpa
  misc_feature (1)..(924): Ceres ANNOT ID no. 1440964
  misc_feature 323772:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtATTPS3 (SEQ ID NO 4165) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atgtactctgcaatacactcactgcctttggatggacatggggactttcaagcggcattagatgggactaatctacctggggatgcgtgcttggttctcactacggatccaaaaccaaggctccgctggactgcagagttacatgagagatttgttgatgcagttgcccaacttggtggacctgacaaagcaacaccaaagacaattatgagaacaatgggggtaaaaggcctcaccctttatcacttgaaatctcacctgcagaaataccggctgggaaagcagtcctgcaaggaatcaactgataactccaaggatgttgggattgcagcatcagttgcagaaagtcaggatactggttcatcaacttcggcatcatcaagaatgattgcacaggatcttaatgatggttaccaggttactgaggctttgagagtgcagatggaagtccaacgaagattgcatgagcagcttgaggtacaacgtcgtctccaacttcggattgaagcacaggggaaatacttacagtcaatacttgagaaagcttgtaaagccctgaatgatcaggctgttgcgactgcaggacttgaagctgctagagaagagctttctgaattagcaatcaaggtttccaatgaacgtgcaggaattgccccacttgataccatgaaaatgccttccatatctgaacttgctgctgctttagagaacaaacatgcttccaatgtgcctgctcgtgttggcgattgctctgtcgaaagctgcctgacttcaactgggagcccagtttctccaatgggtgtgggcgcacaggttgcttccacgaagaaaagatcaaggcctgtgtttggtaatggagattcattgcccttcgatggcaacattcagcaagaagttgaatggacaatgaacaatattgtatga

SEQ ID NO: 2897 - protein, 307 aa, Populus balsamifera subsp. trichocarpa
  misc_feature (1)..(307): Ceres ANNOT ID no. 1440964
  misc_feature (40)..(91): Pfam Name: Myb_DNA-binding Pfam Description: Myb-like DNA-binding domain
  misc_feature: SWISSPROT Homolog: MYBF_ARATH Putative Myb family transcription factor At1g14600 with e-value of 3.2e-15 and BLAST sequence identity of 48.4
  misc_feature: SWISSPROT Homolog: ARR18_ARATH Two-component response regulator ARR18 with e-value of 8.9e-09 and BLAST sequence identity of 44.7
  misc_feature: SWISSPROT Homolog: ARR2_ARATH Two-component response regulator ARR2 (Receiver-like protein 5) with e-value of 4.9e-08 and BLAST sequence identity of 45.3
  misc_feature: SWISSPROT Homolog: ARR19_ARATH Putative two-component response regulator ARR19 with e-value of 6.3e-08 and BLAST sequence identity of 33.3
  misc_feature: SWISSPROT Homolog: ARR1_ARATH Two-component response regulator ARR1 with e-value of 1.5e-07 and BLAST sequence identity of 54.5
  misc_feature 323886:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtATTPS3 (SEQ ID NO 4165) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(307): Functional Homolog of  Ceres CLONE ID no. 306497 at SEQ ID NO. 2940 with e-value of 4.70E-52 and BLAST sequence identity of 58.6
MYSAIHSLPLDGHGDFQAALDGTNLPGDACLVLTTDPKPRLRWTAELHERFVDAVAQLGGPDKATPKTIMRTMGVKGLTLYHLKSHLQKYRLGKQSCKESTDNSKDVGIAASVAESQDTGSSTSASSRMIAQDLNDGYQVTEALRVQMEVQRRLHEQLEVQRRLQLRIEAQGKYLQSILEKACKALNDQAVATAGLEAAREELSELAIKVSNERAGIAPLDTMKMPSISELAAALENKHASNVPARVGDCSVESCLTSTGSPVSPMGVGAQVASTKKRSRPVFGNGDSLPFDGNIQQEVEWTMNNIV

SEQ ID NO: 2898 - DNA, 861 bp, Populus balsamifera subsp. trichocarpa
  misc_feature (1)..(861): Ceres ANNOT ID no. 1493847
  misc_feature 323994:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtATTPS3 (SEQ ID NO 4165) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atgtactctgcaatacactcactgcctttggatggacatggggactttcaagcggcattagatgggactaatctacctggggatgcgtgcttggttctcactacggatccaaaaccaaggctccgctggactgcagagttacatgagagatttgttgatgcagttgcccaacttggtggacctgacaaagcaacaccaaagacaattatgagaacaatgggggtaaaaggcctcaccctttatcacttgaaatctcacctgcagaaataccggctgggaaagcagtcctgcaaggaatcaactgataactccaaggatggtattggcctcgtatcattagaacggtttttacaagttactgaggctttgagagtgcagatggaagtccaacgaagattgcatgagcagcttgaggtacaacgtcgtctccaacttcggattgaagcacaggggaaatacttacagtcaatacttgagaaagcttgtaaagccctgaatgatcaggctgttgcgactgcaggacttgaagctgctagagaagagctttctgaattagcaatcaaggtttccaatgaacgtgcaggaattgccccacttgataccatgaaaatgccttccatatctgaacttgctgctgctttagagaacaaacatgcttccaatgtgcctgctcgtgttggcgattgctctgtcgaaagctgcctgacttcaactgggagcccagtttctccaatgggtgtgggcgcacaggttgcttccacgaagaaaagatcaaggcctgtgtttggtaatggagattcattgcccttcgatggcaacattcagcaagaagttgaatggacaatgaacaatattgtatga

SEQ ID NO: 2899 - protein, 286 aa, Populus balsamifera subsp. trichocarpa
  misc_feature (1)..(286): Ceres ANNOT ID no. 1493847
  misc_feature (40)..(91): Pfam Name: Myb_DNA-binding Pfam Description: Myb-like DNA-binding domain
  misc_feature: SWISSPROT Homolog: MYBF_ARATH Putative Myb family transcription factor At1g14600 with e-value of 3.2e-15 and BLAST sequence identity of 48.4
  misc_feature: SWISSPROT Homolog: ARR18_ARATH Two-component response regulator ARR18 with e-value of 8.9e-09 and BLAST sequence identity of 44.7
  misc_feature: SWISSPROT Homolog: ARR2_ARATH Two-component response regulator ARR2 (Receiver-like protein 5) with e-value of 4.9e-08 and BLAST sequence identity of 45.3
  misc_feature: SWISSPROT Homolog: ARR19_ARATH Putative two-component response regulator ARR19 with e-value of 6.3e-08 and BLAST sequence identity of 33.3
  misc_feature: SWISSPROT Homolog: ARR1_ARATH Two-component response regulator ARR1 with e-value of 1.5e-07 and BLAST sequence identity of 54.5
  misc_feature 324106:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtATTPS3 (SEQ ID NO 4165) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(286): Functional Homolog of  Ceres CLONE ID no. 306497 at SEQ ID NO. 2940 with e-value of 3.49E-47 and BLAST sequence identity of 59.5
MYSAIHSLPLDGHGDFQAALDGTNLPGDACLVLTTDPKPRLRWTAELHERFVDAVAQLGGPDKATPKTIMRTMGVKGLTLYHLKSHLQKYRLGKQSCKESTDNSKDGIGLVSLERFLQVTEALRVQMEVQRRLHEQLEVQRRLQLRIEAQGKYLQSILEKACKALNDQAVATAGLEAAREELSELAIKVSNERAGIAPLDTMKMPSISELAAALENKHASNVPARVGDCSVESCLTSTGSPVSPMGVGAQVASTKKRSRPVFGNGDSLPFDGNIQQEVEWTMNNIV

SEQ ID NO: 2900 - DNA, 864 bp, Populus balsamifera subsp. trichocarpa
  misc_feature (1)..(864): Ceres ANNOT ID no. 1533800
  misc_feature 324208:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtATTPS3 (SEQ ID NO 4165) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atgttggagagcaggggggttggaatcggagggatgattatggaagaaatgcatcaaaatcaatcaggaattggaattggattaggaatgcaaggaggagcccaagttgtgttgacttccgatcccaagcctcgcctccgttggactgccgatcttcaccaacgcttcgttgacgctgtctctcagctcggcggtcccaataaagccaccccaaaggctatcttgcgtacaatgaatgtcaagggattgaccctctttcatttaaagagccaccttcagaaatatagactgggtaagcaatcggggaaggatatgagcgacacattcaaagatggttatgaagtcaaagaggcattacgcgcacaaatggaagtgcaaagcaaattgcatctacaagtggaggctgagaagcacttgcatattcgcctggatgcagaacgaagatatctggccatgctcgagagagcttgtaagatgcttgccgatcaatttattggtgctgcagttattgatacagatagccagaaggggttgggaaccaggacaactagaattgcctctcttgatccacttggcttttactccttacaaacctctgaggtggctgaagtgcatggtccagaggatgtactgcccggtcttcatcaccaaggggctgattgttctaccgaaagctgcctgacttctaacgagagtcctggaggtttgaatttggaaggatctccagctggagggaagaaagggatgctgagcttggagtcagcaacatctttgatctggggtgaaacaagaatgggaaatgcagaagttaatgcgacccaagtcaattcctatggcgcctctctgtatggaatatggaattga

SEQ ID NO: 2901 - protein, 274 aa, Populus balsamifera subsp. trichocarpa
  misc_feature (1)..(274): Ceres ANNOT ID no. 1533800
  misc_feature (32)..(83): Pfam Name: Myb_DNA-binding Pfam Description: Myb-like DNA-binding domain
  misc_feature: SWISSPROT Homolog: MYBF_ARATH Putative Myb family transcription factor At1g14600 with e-value of 3.2e-15 and BLAST sequence identity of 48.4
  misc_feature: SWISSPROT Homolog: ARR18_ARATH Two-component response regulator ARR18 with e-value of 8.9e-09 and BLAST sequence identity of 44.7
  misc_feature: SWISSPROT Homolog: ARR2_ARATH Two-component response regulator ARR2 (Receiver-like protein 5) with e-value of 4.9e-08 and BLAST sequence identity of 45.3
  misc_feature: SWISSPROT Homolog: ARR19_ARATH Putative two-component response regulator ARR19 with e-value of 6.3e-08 and BLAST sequence identity of 33.3
  misc_feature: SWISSPROT Homolog: ARR1_ARATH Two-component response regulator ARR1 with e-value of 1.5e-07 and BLAST sequence identity of 54.5
  misc_feature 324320:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtATTPS3 (SEQ ID NO 4165) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(274): Functional Homolog of  Ceres CLONE ID no. 306497 at SEQ ID NO. 2940 with e-value of 1.89E-46 and BLAST sequence identity of 60.5
MEEMHQNQSGIGIGLGMQGGAQVVLTSDPKPRLRWTADLHQRFVDAVSQLGGPNKATPKAILRTMNVKGLTLFHLKSHLQKYRLGKQSGKDMSDTFKDGYEVKEALRAQMEVQSKLHLQVEAEKHLHIRLDAERRYLAMLERACKMLADQFIGAAVIDTDSQKGLGTRTTRIASLDPLGFYSLQTSEVAEVHGPEDVLPGLHHQGADCSTESCLTSNESPGGLNLEGSPAGGKKGMLSLESATSLIWGETRMGNAEVNATQVNSYGASLYGIWN

SEQ ID NO: 2902 - protein, 94 aa, Zea mays
  misc_feature (1)..(94): Ceres CLONE ID no. 316638
  misc_feature (1)..(94): Also Known As Ceres CDNA ID no. 23767585
  misc_feature (1)..(94): Also Known As Ceres GEMINI ID 538E5
  misc_feature (4)..(93): Pfam Name: Arf Pfam Description: ADP-ribosylation factor family
  misc_feature 324442:<222: Transcription Factor
  misc_feature: Phenotype: Activates expression of the gene endogenous to the AtPES (SEQ ID NO 4142) regalutory region Useful for modulating Terpenoid Biosynthesis
MGQAFRKLFDSFFGTSEMRVVMLGLDAAGKTTILYKLHIGEVLSTVPTIGFNVEKVQYKNVMFTVWDVGGQEKLRVTTSAKEMSLGISPLEGVQ

SEQ ID NO: 2903 - DNA, 411 bp, Populus balsamifera subsp. trichocarpa
  misc_feature (1)..(411): Ceres ANNOT ID no. 1470444
  misc_feature 324485:<222: Transcription Factor
  misc_feature: Phenotype: Activates expression of the gene endogenous to the AtPES (SEQ ID NO 4142) regalutory region Useful for modulating Terpenoid Biosynthesis
atgggtcaagcctttcgcaagcttttcgacaccttctttggcaacaccgagatgcgggttgtgatgctgggacttgatgcagctggtaaaactaccatactttacaagttgcacattggagaagtattatctactgtccctaccattgggttcaatgtggagaaagttcagtacaagaatgtggtattcaccgtttgggatgttggtggacaagagaaattaaggccgctctggaggcattacttcaataacactgatggactgatatatgttgttgattcattggaccgagagagaatcggaaaagcaaaggcagaatttcaggttgtatattcagaaagaccatcatcaaagatccatttatgctcaacagtgtcatcttggtgtttgccaacaaacaggacatggtaa

SEQ ID NO: 2904 - protein, 136 aa, Populus balsamifera subsp. trichocarpa
  misc_feature (1)..(136): Ceres ANNOT ID no. 1470444
  misc_feature (4)..(135): Pfam Name: Arf Pfam Description: ADP-ribosylation factor family
  misc_feature: SWISSPROT Homolog: ARF2_BOVIN ADP-ribosylation factor 2 with e-value of 7.0e-27 and BLAST sequence identity of 70.7
  misc_feature: SWISSPROT Homolog: ARF2_MOUSE ADP-ribosylation factor 2 with e-value of 7.0e-27 and BLAST sequence identity of 70.7
  misc_feature: SWISSPROT Homolog: ARF2_RAT ADP-ribosylation factor 2 with e-value of 7.0e-27 and BLAST sequence identity of 70.7
  misc_feature: SWISSPROT Homolog: ARF_AJECA ADP-ribosylation factor with e-value of 1.9e-26 and BLAST sequence identity of 70.3
  misc_feature: SWISSPROT Homolog: ARF_NEUCR ADP-ribosylation factor with e-value of 4.9e-26 and BLAST sequence identity of 73.2
  misc_feature 324565:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(136): Functional Homolog of  Ceres CLONE ID no. 316638 at SEQ ID NO. 2949 with e-value of 3.00E-34 and BLAST sequence identity of 94.6
MGQAFRKLFDTFFGNTEMRVVMLGLDAAGKTTILYKLHIGEVLSTVPTIGFNVEKVQYKNVVFTVWDVGGQEKLRPLWRHYFNNTDGLIYVVDSLDRERIGKAKAEFQVVYSERPSSKIHLCSTVSSWCLPTNRTW

SEQ ID NO: 2905 - protein, 344 aa, Zea mays
  misc_feature (1)..(344): Ceres CLONE ID no. 325800
  misc_feature (1)..(344): Also Known As Ceres CDNA ID no. 23792467
  misc_feature (1)..(344): Also Known As Ceres GEMINI ID 552D1
  misc_feature (40)..(91): Pfam Name: Myb_DNA-binding Pfam Description: Myb-like DNA-binding domain
  misc_feature 324645:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
MFPSSKKQASTGAANPNDRPMCGQGGDSGGLVLTTDPKPRLRWTPELHDRFVDAVAQLGGPDKATPKTIMRVMGVKGLTLYHLKSHLQKFRLGKQHKELGDHTAMEMQRSVASSSGMIARSMNDRSVNVNEALRIQMEVQRRLHGELEVQKHLQMRVEAQGKYMQSIVEKAYQALGSSDCATWPAGYRTLGSQGVLDIGTSSTSFSSVQDLQCFYGGSSHMDQLLHQMERPMDGFLTLGESCFIGSADNKKDPNNHCSSSGKSSMMWASEEQQAKSGNDQLQMGSSTRMEGAGIDVMDPVVTGLYEGAVSGDSMDSKGFEGSNSRLEMKPPAQQAPVGSQRIRI

SEQ ID NO: 2906 - DNA, 1071 bp, Populus balsamifera subsp. trichocarpa
  misc_feature (1)..(1071): Ceres ANNOT ID no. 1517851
  misc_feature 324752:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
atgttccataccaagaaaccctcaactatgaattcccatgatagacccatgtgtgttcaaggggactctggtcttgtcctcaccacagaccccaagccccgtctccgctggactgttgagctccatgaacgctttgtggatgccgttactcagcttggaggcccagataaggccactcccaaaaccatcatgagagtcatgggtgtgaagggtcttaccctttaccacctcaaaagccatcttcagaaattcagacttggaaagcaaccacacaaggatttcaatgatcattcaattaaggatgcttcggcgttagatcttcaacgaagtgcagcatcttcatctggcatgatgagccgcagtatgaatgagatgcaaatggaggtgcagagaagactgcatgaacaattagaggttcaaagacaccttcaattaaggaccgaggctcaagggaaatatatacaaagtttgttggagaaagcttgccaaaccctagcaggtgatcaaaacttggcttctggaagctataagggaatggggaatcaaggaattcctggtatgggtgcaatgaaagaatttggcacgctgaattttccagcatttcaagaccttaacatttatgggggtgaccaacttgaccttcaacacaatatggataggccatcactcgatggtttcatgccgaacaacgacaacatttgtttgggaaagaagaggcctagtccttacgatggtagtggaaagagccctttgatttggccggacgatctgcgtttgcaggatttgggatcaggaccggcatgtcttgaaccccaagatgatcctttcaaaggtgatcaaatccagatggcaccaccatcaatggataggggtactgatctggattccatatctgacatgtatgaaataaagccagcgcttcagggtgatgcactggatgagaagaaatttgaagcatcagcaaagctaaaaaggccatccccaagaagatcaccactagcagccgaaaggatgagccctatgatcaatactggcgccatgccacaaggcagaaactcaccatttggttga

SEQ ID NO: 2907 - protein, 356 aa, Populus balsamifera subsp. trichocarpa
  misc_feature (1)..(356): Ceres ANNOT ID no. 1517851
  misc_feature (34)..(85): Pfam Name: Myb_DNA-binding Pfam Description: Myb-like DNA-binding domain
  misc_feature: SWISSPROT Homolog: MYBF_ARATH Putative Myb family transcription factor At1g14600 with e-value of 1.6e-16 and BLAST sequence identity of 53.7
  misc_feature: SWISSPROT Homolog: ARR18_ARATH Two-component response regulator ARR18 with e-value of 2.4e-12 and BLAST sequence identity of 27.1
  misc_feature: SWISSPROT Homolog: ARR20_ARATH Putative two-component response regulator ARR20 with e-value of 2.8e-09 and BLAST sequence identity of 51.7
  misc_feature: SWISSPROT Homolog: ARR19_ARATH Putative two-component response regulator ARR19 with e-value of 3.5e-08 and BLAST sequence identity of 34.3
  misc_feature: SWISSPROT Homolog: ARR2_ARATH Two-component response regulator ARR2 (Receiver-like protein 5) with e-value of 1.1e-07 and BLAST sequence identity of 56.4
  misc_feature 324871:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature (1)..(356): Functional Homolog of  Ceres CLONE ID no. 325800 at SEQ ID NO. 2952 with e-value of 2.70E-72 and BLAST sequence identity of 58.4
MFHTKKPSTMNSHDRPMCVQGDSGLVLTTDPKPRLRWTVELHERFVDAVTQLGGPDKATPKTIMRVMGVKGLTLYHLKSHLQKFRLGKQPHKDFNDHSIKDASALDLQRSAASSSGMMSRSMNEMQMEVQRRLHEQLEVQRHLQLRTEAQGKYIQSLLEKACQTLAGDQNLASGSYKGMGNQGIPGMGAMKEFGTLNFPAFQDLNIYGGDQLDLQHNMDRPSLDGFMPNNDNICLGKKRPSPYDGSGKSPLIWPDDLRLQDLGSGPACLEPQDDPFKGDQIQMAPPSMDRGTDLDSISDMYEIKPALQGDALDEKKFEASAKLKRPSPRRSPLAAERMSPMINTGAMPQGRNSPFG

SEQ ID NO: 2908 - DNA, 1044 bp, Populus balsamifera subsp. trichocarpa
  misc_feature (1)..(1044): Ceres ANNOT ID no. 1464534
  misc_feature 324989:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
atgaattcccatgatagacccatgtgtgttcaaggggactctggtcttgtcctcaccacagaccccaagccccgtctccgctggactgttgagctccatgaacgctttgtggatgccgttactcagcttggaggcccagataaggccactcccaaaaccatcatgagagtcatgggtgtgaagggtcttaccctttaccacctcaaaagccatcttcagaaattcagacttggaaagcaaccacacaaggatttcaatgatcattcaattaaggatgcttcggcgttagatcttcaacgaagtgcagcatcttcatctggcatgatgagccgcagtatgaatgagatgcaaatggaggtgcagagaagactgcatgaacaattagaggttcaaagacaccttcaattaaggaccgaggctcaagggaaatatatacaaagtttgttggagaaagcttgccaaaccctagcaggtgatcaaaacttggcttctggaagctataagggaatggggaatcaaggaattcctggtatgggtgcaatgaaagaatttggcacgctgaattttccagcatttcaagaccttaacatttatgggggtgaccaacttgaccttcaacacaatatggataggccatcactcgatggtttcatgccgaacaacgacaacatttgtttgggaaagaagaggcctagtccttacgatggtagtggaaagagccctttgatttggccggacgatctgcgtttgcaggatttgggatcaggaccggcatgtcttgaaccccaagatgatcctttcaaaggtgatcaaatccagatggcaccaccatcaatggataggggtactgatctggattccatatctgacatgtatgaaataaagccagcgcttcagggtgatgcactggatgagaagaaatttgaagcatcagcaaagctaaaaaggccatccccaagaagatcaccactagcagccgaaaggatgagccctatgatcaatactggcgccatgccacaaggcagaaactcaccatttggttga

SEQ ID NO: 2909 - protein, 347 aa, Populus balsamifera subsp. trichocarpa
  misc_feature (1)..(347): Ceres ANNOT ID no. 1464534
  misc_feature (25)..(76): Pfam Name: Myb_DNA-binding Pfam Description: Myb-like DNA-binding domain
  misc_feature: SWISSPROT Homolog: MYBF_ARATH Putative Myb family transcription factor At1g14600 with e-value of 1.6e-16 and BLAST sequence identity of 53.7
  misc_feature: SWISSPROT Homolog: ARR18_ARATH Two-component response regulator ARR18 with e-value of 2.4e-12 and BLAST sequence identity of 27.1
  misc_feature: SWISSPROT Homolog: ARR20_ARATH Putative two-component response regulator ARR20 with e-value of 2.8e-09 and BLAST sequence identity of 51.7
  misc_feature: SWISSPROT Homolog: ARR19_ARATH Putative two-component response regulator ARR19 with e-value of 3.5e-08 and BLAST sequence identity of 34.3
  misc_feature: SWISSPROT Homolog: ARR2_ARATH Two-component response regulator ARR2 (Receiver-like protein 5) with e-value of 1.1e-07 and BLAST sequence identity of 56.4
  misc_feature 325108:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature (1)..(347): Functional Homolog of  Ceres CLONE ID no. 325800 at SEQ ID NO. 2952 with e-value of 4.40E-72 and BLAST sequence identity of 58.6
MNSHDRPMCVQGDSGLVLTTDPKPRLRWTVELHERFVDAVTQLGGPDKATPKTIMRVMGVKGLTLYHLKSHLQKFRLGKQPHKDFNDHSIKDASALDLQRSAASSSGMMSRSMNEMQMEVQRRLHEQLEVQRHLQLRTEAQGKYIQSLLEKACQTLAGDQNLASGSYKGMGNQGIPGMGAMKEFGTLNFPAFQDLNIYGGDQLDLQHNMDRPSLDGFMPNNDNICLGKKRPSPYDGSGKSPLIWPDDLRLQDLGSGPACLEPQDDPFKGDQIQMAPPSMDRGTDLDSISDMYEIKPALQGDALDEKKFEASAKLKRPSPRRSPLAAERMSPMINTGAMPQGRNSPFG

SEQ ID NO: 2910 - DNA, 1071 bp, Populus balsamifera subsp. trichocarpa
  misc_feature (1)..(1071): Ceres ANNOT ID no. 1511678
  misc_feature 325223:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
atgttccataccaagaaaccctcaactatgaattcccatgatagacccatgtgtgttcaagactctggtcttgtcctcaccacagaccctaagccccgtctccgctggactgttgagctccatgaacgctttgtggatgctgttgctcagcttggaggccctgacaaggccactccaaaaaccatcatgagagtcatgggtgtgaagggtcttaccctttaccacctcaaaagccatcttcagaaattcagacttggaaagcaactacacaaagaattcaatgatcattcaatcaaggatgcttcggcgttagatcttcaacgaagcgcagcatcttcatccggcatgattagccgcagtatgaatgagatgcaaatggaggtgcagagaagactgcacgaacaattagaggttcaaagacaccttcaattaaggactgaagctcaaggaaaatatatacaaagtttgttggagaaagcttgccaaaccctagcaggtgatcaagacttggcttctggaagctacaagggaattgggaatcaaggagttcctgatatgggtgcaatgaaagactttggtccgcttaattttccaccatttcaagaccttaacatttatgggagtggccagcttgaccttctacacaatatggataggccatcacttgatggtttcatgtccaacaatcatgacgacatttgtttgggaaagaagaggactaatccttatgctggtagtggcaagagccctttgatttggtcggacgatctgcgtttgcaagatttgggatcgggactgtcatgtcttggacctcaagatgatcctttgaaaggtgaccagatccagattgcaccaccattaatggatagtggcactgatctggattcgttatctggtttatatggaacaaagccagtacatcagggtgatgcactggatgaaaagaaattggaagcatcagcaaagactgaaaggccatcaccaagaagagcaccacttgcagcagacaggatgagccctatgatcaataccggtgtcatgccacaaggcagaaactcaccatttggttga

SEQ ID NO: 2911 - protein, 356 aa, Populus balsamifera subsp. trichocarpa
  misc_feature (1)..(356): Ceres ANNOT ID no. 1511678
  misc_feature (33)..(84): Pfam Name: Myb_DNA-binding Pfam Description: Myb-like DNA-binding domain
  misc_feature: SWISSPROT Homolog: MYBF_ARATH Putative Myb family transcription factor At1g14600 with e-value of 1.6e-16 and BLAST sequence identity of 53.7
  misc_feature: SWISSPROT Homolog: ARR18_ARATH Two-component response regulator ARR18 with e-value of 2.4e-12 and BLAST sequence identity of 27.1
  misc_feature: SWISSPROT Homolog: ARR20_ARATH Putative two-component response regulator ARR20 with e-value of 2.8e-09 and BLAST sequence identity of 51.7
  misc_feature: SWISSPROT Homolog: ARR19_ARATH Putative two-component response regulator ARR19 with e-value of 3.5e-08 and BLAST sequence identity of 34.3
  misc_feature: SWISSPROT Homolog: ARR2_ARATH Two-component response regulator ARR2 (Receiver-like protein 5) with e-value of 1.1e-07 and BLAST sequence identity of 56.4
  misc_feature 325342:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature (1)..(356): Functional Homolog of  Ceres CLONE ID no. 325800 at SEQ ID NO. 2952 with e-value of 5.60E-72 and BLAST sequence identity of 58.2
MFHTKKPSTMNSHDRPMCVQDSGLVLTTDPKPRLRWTVELHERFVDAVAQLGGPDKATPKTIMRVMGVKGLTLYHLKSHLQKFRLGKQLHKEFNDHSIKDASALDLQRSAASSSGMISRSMNEMQMEVQRRLHEQLEVQRHLQLRTEAQGKYIQSLLEKACQTLAGDQDLASGSYKGIGNQGVPDMGAMKDFGPLNFPPFQDLNIYGSGQLDLLHNMDRPSLDGFMSNNHDDICLGKKRTNPYAGSGKSPLIWSDDLRLQDLGSGLSCLGPQDDPLKGDQIQIAPPLMDSGTDLDSLSGLYGTKPVHQGDALDEKKLEASAKTERPSPRRAPLAADRMSPMINTGVMPQGRNSPFG

SEQ ID NO: 2912 - DNA, 1044 bp, Populus balsamifera subsp. trichocarpa
  misc_feature (1)..(1044): Ceres ANNOT ID no. 1458433
  misc_feature 325460:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
atgaattcccatgatagacccatgtgtgttcaagactctggtcttgtcctcaccacagaccctaagccccgtctccgctggactgttgagctccatgaacgctttgtggatgctgttgctcagcttggaggccctgacaaggccactccaaaaaccatcatgagagtcatgggtgtgaagggtcttaccctttaccacctcaaaagccatcttcagaaattcagacttggaaagcaactacacaaagaattcaatgatcattcaatcaaggatgcttcggcgttagatcttcaacgaagcgcagcatcttcatccggcatgattagccgcagtatgaatgagatgcaaatggaggtgcagagaagactgcacgaacaattagaggttcaaagacaccttcaattaaggactgaagctcaaggaaaatatatacaaagtttgttggagaaagcttgccaaaccctagcaggtgatcaagacttggcttctggaagctacaagggaattgggaatcaaggagttcctgatatgggtgcaatgaaagactttggtccgcttaattttccaccatttcaagaccttaacatttatgggagtggccagcttgaccttctacacaatatggataggccatcacttgatggtttcatgtccaacaatcatgacgacatttgtttgggaaagaagaggactaatccttatgctggtagtggcaagagccctttgatttggtcggacgatctgcgtttgcaagatttgggatcgggactgtcatgtcttggacctcaagatgatcctttgaaaggtgaccagatccagattgcaccaccattaatggatagtggcactgatctggattcgttatctggtttatatggaacaaagccagtacatcagggtgatgcactggatgaaaagaaattggaagcatcagcaaagactgaaaggccatcaccaagaagagcaccacttgcagcagacaggatgagccctatgatcaataccggtgtcatgccacaaggcagaaactcaccatttggttga

SEQ ID NO: 2913 - protein, 347 aa, Populus balsamifera subsp. trichocarpa
  misc_feature (1)..(347): Ceres ANNOT ID no. 1458433
  misc_feature (24)..(75): Pfam Name: Myb_DNA-binding Pfam Description: Myb-like DNA-binding domain
  misc_feature: SWISSPROT Homolog: MYBF_ARATH Putative Myb family transcription factor At1g14600 with e-value of 1.6e-16 and BLAST sequence identity of 53.7
  misc_feature: SWISSPROT Homolog: ARR18_ARATH Two-component response regulator ARR18 with e-value of 2.4e-12 and BLAST sequence identity of 27.1
  misc_feature: SWISSPROT Homolog: ARR20_ARATH Putative two-component response regulator ARR20 with e-value of 2.8e-09 and BLAST sequence identity of 51.7
  misc_feature: SWISSPROT Homolog: ARR19_ARATH Putative two-component response regulator ARR19 with e-value of 3.5e-08 and BLAST sequence identity of 34.3
  misc_feature: SWISSPROT Homolog: ARR2_ARATH Two-component response regulator ARR2 (Receiver-like protein 5) with e-value of 1.1e-07 and BLAST sequence identity of 56.4
  misc_feature 325579:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature (1)..(347): Functional Homolog of  Ceres CLONE ID no. 325800 at SEQ ID NO. 2952 with e-value of 9.10E-72 and BLAST sequence identity of 58.4
MNSHDRPMCVQDSGLVLTTDPKPRLRWTVELHERFVDAVAQLGGPDKATPKTIMRVMGVKGLTLYHLKSHLQKFRLGKQLHKEFNDHSIKDASALDLQRSAASSSGMISRSMNEMQMEVQRRLHEQLEVQRHLQLRTEAQGKYIQSLLEKACQTLAGDQDLASGSYKGIGNQGVPDMGAMKDFGPLNFPPFQDLNIYGSGQLDLLHNMDRPSLDGFMSNNHDDICLGKKRTNPYAGSGKSPLIWSDDLRLQDLGSGLSCLGPQDDPLKGDQIQIAPPLMDSGTDLDSLSGLYGTKPVHQGDALDEKKLEASAKTERPSPRRAPLAADRMSPMINTGVMPQGRNSPFG

SEQ ID NO: 2914 - DNA, 906 bp, Populus balsamifera subsp. trichocarpa; identical to SEQ ID NO: 2894
  misc_feature (1)..(906): Ceres ANNOT ID no. 1529923
  misc_feature 325694:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis

SEQ ID NO: 2915 - protein, 301 aa, Populus balsamifera subsp. trichocarpa; identical to SEQ ID NO: 2895
  misc_feature (1)..(301): Ceres ANNOT ID no. 1529923
  misc_feature (40)..(91): Pfam Name: Myb_DNA-binding Pfam Description: Myb-like DNA-binding domain
  misc_feature: SWISSPROT Homolog: MYBF_ARATH Putative Myb family transcription factor At1g14600 with e-value of 1.6e-16 and BLAST sequence identity of 53.7
  misc_feature: SWISSPROT Homolog: ARR18_ARATH Two-component response regulator ARR18 with e-value of 2.4e-12 and BLAST sequence identity of 27.1
  misc_feature: SWISSPROT Homolog: ARR20_ARATH Putative two-component response regulator ARR20 with e-value of 2.8e-09 and BLAST sequence identity of 51.7
  misc_feature: SWISSPROT Homolog: ARR19_ARATH Putative two-component response regulator ARR19 with e-value of 3.5e-08 and BLAST sequence identity of 34.3
  misc_feature: SWISSPROT Homolog: ARR2_ARATH Two-component response regulator ARR2 (Receiver-like protein 5) with e-value of 1.1e-07 and BLAST sequence identity of 56.4
  misc_feature 325809:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature (1)..(301): Functional Homolog of  Ceres CLONE ID no. 325800 at SEQ ID NO. 2952 with e-value of 5.89E-52 and BLAST sequence identity of 72.9

SEQ ID NO: 2916 - protein, 228 aa, Zea mays
  misc_feature (1)..(228): Ceres CLONE ID no. 331626
  misc_feature (1)..(228): Also Known As Ceres CDNA ID no. 23765288
  misc_feature (1)..(228): Also Known As Ceres GEMINI ID 538H4
  misc_feature (81)..(175): Pfam Name: K-box Pfam Description: K-box region
  misc_feature (9)..(59): Pfam Name: SRF-TF Pfam Description: SRF-type transcription factor DNA-binding and dimerisation domain)
  misc_feature 325942:<222: Transcription Factor
  misc_feature: Phenotype: Activates expression of the gene endogenous to the AtPES (SEQ ID NO 4142) regalutory region Useful for modulating Terpenoid Biosynthesis
  misc_feature: Phenotype: ROSETTE LEAVES - Curled 5 Useful for making ornamental plants with altered leaf shape
MARGKVQLRRVENPVHRQVTFCKRRAGLLKKARELSVLCDASVGIIVFSAHGKLYDLATTGTMEELIERYKAASAGEATTDGCGRHNRMDPKHETTVLQQEINLLQKGLRYIYGNRANEHMNVDELNALERYLEIWMYNTRSAKMQIMAQEIQALKSKEGMLKAANEILQEKIVEQSSLLDVGMVVADQQNGRFSTVPLVEEVISSNPLTILSGYSSCRGSEMGYSFC

SEQ ID NO: 2917 - DNA, 621 bp, Populus balsamifera subsp. trichocarpa
  misc_feature (1)..(621): Ceres ANNOT ID no. 1479649
  misc_feature 326019:<222: Transcription Factor
  misc_feature: Phenotype: Activates expression of the gene endogenous to the AtPES (SEQ ID NO 4142) regalutory region Useful for modulating Terpenoid Biosynthesis
  misc_feature: Phenotype: ROSETTE LEAVES - Curled 5 Useful for making ornamental plants with altered leaf shape
atggctcgtggaaaggttcagttgagacgtattgagaaccatgtgcacaggcaggttaccttctgcaagcgccgagcagggctccttaagaaggctaaggagctctctgtgctgtgtgatgctgaaattggagttgtcattttctccgcccatggaaagctctatgaactagccaccaaaggaaccatgcaagggctcattgagaggtacatgaagtccagccgtggggctcaacctgaaccagctgccatggagacccagccggcgcctgatctggatacaaaggaggagatcaacatgttgaagcaagagattgaagtactgcaaaaaggactaaggtacatgttcggagcaagagctgcagcagaaatgagcttagatgaattgcttgtactcgaaaaacatcttgaaatttggatttatcaaattcgttcaaccaagatggacatcatgtttaaagagattcagcagttgaggaacaaggaagaaatattgacggctgcaaaccaacacctccataataaggtggaggagaatgctgagattactaactttgtgtcagtaacctctgattttccgcacccactaactatacaaaatgaaataatatttcaatattag

SEQ ID NO: 2918 - protein, 206 aa, Populus balsamifera subsp. trichocarpa
  misc_feature (1)..(206): Ceres ANNOT ID no. 1479649
  misc_feature (83)..(178): Pfam Name: K-box Pfam Description: K-box region
  misc_feature (9)..(59): Pfam Name: SRF-TF Pfam Description: SRF-type transcription factor DNA-binding and dimerisation domain)
  misc_feature: SWISSPROT Homolog: MAD26_ORYSA MADS-box transcription factor 26 (OsMADS26) (FDRMADS3) (RMADS220) with e-value of 1.1e-97 and BLAST sequence identity of 84.1
  misc_feature: SWISSPROT Homolog: MAD33_ORYSA MADS-box transcription factor 33 (OsMADS33) with e-value of 4.8e-51 and BLAST sequence identity of 58.7
  misc_feature: SWISSPROT Homolog: AGL12_ARATH Agamous-like MADS-box protein AGL12 with e-value of 1.9e-49 and BLAST sequence identity of 51.0
  misc_feature: SWISSPROT Homolog: MAD14_ORYSA MADS-box transcription factor 14 (OsMADS14) (Protein APETALA1- like B)(Protein AGAMOUS-like 10) (FDRMADS6) (RMADS211) with e-value of 2.1e-34 and BLAST sequence identity of 38.1
  misc_feature: SWISSPROT Homolog: MAD18_ORYSA MADS-box transcription factor 18 (OsMADS18) (MADS-box protein 2) (OsMADS2) (MADS-box protein 28) (OsMADS28) (FDRMADS7) with e-value of 3.5e-32 and BLAST sequence identity of 37.9
  misc_feature 326125:<222: Transcription Factor
  misc_feature: Phenotype: Activates expression of the gene endogenous to the AtPES (SEQ ID NO 4142) regalutory region Useful for modulating Terpenoid Biosynthesis
  misc_feature: Phenotype: ROSETTE LEAVES - Curled 5 Useful for making ornamental plants with altered leaf shape
  misc_feature (1)..(206): Functional Homolog of  Ceres CLONE ID no. 331626 at SEQ ID NO. 2963 with e-value of 8.40E-53 and BLAST sequence identity of 58.8
MARGKVQLRRIENHVHRQVTFCKRRAGLLKKAKELSVLCDAEIGVVIFSAHGKLYELATKGTMQGLIERYMKSSRGAQPEPAAMETQPAPDLDTKEEINMLKQEIEVLQKGLRYMFGARAAAEMSLDELLVLEKHLEIWIYQIRSTKMDIMFKEIQQLRNKEEILTAANQHLHNKVEENAEITNFVSVTSDFPHPLTIQNEIIFQY

SEQ ID NO: 2919 - protein, 297 aa, Zea mays
  misc_feature (1)..(297): Ceres CLONE ID no. 333416
  misc_feature (1)..(297): Also Known As Ceres CDNA ID no. 23767681
  misc_feature (1)..(297): Also Known As Ceres GEMINI ID 538H6
  misc_feature (61)..(105): Pfam Name: G-patch Pfam Description: G-patch domain
  misc_feature 326224:<222: Transcription Factor
  misc_feature: Phenotype: Activates expression of the gene endogenous to the AtATTPS3 (SEQ ID NO 4165) regalutory region Useful for modulating Terpenoid Biosynthesis
MESKQWGKTPQEVVGAGGGRQVDLDEEDDLEEFRLPMGHRPTENLDTEGLQQASVYTQLTASNVGFRLLQKMGWKTGKGLGKNEQGILEPIRADMRDAKLGVGKQEEDDFFTSEENVQRKKLNIELEETEEHIKKREVIAEREHKIRSEVKEIQKVFFCNLCNKQYKLAHEFESHLSSYDHNHRKRFKEMREMQSSSGSRDDRQKREQQREEKELAKIAQLADAHRKQQKDKQEKSETEDAAPKNMAASSNQDQRQTLKFGFSKMAPSKVLVGSASKKPKVATKVSSVFGNESDEDS

SEQ ID NO: 2920 - DNA, 888 bp, Populus balsamifera subsp. trichocarpa; identical to SEQ ID NO: 2294
  misc_feature (1)..(888): Ceres ANNOT ID no. 1469082
  misc_feature 326306:<222: Transcription Factor
  misc_feature: Phenotype: Activates expression of the gene endogenous to the AtATTPS3 (SEQ ID NO 4165) regalutory region Useful for modulating Terpenoid Biosynthesis

SEQ ID NO: 2921 - protein, 295 aa, Populus balsamifera subsp. trichocarpa; identical to SEQ ID NO: 2295
  misc_feature (1)..(295): Ceres ANNOT ID no. 1469082
  misc_feature (63)..(106): Pfam Name: G-patch Pfam Description: G-patch domain
  misc_feature: SWISSPROT Homolog: CB010_HUMAN Protein C2orf10 with e-value of 2.1e-10 and BLAST sequence identity of 36.9
  misc_feature: SWISSPROT Homolog: AGGF1_MOUSE Angiogenic factor with G patch and FHA domains 1 (Angiogenic factor VG5Q) (mVG5Q) with e-value of 1.1e-06 and BLAST sequence identity of 35.7
  misc_feature: SWISSPROT Homolog: AGGF1_HUMAN Angiogenic factor with G patch and FHA domains 1 (Angiogenic factor VG5Q) (Vasculogenesis gene on 5q) (hVG5Q) with e-value of 1.8e-06 and BLAST sequence identity of 34.0
  misc_feature: SWISSPROT Homolog: DR111_ARATH DNA-damage-repair/toleration protein DRT111, with e-value of 5.5e-06 and BLAST sequence identity of 39.3
  misc_feature: SWISSPROT Homolog: PINX1_MOUSE Pin2-interacting protein X1 (TRF1-interacting protein 1) with e-value of 7.8e-06 and BLAST sequence identity of 34.6
  misc_feature: SWISSPROT Homolog: PINX1_MOUSE Liver-related putative tumor suppressor (LPTS1) 67-11-3 protein
  misc_feature 326412:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(295): Functional Homolog of  Ceres CLONE ID no. 333416 at SEQ ID NO. 2966 with e-value of 2.19E-93 and BLAST sequence identity of 68.75

SEQ ID NO: 2922 - DNA, 876 bp, Populus balsamifera subsp. trichocarpa; identical to SEQ ID NO: 2296
  misc_feature (1)..(876): Ceres ANNOT ID no. 1522474
  misc_feature 326502:<222: Transcription Factor
  misc_feature: Phenotype: Activates expression of the gene endogenous to the AtATTPS3 (SEQ ID NO 4165) regalutory region Useful for modulating Terpenoid Biosynthesis

SEQ ID NO: 2923 - protein, 291 aa, Populus balsamifera subsp. trichocarpa; identical to SEQ ID NO: 2297
  misc_feature (1)..(291): Ceres ANNOT ID no. 1522474
  misc_feature (63)..(106): Pfam Name: G-patch Pfam Description: G-patch domain
  misc_feature: SWISSPROT Homolog: CB010_HUMAN Protein C2orf10 with e-value of 2.1e-10 and BLAST sequence identity of 36.9
  misc_feature: SWISSPROT Homolog: AGGF1_MOUSE Angiogenic factor with G patch and FHA domains 1 (Angiogenic factor VG5Q) (mVG5Q) with e-value of 1.1e-06 and BLAST sequence identity of 35.7
  misc_feature: SWISSPROT Homolog: AGGF1_HUMAN Angiogenic factor with G patch and FHA domains 1 (Angiogenic factor VG5Q) (Vasculogenesis gene on 5q) (hVG5Q) with e-value of 1.8e-06 and BLAST sequence identity of 34.0
  misc_feature: SWISSPROT Homolog: DR111_ARATH DNA-damage-repair/toleration protein DRT111, with e-value of 5.5e-06 and BLAST sequence identity of 39.3
  misc_feature: SWISSPROT Homolog: PINX1_MOUSE Pin2-interacting protein X1 (TRF1-interacting protein 1) with e-value of 7.8e-06 and BLAST sequence identity of 34.6
  misc_feature: SWISSPROT Homolog: PINX1_MOUSE Liver-related putative tumor suppressor (LPTS1) 67-11-3 protein
  misc_feature 326608:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(291): Functional Homolog of  Ceres CLONE ID no. 333416 at SEQ ID NO. 2966 with e-value of 1.20E-90 and BLAST sequence identity of 69.0

SEQ ID NO: 2924 - protein, 127 aa, Zea mays
  misc_feature (1)..(127): Ceres CLONE ID no. 333753
  misc_feature (1)..(127): Also Known As Ceres CDNA ID no. 24385563
  misc_feature (1)..(127): Also Known As Ceres GEMINI ID 538C6
  misc_feature (28)..(97): Pfam Name: HMG_box Pfam Description: HMG (high mobility group) box
  misc_feature 326718:<222: Transcription Factor
  misc_feature: Phenotype: Activates expression of the gene endogenous to the AtHMGS (SEQ ID NO 4144) regalutory region Useful for modulating Terpenoid Biosynthesis
MKSRARSGGGDSRLSVRKTKVEKDPNKPKRPPTTFFVFMEEFRKDYKEKHPNVKQVSVIGKAGGDMWKSLSDAEKAPYVSKAEKLKVEYTKKMDAYNNKQSGGGPTLSGDSDKSKSEVNDGDEEGDE

SEQ ID NO: 2925 - DNA, 531 bp, Populus balsamifera subsp. trichocarpa; identical to SEQ ID NO: 498
  misc_feature (1)..(531): Ceres ANNOT ID no. 1442401
  misc_feature 326767:<222: Transcription Factor
  misc_feature: Phenotype: Activates expression of the gene endogenous to the AtHMGS (SEQ ID NO 4144) regalutory region Useful for modulating Terpenoid Biosynthesis

SEQ ID NO: 2926 - protein, 176 aa, Populus balsamifera subsp. trichocarpa; identical to SEQ ID NO: 499
  misc_feature (1)..(176): Ceres ANNOT ID no. 1442401
  misc_feature (68)..(137): Pfam Name: HMG_box Pfam Description: HMG (high mobility group) box
  misc_feature: SWISSPROT Homolog: HMGL_IPONI HMG1/2-like protein with e-value of 3.3e-36 and BLAST sequence identity of 59.4
  misc_feature: SWISSPROT Homolog: HMGL_SOYBN HMG1/2-like protein (SB11 protein) with e-value of 3.5e-32 and BLAST sequence identity of 62.2
  misc_feature: SWISSPROT Homolog: MNB1B_MAIZE DNA-binding protein MNB1B (HMG1-like protein) with e-value of 7.3e-32 and BLAST sequence identity of 53.7
  misc_feature: SWISSPROT Homolog: HMGL_VICFA HMG1/2-like protein with e-value of 6.8e-29 and BLAST sequence identity of 55.9
  misc_feature: SWISSPROT Homolog: HMGL_WHEAT HMG1/2-like protein with e-value of 7.8e-28 and BLAST sequence identity of 47.9
  misc_feature 326853:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(176): Functional Homolog of  Ceres CLONE ID no. 333753 at SEQ ID NO. 2971 with e-value of 3.80E-34 and BLAST sequence identity of 61.5

SEQ ID NO: 2927 - DNA, 426 bp, Populus balsamifera subsp. trichocarpa; identical to SEQ ID NO: 500
  misc_feature (1)..(426): Ceres ANNOT ID no. 1506142
  misc_feature 326922:<222: Transcription Factor
  misc_feature: Phenotype: Activates expression of the gene endogenous to the AtHMGS (SEQ ID NO 4144) regalutory region Useful for modulating Terpenoid Biosynthesis

SEQ ID NO: 2928 - protein, 141 aa, Populus balsamifera subsp. trichocarpa; identical to SEQ ID NO: 501
  misc_feature (1)..(141): Ceres ANNOT ID no. 1506142
  misc_feature (44)..(104): Pfam Name: HMG_box Pfam Description: HMG (high mobility group) box
  misc_feature: SWISSPROT Homolog: HMGL_IPONI HMG1/2-like protein with e-value of 3.3e-36 and BLAST sequence identity of 59.4
  misc_feature: SWISSPROT Homolog: HMGL_SOYBN HMG1/2-like protein (SB11 protein) with e-value of 3.5e-32 and BLAST sequence identity of 62.2
  misc_feature: SWISSPROT Homolog: MNB1B_MAIZE DNA-binding protein MNB1B (HMG1-like protein) with e-value of 7.3e-32 and BLAST sequence identity of 53.7
  misc_feature: SWISSPROT Homolog: HMGL_VICFA HMG1/2-like protein with e-value of 6.8e-29 and BLAST sequence identity of 55.9
  misc_feature: SWISSPROT Homolog: HMGL_WHEAT HMG1/2-like protein with e-value of 7.8e-28 and BLAST sequence identity of 47.9
  misc_feature 327006:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(141): Functional Homolog of  Ceres CLONE ID no. 333753 at SEQ ID NO. 2971 with e-value of 2.79E-29 and BLAST sequence identity of 60.5

SEQ ID NO: 2929 - protein, 475 aa, Zea mays
  misc_feature (1)..(475): Ceres CLONE ID no. 335011
  misc_feature (1)..(475): Also Known As Ceres CDNA ID no. 23768333
  misc_feature (1)..(475): Also Known As Ceres GEMINI ID 538F7
  misc_feature (386)..(442): Pfam Name: RRM_1 Pfam Description: RNA recognition motif. (a.k.a. RRM RBD, or RNP domain)
  misc_feature 327087:<222: Transcription Factor
  misc_feature: Phenotype: Activates expression of the gene endogenous to the AtATTPS3 (SEQ ID NO 4165) regalutory region Useful for modulating Terpenoid Biosynthesis
METSSAPAAATEAGWYVLGPNQEGVGPYALAELREHFANGYFNESTMLWAEGRKEWMPLSSISELHSAVAAKDQSEQDAPDVDDDFEKFQKEVIEAETEVKALKGNDVDQQDDERPATPPDGEEEFTDDDGTIYKWDRTLRAWVPQNDASGSKEDYAVEEMTFAVEEEIFQAPDILGPALEEINNLPESKNKGSDKAEMRGDKKRKSYENPAEKKEANKPPDSWFDLKVNTHVYVTGLPDDVTVEEIVEVFSKCGIIKEDPETKKPRVKIYTDRETGRKKGDALVTYFKEPSVALAVQLLDGTPFRPGGKTHMSVSPAKFEQKGDVFVSKKTDKQKKRKIKKVEDKMLGWGGHDDKKLMIPATVILRHMFTPAELRADEELLPELEADVREECIKFGPVDNVKVCENHPQGVILVRFKDRKDGAKCIEKMNGRWFAGRQIHASEDDGSVNHALIRDYDAEVSRLDRFGQELEEST

SEQ ID NO: 2930 - DNA, 1536 bp, Populus balsamifera subsp. trichocarpa
  misc_feature (1)..(1536): Ceres ANNOT ID no. 1511636
  misc_feature 327202:<222: Transcription Factor
  misc_feature: Phenotype: Activates expression of the gene endogenous to the AtATTPS3 (SEQ ID NO 4165) regalutory region Useful for modulating Terpenoid Biosynthesis
atgtcgtctatgaaggattttgccatggatcaccaaacccagcagcagcagccatactctggtgcaggaaacggccatgatggcagctacaacagggttgcggaagttggatggtttattctaggtgaagatcaacaacaggttggaccttatacgttttctgagctaagtgagcacttcctgaacgggtatctcgtagaaagtacactggtatggtctgaaggaagaagtgaatggcagccactgtcctcattccctgagttcacgtcaggaatatctcaacagggatctgattattccacagcagtgtcacccaacactgatgaggatgagtttgagaaatggaaaagggaggtagaagaggctgaggctgaggctgaggcagaaaggctgaaaaatggatctctttctggcaacactggagatgatcttgggatagacgatcctgacagggttctatcaccaccagatggcgaggatgaattcacagatgatgatgggactacatacaagtgggatggaagcctaagagcctgggttcctcaggataatccttcaagtgtaagtgggcgatttggagtagaagagatgactttccatgaacaagaggaggtgtttctaaatgtaaacgctgctgatgccactttgaaggaagaattcaatgttactgatgaagtagtaggatcacagcttaataacaagaggaaattgcgtgacaagcaagcggacaagaaggatgagcaagctgataaaaaggaagccaataaggctcctgatagttggtttgaattgaaagtcaatacacacgtttatgtaactgggttgcctgacgatgtcactgctgaagaagtggtagaggtattttccaaatgtgggataattaaggaggatcctgaaacaaaaaagccccgagtgaagatttatgttgacaaagagacaagaagagtaaagggagatgctctagttacatatttgaaggaaccctctgtagatttggctgtgcaaattttggatgggacaccattgcgtcctgggggcacaattcctatgtcagtcagccaagccaagtttgaacagagaggggacagatttatatccaaacaaattgacagcaagaagaaaaggaagctgaaaaaggttgaggacaggatccttggttggggtggccgtgatgatgccaaggtgtcaattccagctactgtagttcttcgccacttgttcactctttctgaaatgagggctgatgaaagcttaggttcagaactcgaggtagatgttagagaggaatgtgtgaagcttggtccaatagattccatcaaggtctgtgagaataatccacacggtgttgttttagtgagatttaaggacagaaatgacgctcgaaggtgcatagaattgatgaatggacgatggtttggcggaagagagatacatgctagtgaggatgatgggctaattaatcatgcttcggtccgggatcttgatgaggatgctgctcgcttagagcagtttggtgctgaacttgaagctggctga

SEQ ID NO: 2931 - protein, 503 aa, Populus balsamifera subsp. trichocarpa
  misc_feature (1)..(503): Ceres ANNOT ID no. 1511636
  misc_feature (262)..(336): Pfam Name: RRM_1 Pfam Description: RNA recognition motif. (a.k.a. RRM RBD, or RNP domain)
  misc_feature: SWISSPROT Homolog: UAP2_SCHPO Splicing factor U2AF-associated protein 2 with e-value of 8.3e-40 and BLAST sequence identity of 37.4
  misc_feature: SWISSPROT Homolog: YN26_YEAST Hypothetical 32.3 kDa protein in SEC21-MRPL10 intergenic region with e-value of 1.2e-23 and BLAST sequence identity of 31.5
  misc_feature: SWISSPROT Homolog: EWS_MOUSE RNA-binding protein EWS with e-value of 2.3e-12 and BLAST sequence identity of 40.0
  misc_feature: SWISSPROT Homolog: EWS_HUMAN RNA-binding protein EWS (EWS oncogene) (Ewing sarcoma breakpoint region 1 protein) with e-value of 3.0e-12 and BLAST sequence identity of 40.0
  misc_feature: SWISSPROT Homolog: FUS_BOVIN RNA-binding protein FUS (Pigpen protein) with e-value of 3.1e-11 and BLAST sequence identity of 30.2
  misc_feature 327323:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(503): Functional Homolog of  Ceres CLONE ID no. 335011 at SEQ ID NO. 2976 with e-value of 1.09E-155 and BLAST sequence identity of 62.8
MDHQTQQQQPYSGAGNGHDGSYNRVAEVGWFILGEDQQQVGPYTFSELSEHFLNGYLVESTLVWSEGRSEWQPLSSFPEFTSGISQQGSDYSTAVSPNTDEDEFEKWKREVEEAEAEAEAERLKNGSLSGNTGDDLGIDDPDRVLSPPDGEDEFTDDDGTTYKWDGSLRAWVPQDNPSSVSGRFGVEEMTFHEQEEVFLNVNAADATLKEEFNVTDEVVGSQLNNKRKLRDKQADKKDEQADKKEANKAPDSWFELKVNTHVYVTGLPDDVTAEEVVEVFSKCGIIKEDPETKKPRVKIYVDKETRRVKGDALVTYLKEPSVDLAVQILDGTPLRPGGTIPMSVSQAKFEQRGDRFISKQIDSKKKRKLKKVEDRILGWGGRDDAKVSIPATVVLRHLFTLSEMRADESLGSELEVDVREECVKLGPIDSIKVCENNPHGVVLVRFKDRNDARRCIELMNGRWFGGREIHASEDDGLINHASVRDLDEDAARLEQFGAELEAG

SEQ ID NO: 2932 - DNA, 1647 bp, Populus balsamifera subsp. trichocarpa
  misc_feature (1)..(1647): Ceres ANNOT ID no. 1517906
  misc_feature 327452:<222: Transcription Factor
  misc_feature: Phenotype: Activates expression of the gene endogenous to the AtATTPS3 (SEQ ID NO 4165) regalutory region Useful for modulating Terpenoid Biosynthesis
atgtcgtctctgaaagattcatccgtcgatctccaaacccagcagcaacaacaaccatactccggtgctggaaatggctatgatggcaattacaacacagttgcggaagttggatggtatatactaggtgaagatcaacaacaggtcggaccttatgtgttttctgagctacgtgagcatttcttgaatgggtatctcttagaaagtacacttgtatggtccgaaggaagaagtgactggcagccattgtcctcaatccctgagttgatgtcaggaacttctcaacagggatctgattattccagagcagtgtcttccaacgatgatgaagatgagtttgagaaatggcaaagggaggtaaaagaggcagaagctgaggcagaaaggttaaaaaatggatctcttccaggcaacactggagacgatttcgggatagatgattctgataggattctgtcaccaccagatggtgaggatgaattcacagatgatgatgggactacatacaagtgggatagaagccttagggcctgggttcctcagatcgagaagagtattgctgagggatatgaagtggctagggatagcattgctgaattcttgggttgcgggcttgatgaatggcctaaaagtgtatcggatttccagtgcagggcaattgataatctatcaagtgtaagtgggcagtatggggtagaacagatgactttccatgaacaagaggaggtatttctgaatgtaaatgctgctgatgcctctttgaaggatgaagccaatggtactggtgaagtagtagaatcacaacgtagtgacaagaggaaattacaggatgagcaagctgataaggacaagcaagctgataagaaggaagccaataaggcccctgatagttggtttgaattgaaagtcaatacgcatgtttatgtaactgggttgcccgatgatgtcactgccgaagaagtggtagaggtattttccaagtgtggggtaattaaggaggatcctgaaaaaaaaaagcctcgcgtgaagatctacgttgacaaagagactggaagaataaagggagatgctctagttacatatttgaaggaaccctcagttgatttggctatgcaaattttggatgggacacctttgcgtcccgggggcacaattcctatgtcggtcacccaagccaagtttgagcagaaaggggacagatttataaccaaacaagtagacagcaagaagaaaaggaagctgaaaaaggttgaggacaggatacttggttggggtggccgtgatgatgccaaggtgtcaattccagctactgtagttcttcgccaaatgttcactctttctgaaatgagggctgatgaaagcttacgttcagaacttgaggtagatgttagagaggaatgtgcgaagcttggtccagttgattctgtcaaggtctgtgagaataatccacatggtgttgttttagtgaaatttaaagacagaaaggatgctcaaagttgcatagaattgatgaatgggcgatggtttggcggaagacaggtagatgctagcgaggatgacggattaattaatcatgctttggtccgggatcatgatgaggatgcagctcgattggagcagtttggtgctgaacttgaagctgactga

SEQ ID NO: 2933 - protein, 548 aa, Populus balsamifera subsp. trichocarpa
  misc_feature (1)..(548): Ceres ANNOT ID no. 1517906
  misc_feature (460)..(516): Pfam Name: RRM_1 Pfam Description: RNA recognition motif. (a.k.a. RRM RBD, or RNP domain)
  misc_feature: SWISSPROT Homolog: UAP2_SCHPO Splicing factor U2AF-associated protein 2 with e-value of 8.3e-40 and BLAST sequence identity of 37.4
  misc_feature: SWISSPROT Homolog: YN26_YEAST Hypothetical 32.3 kDa protein in SEC21-MRPL10 intergenic region with e-value of 1.2e-23 and BLAST sequence identity of 31.5
  misc_feature: SWISSPROT Homolog: EWS_MOUSE RNA-binding protein EWS with e-value of 2.3e-12 and BLAST sequence identity of 40.0
  misc_feature: SWISSPROT Homolog: EWS_HUMAN RNA-binding protein EWS (EWS oncogene) (Ewing sarcoma breakpoint region 1 protein) with e-value of 3.0e-12 and BLAST sequence identity of 40.0
  misc_feature: SWISSPROT Homolog: FUS_BOVIN RNA-binding protein FUS (Pigpen protein) with e-value of 3.1e-11 and BLAST sequence identity of 30.2
  misc_feature 327577:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(548): Functional Homolog of  Ceres CLONE ID no. 335011 at SEQ ID NO. 2976 with e-value of 1.39E-148 and BLAST sequence identity of 64.0
MSSLKDSSVDLQTQQQQQPYSGAGNGYDGNYNTVAEVGWYILGEDQQQVGPYVFSELREHFLNGYLLESTLVWSEGRSDWQPLSSIPELMSGTSQQGSDYSRAVSSNDDEDEFEKWQREVKEAEAEAERLKNGSLPGNTGDDFGIDDSDRILSPPDGEDEFTDDDGTTYKWDRSLRAWVPQIEKSIAEGYEVARDSIAEFLGCGLDEWPKSVSDFQCRAIDNLSSVSGQYGVEQMTFHEQEEVFLNVNAADASLKDEANGTGEVVESQRSDKRKLQDEQADKDKQADKKEANKAPDSWFELKVNTHVYVTGLPDDVTAEEVVEVFSKCGVIKEDPEKKKPRVKIYVDKETGRIKGDALVTYLKEPSVDLAMQILDGTPLRPGGTIPMSVTQAKFEQKGDRFITKQVDSKKKRKLKKVEDRILGWGGRDDAKVSIPATVVLRQMFTLSEMRADESLRSELEVDVREECAKLGPVDSVKVCENNPHGVVLVKFKDRKDAQSCIELMNGRWFGGRQVDASEDDGLINHALVRDHDEDAARLEQFGAELEAD

SEQ ID NO: 2934 - protein, 249 aa, Zea mays
  misc_feature (1)..(249): Ceres CLONE ID no. 335471
  misc_feature (1)..(249): Also Known As Ceres CDNA ID no. 23778718
  misc_feature (1)..(249): Also Known As Ceres GEMINI ID 538D8
  misc_feature (197)..(237): Pfam Name: zf-C3HC4 Pfam Description: Zinc finger, C3HC4 type (RING finger)
  misc_feature 327735:<222: Transcription Factor
  misc_feature: Phenotype: Activates expression of the gene endogenous to the AtHMGS (SEQ ID NO 4144) regalutory region Useful for modulating Terpenoid Biosynthesis
MTSSRQMELHYINTGFPYTITESFMDFFEGLTYAHADFALMDGFQDQGNPYWTMMHTNSYKYGYSGSGNYYSYAHAYDIDDYMHRTDGGRRTWDNTTPVNNVDSANVVLQGGEAPRTTANTTSEDCIQQVHQSPGSPQVVWQDNIDPDNMTYEELLDLGEAVGTQSRGLSQECISLLPITKYKCGFFSRKKTRRERCVICQMEYRRGNLQITLPCKHVYHASCVTRWLSINKVCPVCFAEVPGEDSLRQ

SEQ ID NO: 2935 - DNA, 747 bp, Populus balsamifera subsp. trichocarpa
  misc_feature (1)..(747): Ceres ANNOT ID no. 1514745
  misc_feature 327808:<222: Transcription Factor
  misc_feature: Phenotype: Activates expression of the gene endogenous to the AtHMGS (SEQ ID NO 4144) regalutory region Useful for modulating Terpenoid Biosynthesis
atgaatgggaacagacaaatggaggtgcattatataaacaccggctttccttacaccaccactgaaagctttatggatttctttgaaggactaacacatgctcctgtaaattatgctcacactggaccaatgcatgatcaggacagtgcatactggccaatgaacatgaatgcatacaaatttggattttctggtcctgggagtacttcttactacagcccatacgaggtaaatgataatttacccatcatggatatcagcaggacagcttgggaatacccttctgtagtgaacgctgaagaacccacaaccacagacactcagtttgaaggagatgaggacatgggagtacacgccatgcacgaagaaagaagcatttctaatcagccaagcgccaacagtccccaggctgtttggcaagatgatgtcgatccagataacatgacgtatgaggaattgctcgacctaggtgatactgttggaacgcaaagtaaaggtctttctccggaactaatcaggttgcttccaacctcaaaatgcaagttcggaagcttcttctcaagaaaaaaatctggggaaagagacagatgtgtaatttgccagatgaaatacaaaagaggggataagcagacaaaacttatgtgcaaacatgtttaccattccgaatgtatcgctaaatggcttggcatcaataaggtatgccctgtttgcaacaatgaggtgcttggagagcattcaaggaactaa

SEQ ID NO: 2936 - protein, 248 aa, Populus balsamifera subsp. trichocarpa
  misc_feature (1)..(248): Ceres ANNOT ID no. 1514745
  misc_feature (197)..(237): Pfam Name: zf-C3HC4 Pfam Description: Zinc finger, C3HC4 type (RING finger)
  misc_feature: SWISSPROT Homolog: RNF38_HUMAN RING finger protein 38 with e-value of 4.7e-11 and BLAST sequence identity of 35.4
  misc_feature: SWISSPROT Homolog: RNF38_MOUSE RING finger protein 38 with e-value of 4.8e-11 and BLAST sequence identity of 35.4
  misc_feature: SWISSPROT Homolog: ATL4A_ARATH Putative RING-H2 finger protein ATL4A with e-value of 1.2e-08 and BLAST sequence identity of 36.8
  misc_feature: SWISSPROT Homolog: ATL1Q_ARATH RING-H2 finger protein ATL1Q with e-value of 2.6e-08 and BLAST sequence identity of 34.7
  misc_feature: SWISSPROT Homolog: RNF12_HUMAN RING finger protein 12 LIM domain-interacting RING finger protein with e-value of 4.2e-08 and BLAST sequence identity of 41.2
  misc_feature: SWISSPROT Homolog: RNF12_HUMAN RING finger LIM domain-binding protein (R-LIM) NY-REN-43 antigen
  misc_feature 327909:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(248): Functional Homolog of  Ceres CLONE ID no. 335471 at SEQ ID NO. 2981 with e-value of 4.30E-65 and BLAST sequence identity of 54.9
MNGNRQMEVHYINTGFPYTTTESFMDFFEGLTHAPVNYAHTGPMHDQDSAYWPMNMNAYKFGFSGPGSTSYYSPYEVNDNLPIMDISRTAWEYPSVVNAEEPTTTDTQFEGDEDMGVHAMHEERSISNQPSANSPQAVWQDDVDPDNMTYEELLDLGDTVGTQSKGLSPELIRLLPTSKCKFGSFFSRKKSGERDRCVICQMKYKRGDKQTKLMCKHVYHSECIAKWLGINKVCPVCNNEVLGEHSRN

SEQ ID NO: 2937 - DNA, 717 bp, Populus balsamifera subsp. trichocarpa
  misc_feature (1)..(717): Ceres ANNOT ID no. 1493080
  misc_feature 327990:<222: Transcription Factor
  misc_feature: Phenotype: Activates expression of the gene endogenous to the AtHMGS (SEQ ID NO 4144) regalutory region Useful for modulating Terpenoid Biosynthesis
atgaatgggaatagacaaatggaagtgcattatatgaacaccgactttccttacactaccactgaaagctttatggatttctttgaaggactaactcatgctccagtaaattatgctcacaatggaccaatgcatgatcaggacaatgcatattggtcaatgaatatgaatgcatacaaatttggattttctggtctggggagtacttcttactatagtccatatgaggtaaatgataatttaccaagaatggatgtgagcaggatggcttgggaatacccttcagtagtgagtgctgaagagcccacaaccacagacacacagtttgaaggagatgcgaacatgggagtgcatgccatacctgaagaaagcatttcaaatcaggctctttggcaagatgatgttgatccagataccatgacatatgaggaattggtcgacctaggtgagactgttggaactcaaagtaagggtctatctcctgagcttatcagcttgcttccaacctcaaaatgcaagtttggaagcttcttctcaagaaaaagatctggggaaagatgtgtaatttgccagatgaaatataaaagaggggataagcaaataaaactgttgtgcaaacatgcttaccattctgaatgtattaccaaatggcttggcatcaataaggtatgtcctgtttgcaacgatgaggtatttggagaggaatcacggaattaa

SEQ ID NO: 2938 - protein, 238 aa, Populus balsamifera subsp. trichocarpa
  misc_feature (1)..(238): Ceres ANNOT ID no. 1493080
  misc_feature (187)..(227): Pfam Name: zf-C3HC4 Pfam Description: Zinc finger, C3HC4 type (RING finger)
  misc_feature: SWISSPROT Homolog: RNF38_HUMAN RING finger protein 38 with e-value of 4.7e-11 and BLAST sequence identity of 35.4
  misc_feature: SWISSPROT Homolog: RNF38_MOUSE RING finger protein 38 with e-value of 4.8e-11 and BLAST sequence identity of 35.4
  misc_feature: SWISSPROT Homolog: ATL4A_ARATH Putative RING-H2 finger protein ATL4A with e-value of 1.2e-08 and BLAST sequence identity of 36.8
  misc_feature: SWISSPROT Homolog: ATL1Q_ARATH RING-H2 finger protein ATL1Q with e-value of 2.6e-08 and BLAST sequence identity of 34.7
  misc_feature: SWISSPROT Homolog: RNF12_HUMAN RING finger protein 12 LIM domain-interacting RING finger protein with e-value of 4.2e-08 and BLAST sequence identity of 41.2
  misc_feature: SWISSPROT Homolog: RNF12_HUMAN RING finger LIM domain-binding protein (R-LIM) NY-REN-43 antigen
  misc_feature 328089:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(238): Functional Homolog of  Ceres CLONE ID no. 335471 at SEQ ID NO. 2981 with e-value of 6.30E-64 and BLAST sequence identity of 57.3
MNGNRQMEVHYMNTDFPYTTTESFMDFFEGLTHAPVNYAHNGPMHDQDNAYWSMNMNAYKFGFSGLGSTSYYSPYEVNDNLPRMDVSRMAWEYPSVVSAEEPTTTDTQFEGDANMGVHAIPEESISNQALWQDDVDPDTMTYEELVDLGETVGTQSKGLSPELISLLPTSKCKFGSFFSRKRSGERCVICQMKYKRGDKQIKLLCKHAYHSECITKWLGINKVCPVCNDEVFGEESRN

SEQ ID NO: 2939 - DNA, 729 bp, Populus balsamifera subsp. trichocarpa
  misc_feature (1)..(729): Ceres ANNOT ID no. 1461474
  misc_feature 328167:<222: Transcription Factor
  misc_feature: Phenotype: Activates expression of the gene endogenous to the AtHMGS (SEQ ID NO 4144) regalutory region Useful for modulating Terpenoid Biosynthesis
atggaggtgcattatataaacaccggctttccttacaccaccactgaaagctttatggatttctttgaaggactaacacatgctcctgtaaattatgctcacactggaccaatgcatgatcaggacagtgcatactggccaatgaacatgaatgcatacaaatttggattttctggtcctgggagtacttcttactacagcccatacgaggtaaatgataatttacccatcatggatatcagcaggacagcttgggaatacccttctgtagtgaacgctgaagaacccacaaccacagacactcagtttgaaggagatgaggacatgggagtacacgccatgcacgaagaaagaagcatttctaatcagccaagcgccaacagtccccaggctgtttggcaagatgatgtcgatccagataacatgacgtatgaggaattgctcgacctaggtgatactgttggaacgcaaagtaaaggtctttctccggaactaatcaggttgcttccaacctcaaaatgcaagttcggaagcttcttctcaagaaaaaaatctggggaaagagacagatgtgtaatttgccagatgaaatacaaaagaggggataagcagacaaaacttatgtgcaaacatgtttaccattccgaatgtatcgctaaatggcttggcatcaataaggtatgccctgtttgcaacaatgaggtgcttggagagcattcaaggaactaa

SEQ ID NO: 2940 - protein, 242 aa, Populus balsamifera subsp. trichocarpa
  misc_feature (1)..(242): Ceres ANNOT ID no. 1461474
  misc_feature (191)..(231): Pfam Name: zf-C3HC4 Pfam Description: Zinc finger, C3HC4 type (RING finger)
  misc_feature: SWISSPROT Homolog: RNF38_HUMAN RING finger protein 38 with e-value of 4.7e-11 and BLAST sequence identity of 35.4
  misc_feature: SWISSPROT Homolog: RNF38_MOUSE RING finger protein 38 with e-value of 4.8e-11 and BLAST sequence identity of 35.4
  misc_feature: SWISSPROT Homolog: ATL4A_ARATH Putative RING-H2 finger protein ATL4A with e-value of 1.2e-08 and BLAST sequence identity of 36.8
  misc_feature: SWISSPROT Homolog: ATL1Q_ARATH RING-H2 finger protein ATL1Q with e-value of 2.6e-08 and BLAST sequence identity of 34.7
  misc_feature: SWISSPROT Homolog: RNF12_HUMAN RING finger protein 12 LIM domain-interacting RING finger protein with e-value of 4.2e-08 and BLAST sequence identity of 41.2
  misc_feature: SWISSPROT Homolog: RNF12_HUMAN RING finger LIM domain-binding protein (R-LIM) NY-REN-43 antigen
  misc_feature 328268:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(242): Functional Homolog of  Ceres CLONE ID no. 335471 at SEQ ID NO. 2981 with e-value of 2.09E-63 and BLAST sequence identity of 55.0
MEVHYINTGFPYTTTESFMDFFEGLTHAPVNYAHTGPMHDQDSAYWPMNMNAYKFGFSGPGSTSYYSPYEVNDNLPIMDISRTAWEYPSVVNAEEPTTTDTQFEGDEDMGVHAMHEERSISNQPSANSPQAVWQDDVDPDNMTYEELLDLGDTVGTQSKGLSPELIRLLPTSKCKFGSFFSRKKSGERDRCVICQMKYKRGDKQTKLMCKHVYHSECIAKWLGINKVCPVCNNEVLGEHSRN

SEQ ID NO: 2941 - DNA, 699 bp, Populus balsamifera subsp. trichocarpa
  misc_feature (1)..(699): Ceres ANNOT ID no. 1440205
  misc_feature 328349:<222: Transcription Factor
  misc_feature: Phenotype: Activates expression of the gene endogenous to the AtHMGS (SEQ ID NO 4144) regalutory region Useful for modulating Terpenoid Biosynthesis
atggaagtgcattatatgaacaccgactttccttacactaccactgaaagctttatggatttctttgaaggactaactcatgctccagtaaattatgctcacaatggaccaatgcatgatcaggacaatgcatattggtcaatgaatatgaatgcatacaaatttggattttctggtctggggagtacttcttactatagtccatatgaggtaaatgataatttaccaagaatggatgtgagcaggatggcttgggaatacccttcagtagtgagtgctgaagagcccacaaccacagacacacagtttgaaggagatgcgaacatgggagtgcatgccatacctgaagaaagcatttcaaatcaggctctttggcaagatgatgttgatccagataccatgacatatgaggaattggtcgacctaggtgagactgttggaactcaaagtaagggtctatctcctgagcttatcagcttgcttccaacctcaaaatgcaagtttggaagcttcttctcaagaaaaagatctggggaaagatgtgtaatttgccagatgaaatataaaagaggggataagcaaataaaactgttgtgcaaacatgcttaccattctgaatgtattaccaaatggcttggcatcaataaggtatgtcctgtttgcaacgatgaggtatttggagaggaatcacggaattaa

SEQ ID NO: 2942 - protein, 232 aa, Populus balsamifera subsp. trichocarpa
  misc_feature (1)..(232): Ceres ANNOT ID no. 1440205
  misc_feature (181)..(221): Pfam Name: zf-C3HC4 Pfam Description: Zinc finger, C3HC4 type (RING finger)
  misc_feature: SWISSPROT Homolog: RNF38_HUMAN RING finger protein 38 with e-value of 4.7e-11 and BLAST sequence identity of 35.4
  misc_feature: SWISSPROT Homolog: RNF38_MOUSE RING finger protein 38 with e-value of 4.8e-11 and BLAST sequence identity of 35.4
  misc_feature: SWISSPROT Homolog: ATL4A_ARATH Putative RING-H2 finger protein ATL4A with e-value of 1.2e-08 and BLAST sequence identity of 36.8
  misc_feature: SWISSPROT Homolog: ATL1Q_ARATH RING-H2 finger protein ATL1Q with e-value of 2.6e-08 and BLAST sequence identity of 34.7
  misc_feature: SWISSPROT Homolog: RNF12_HUMAN RING finger protein 12 LIM domain-interacting RING finger protein with e-value of 4.2e-08 and BLAST sequence identity of 41.2
  misc_feature: SWISSPROT Homolog: RNF12_HUMAN RING finger LIM domain-binding protein (R-LIM) NY-REN-43 antigen
  misc_feature 328448:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(232): Functional Homolog of  Ceres CLONE ID no. 335471 at SEQ ID NO. 2981 with e-value of 3.09E-62 and BLAST sequence identity of 57.5
MEVHYMNTDFPYTTTESFMDFFEGLTHAPVNYAHNGPMHDQDNAYWSMNMNAYKFGFSGLGSTSYYSPYEVNDNLPRMDVSRMAWEYPSVVSAEEPTTTDTQFEGDANMGVHAIPEESISNQALWQDDVDPDTMTYEELVDLGETVGTQSKGLSPELISLLPTSKCKFGSFFSRKRSGERCVICQMKYKRGDKQIKLLCKHAYHSECITKWLGINKVCPVCNDEVFGEESRN

SEQ ID NO: 2943 - DNA, 750 bp, Populus balsamifera subsp. trichocarpa
  misc_feature (1)..(750): Ceres ANNOT ID no. 1501185
  misc_feature 328526:<222: Transcription Factor
  misc_feature: Phenotype: Activates expression of the gene endogenous to the AtHMGS (SEQ ID NO 4144) regalutory region Useful for modulating Terpenoid Biosynthesis
atgaattggaatacactcatggacggtcattccatgaatgctagctacccatataattcagctggaagttttattgaatatttcgaaggtctcacgtatgaccatgtgaatttcattttcaatggagcttcccatgttcaggatagtgtatacccctcgatgaatgcaaatttctacaagtttggcttatccccaccagggagcgcttcatattatgaccctgcttatgtctatgaggtctacaatcatggactacgaaatgaagaatatagaaggccgccctcggagaattcttctacagcaactaatgaacggacttctagagtaaatactgaatgggaagtaaatgaaaacaggtcttctcatgatgaccctgtagaatgtttgcgcagacatcataatgttcaggattatcaggctatttggcaagaccatgttgatcctgacaatatgacttatgaggaattacttgaattaggcgagacagttggaactcaaaatcgaggtctttctcaagaacaaatttctctgcttccaacctcaaaatacaagcgcagcttcttctcaaggaggaaatcaagaagtgagaggtgtgtcatttgccaaatggaatataagcgaggtgatcgtcagatcactctaccatgcaaacatatttaccatgctggttgcgggaccagatggcttagcatcaataaggcctgccccatctgctactcagaggtttttggtgatgcatcaaaacattaa

SEQ ID NO: 2944 - protein, 243 aa, Populus balsamifera subsp. trichocarpa
  misc_feature (1)..(243): Ceres ANNOT ID no. 1501185
  misc_feature (192)..(232): Pfam Name: zf-C3HC4 Pfam Description: Zinc finger, C3HC4 type (RING finger)
  misc_feature: SWISSPROT Homolog: RNF38_HUMAN RING finger protein 38 with e-value of 4.7e-11 and BLAST sequence identity of 35.4
  misc_feature: SWISSPROT Homolog: RNF38_MOUSE RING finger protein 38 with e-value of 4.8e-11 and BLAST sequence identity of 35.4
  misc_feature: SWISSPROT Homolog: ATL4A_ARATH Putative RING-H2 finger protein ATL4A with e-value of 1.2e-08 and BLAST sequence identity of 36.8
  misc_feature: SWISSPROT Homolog: ATL1Q_ARATH RING-H2 finger protein ATL1Q with e-value of 2.6e-08 and BLAST sequence identity of 34.7
  misc_feature: SWISSPROT Homolog: RNF12_HUMAN RING finger protein 12 LIM domain-interacting RING finger protein with e-value of 4.2e-08 and BLAST sequence identity of 41.2
  misc_feature: SWISSPROT Homolog: RNF12_HUMAN RING finger LIM domain-binding protein (R-LIM) NY-REN-43 antigen
  misc_feature 328627:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(243): Functional Homolog of  Ceres CLONE ID no. 335471 at SEQ ID NO. 2981 with e-value of 3.20E-60 and BLAST sequence identity of 49.1
MDGHSMNASYPYNSAGSFIEYFEGLTYDHVNFIFNGASHVQDSVYPSMNANFYKFGLSPPGSASYYDPAYVYEVYNHGLRNEEYRRPPSENSSTATNERTSRVNTEWEVNENRSSHDDPVECLRRHHNVQDYQAIWQDHVDPDNMTYEELLELGETVGTQNRGLSQEQISLLPTSKYKRSFFSRRKSRSERCVICQMEYKRGDRQITLPCKHIYHAGCGTRWLSINKACPICYSEVFGDASKH

SEQ ID NO: 2945 - DNA, 849 bp, Populus balsamifera subsp. trichocarpa
  misc_feature (1)..(849): Ceres ANNOT ID no. 1437922
  misc_feature 328708:<222: Transcription Factor
  misc_feature: Phenotype: Activates expression of the gene endogenous to the AtHMGS (SEQ ID NO 4144) regalutory region Useful for modulating Terpenoid Biosynthesis
atggagggtcattacatgaaccctagctacccatataattcggctggaagtttcattgaatatttcgaaggtctcacgtatgaccatgtgaatttcattttcaatggaggttcccacgctcagatgatggagcaattagtaggttgtggttttgttcttgtacaaatgaccttcttgcatttacaggatatcgtatacccctcgacaaatgcaaatttctacaagttcggcatatccccaccagggagcacttcatattatgaccctactcatatttatgaggtccatgataatggactacggaatgaagaatatggaaggcccttggagaattcttctacaacgactaatgaacagacttccagagtaaatacagaatgggaagtaaatgaaaacaggacttctcatgatgaccctgtagaatgtttgcgcagacatcataatgttcaggattatcaggtgtgtttcatacagaactatgtagtccttaggaaaaggccatgtttagagaatcatgctatttggcaagacaacgttgatccagacagtatgacttatgaggaattacttgaattaggcgagacagttggcacccaaaatcgaggtcttacccaagagctcatttctttgcttccaatctcaaaatacaatcgcagcttcttctcaaggaggaattcaagaagcgagaggtgtgtgatttgccaaatggaatataagcgaggtgatcgccggatcactctaccatgcaaacatatctaccatgctggttgcgggaccagatggctttgcatcaataaggcttgccccatttgctacactgaggtttttggcgatgcatcaagacattaa

SEQ ID NO: 2946 - protein, 282 aa, Populus balsamifera subsp. trichocarpa
  misc_feature (1)..(282): Ceres ANNOT ID no. 1437922
  misc_feature (231)..(271): Pfam Name: zf-C3HC4 Pfam Description: Zinc finger, C3HC4 type (RING finger)
  misc_feature: SWISSPROT Homolog: RNF38_HUMAN RING finger protein 38 with e-value of 4.7e-11 and BLAST sequence identity of 35.4
  misc_feature: SWISSPROT Homolog: RNF38_MOUSE RING finger protein 38 with e-value of 4.8e-11 and BLAST sequence identity of 35.4
  misc_feature: SWISSPROT Homolog: ATL4A_ARATH Putative RING-H2 finger protein ATL4A with e-value of 1.2e-08 and BLAST sequence identity of 36.8
  misc_feature: SWISSPROT Homolog: ATL1Q_ARATH RING-H2 finger protein ATL1Q with e-value of 2.6e-08 and BLAST sequence identity of 34.7
  misc_feature: SWISSPROT Homolog: RNF12_HUMAN RING finger protein 12 LIM domain-interacting RING finger protein with e-value of 4.2e-08 and BLAST sequence identity of 41.2
  misc_feature: SWISSPROT Homolog: RNF12_HUMAN RING finger LIM domain-binding protein (R-LIM) NY-REN-43 antigen
  misc_feature 328813:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(282): Functional Homolog of  Ceres CLONE ID no. 335471 at SEQ ID NO. 2981 with e-value of 1.40E-52 and BLAST sequence identity of 50.0
MEGHYMNPSYPYNSAGSFIEYFEGLTYDHVNFIFNGGSHAQMMEQLVGCGFVLVQMTFLHLQDIVYPSTNANFYKFGISPPGSTSYYDPTHIYEVHDNGLRNEEYGRPLENSSTTTNEQTSRVNTEWEVNENRTSHDDPVECLRRHHNVQDYQVCFIQNYVVLRKRPCLENHAIWQDNVDPDSMTYEELLELGETVGTQNRGLTQELISLLPISKYNRSFFSRRNSRSERCVICQMEYKRGDRRITLPCKHIYHAGCGTRWLCINKACPICYTEVFGDASRH

SEQ ID NO: 2947 - protein, 315 aa, Zea mays
  misc_feature (1)..(315): Ceres CLONE ID no. 336323
  misc_feature (1)..(315): Also Known As Ceres CDNA ID no. 23764214
  misc_feature (1)..(315): Also Known As Ceres GEMINI ID 538D9
  misc_feature (106)..(161): Pfam Name: KNOX2 Pfam Description: KNOX2 domain
  misc_feature (219)..(240): Pfam Name: ELK Pfam Description: ELK domain
  misc_feature (51)..(95): Pfam Name: KNOX1 Pfam Description: KNOX1 domain
  misc_feature 328932:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
MQGGGGDQAGGSLGMGMGVGYAGGGGAECSSSSVAAAAAAAAAAAEAEERQLLKGEIAVHPLCEQLVAAHVGCLRVATPIDHLPLIDAQLAQSSGLLHSYAAHHSPFLSPHDKHDLDSFLAQYLMLLCSFREQLQQHVRVHAVEAVMACREIEQSLQDLTGVTLEEGTGATMSEEDEDEAPMLEVGLVDMGSDGHDMMGFGPLLPTDSERSLMDRVRQELKIELKQGFKSRIEDVREEILRKRRAGKLPGDTTSILKQWWQQHSKWPYPTEDDKARLVEETGLQLKQINNWFINQRKRNWHNNSQTSTLKSKRKR

SEQ ID NO: 2948 - DNA, 999 bp, Populus balsamifera subsp. trichocarpa
  misc_feature (1)..(999): Ceres ANNOT ID no. 1491629
  misc_feature 329018:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
atgcaagaaccaaacttgggcatgatgggaagtggaagtgggggtgcacttggtggtttaagcagtggagagatgtctgtgtctttatcaggtgatcagtctcgccaactcaaggcagaaatagctacacaccctttatatgagcagctattatcagctcacgtgtcttgccttcgtgtagctacaccaattgatcaattacctcttatagatgctcagttatcacaatctcatcatcttcttaggtcttatgcttcacagcacaaccaacatggtcattctctttctccccatgaaaggcaagacctagacaacttcctggcacagtatttgataatattgtgtactttcaaagaccagcttcaacaacatgtcagagtgcacgccgttgaagctgttatggcctgccgtgaaattgagaccaccttacaggctctcactggtgtgactctaggagaaggtacgggtgcaaccatgtctgacgatgaggatgacctgcaaatggatttctctttagatcaatcaagtgctgatgggcatgacatgatgggatttggccctctgcttcctacagaatctgaaaggtctttgatggagagagttcggcaggaactgaagattgaattaaagcagggcttcaaatcaagaattgaagatgtcagggaggagatattgagaaaaagaagggctggaaaactaccgggtgacactacttcagtgctgaagaattggtggcagcaacactccaagtggccttacccaactgaagatgacaaagcaaaacttgtggaggagacagggttacagctaaagcagattaacaattggttcatcaaccaaaggaagaggaactggcacagcaactctcaatcggtgacatccttgaagtccaagcgcaaaagtactttctacttgctaacaaccagttgggaagtaaagaggctgagaccaagagctgccaacgttgaagaagttgcctttggcggtctcgtactttaa

SEQ ID NO: 2949 - protein, 332 aa, Populus balsamifera subsp. trichocarpa
  misc_feature (1)..(332): Ceres ANNOT ID no. 1491629
  misc_feature (204)..(225): Pfam Name: ELK Pfam Description: ELK domain
  misc_feature (35)..(79): Pfam Name: KNOX1 Pfam Description: KNOX1 domain
  misc_feature (93)..(148): Pfam Name: KNOX2 Pfam Description: KNOX2 domain
  misc_feature: SWISSPROT Homolog: HD1_BRANA Homeobox protein HD1 with e-value of 4.4e-105 and BLAST sequence identity of 73.9
  misc_feature: SWISSPROT Homolog: KNAP3_MALDO Homeobox protein knotted-1-like 3 (KNAP3) with e-value of 5.0e-97 and BLAST sequence identity of 69.6
  misc_feature: SWISSPROT Homolog: LET12_LYCES Homeobox protein knotted-1-like LET12 with e-value of 2.2e-94 and BLAST sequence identity of 60.1
  misc_feature: SWISSPROT Homolog: KNAT3_ARATH Homeobox protein knotted-1-like 3 (KNAT3) with e-value of 7.5e-94 and BLAST sequence identity of 62.1
  misc_feature: SWISSPROT Homolog: KNAT4_ARATH Homeobox protein knotted-1-like 4 (KNAT4) with e-value of 1.1e-92 and BLAST sequence identity of 67.9
  misc_feature 329134:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature (1)..(332): Functional Homolog of  Ceres CLONE ID no. 336323 at SEQ ID NO. 2994 with e-value of 2.69E-111 and BLAST sequence identity of 76.9
MQEPNLGMMGSGSGGALGGLSSGEMSVSLSGDQSRQLKAEIATHPLYEQLLSAHVSCLRVATPIDQLPLIDAQLSQSHHLLRSYASQHNQHGHSLSPHERQDLDNFLAQYLIILCTFKDQLQQHVRVHAVEAVMACREIETTLQALTGVTLGEGTGATMSDDEDDLQMDFSLDQSSADGHDMMGFGPLLPTESERSLMERVRQELKIELKQGFKSRIEDVREEILRKRRAGKLPGDTTSVLKNWWQQHSKWPYPTEDDKAKLVEETGLQLKQINNWFINQRKRNWHSNSQSVTSLKSKRKSTFYLLTTSWEVKRLRPRAANVEEVAFGGLVL

SEQ ID NO: 2950 - DNA, 969 bp, Populus balsamifera subsp. trichocarpa
  misc_feature (1)..(969): Ceres ANNOT ID no. 1531927
  misc_feature 329231:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
atggcttttcagctacaacaccaccacctctcagcctcgtcttccaccggtcccccatggctaagcaacgcggtcctccgtaggaacggcgactttataaccatcgaaaaaaccgaaaacaccaccaacaatggaagtgaagaggagttggtagattctgttagtgataactgggagagagctaaatgcaaagctgagatattagggcatcctttttatgaacaattattggctgcacacgtggcttgtttaaggattgcaacgccagttgaccagttggctaggattgatacacagttggctcggtctcaagatgttattgctaagtattctggtgttggttgtggccatgttgttgacgagaaagaacttgatcagttcatgacacattacgctctacttctctgttccttcaaagaccaattgcagcaacatgtccgtgttcatgctatggaggcagtaatggcttgctgggaacttgaacaatctctacaaagtttgactggcgtatctcctggggaaggcactggtgcaactatgtctgatgacgaagatgaccaagcagaaagtgataccaactttaatgatggaaaccttgatgggttggataccatgggatttggtcctctagtccccactgaaactgagaggtccttgatggagcgtgtaaggcaagaattgaagcacgagttcaaacaggattacaaagagaaaattgtggacattagagaggaaattttacgtaagagaagagcagggaaactgccaggtgataccacttcccacttaaaagcttggtggcaaacacattccaagtggccgtacccatctgaggaagacaaagcaagattggtgcaggaaactgggttgcagttaaagcagataaataattggttcataaaccaaaggaaaaggaactggcacagcagcccttcaggatctacctcgaagagcaaacgaaagaagtaa

SEQ ID NO: 2951 - protein, 322 aa, Populus balsamifera subsp. trichocarpa
  misc_feature (1)..(322): Ceres ANNOT ID no. 1531927
  misc_feature (114)..(169): Pfam Name: KNOX2 Pfam Description: KNOX2 domain
  misc_feature (226)..(247): Pfam Name: ELK Pfam Description: ELK domain
  misc_feature (61)..(105): Pfam Name: KNOX1 Pfam Description: KNOX1 domain
  misc_feature: SWISSPROT Homolog: HD1_BRANA Homeobox protein HD1 with e-value of 4.4e-105 and BLAST sequence identity of 73.9
  misc_feature: SWISSPROT Homolog: KNAP3_MALDO Homeobox protein knotted-1-like 3 (KNAP3) with e-value of 5.0e-97 and BLAST sequence identity of 69.6
  misc_feature: SWISSPROT Homolog: LET12_LYCES Homeobox protein knotted-1-like LET12 with e-value of 2.2e-94 and BLAST sequence identity of 60.1
  misc_feature: SWISSPROT Homolog: KNAT3_ARATH Homeobox protein knotted-1-like 3 (KNAT3) with e-value of 7.5e-94 and BLAST sequence identity of 62.1
  misc_feature: SWISSPROT Homolog: KNAT4_ARATH Homeobox protein knotted-1-like 4 (KNAT4) with e-value of 1.1e-92 and BLAST sequence identity of 67.9
  misc_feature 329347:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature (1)..(322): Functional Homolog of  Ceres CLONE ID no. 336323 at SEQ ID NO. 2994 with e-value of 1.09E-89 and BLAST sequence identity of 65.1
MAFQLQHHHLSASSSTGPPWLSNAVLRRNGDFITIEKTENTTNNGSEEELVDSVSDNWERAKCKAEILGHPFYEQLLAAHVACLRIATPVDQLARIDTQLARSQDVIAKYSGVGCGHVVDEKELDQFMTHYALLLCSFKDQLQQHVRVHAMEAVMACWELEQSLQSLTGVSPGEGTGATMSDDEDDQAESDTNFNDGNLDGLDTMGFGPLVPTETERSLMERVRQELKHEFKQDYKEKIVDIREEILRKRRAGKLPGDTTSHLKAWWQTHSKWPYPSEEDKARLVQETGLQLKQINNWFINQRKRNWHSSPSGSTSKSKRKK

SEQ ID NO: 2952 - DNA, 990 bp, Populus balsamifera subsp. trichocarpa
  misc_feature (1)..(990): Ceres ANNOT ID no. 1507861
  misc_feature 329444:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
atggcttttcaagaccaccaccatacaccacaagaaatgacttttcaactaccacaacaccaccacctctcagcctcaccttccaccggtcccacatggctaagcaacgcagtcctccgtagacacgacgacgttttaacccaaacccgcatcgaaaaaccagaaaacaacaccaataatggaagtgaagaggaattgatagattccgttagtgataattgggagagagctaaatgcaaagctgagatattagggcatcccttatatgaacagttattggctgctcacgtggcttgtttaaggattgccacgccagttgaccagttggctaggattgatacacagttggctcagtctcaagatgttgtggctaagtattctggtgttggtaggagccatgttgttgatgagaaagaacttgatcagttcatgacacattacgttatattgctctgttccttcaaagaccaattgcaacaacatgtccgtgttcatgctatggaggctgtaatggcatgctgggaacttgaacagtctctacaaagtttgacaggtgtatctccaggggaaggcactggtgcaactatgtctgatgatgatgacgaccaagcagatagtgatgccaacttgtatgatggaaatcttgatgggttggataccatgggatttggtcctctagttcccaccgagactgagaggtccttgatggagcgtgtaaggcaagaattgaagcatgagctcaaacaggattacaaggagaagattgtggatattagagaggaaattctacgtaagagaagagctggaaaactgccaggtgatactacgtccctcttaaaagcttggtggcaaacacattccaagtggccatacccaactgaaacaggtttgcaattaaagcagataaataattggttcataaaccaaaggaaaaggaactggcacagcagtccttcaggttctacttcgaagagcaaacgaaagaagtaa

SEQ ID NO: 2953 - protein, 317 aa, Populus balsamifera subsp. trichocarpa
  misc_feature (1)..(317): Ceres ANNOT ID no. 1507861
  misc_feature (118)..(173): Pfam Name: KNOX2 Pfam Description: KNOX2 domain
  misc_feature (230)..(251): Pfam Name: ELK Pfam Description: ELK domain
  misc_feature (65)..(109): Pfam Name: KNOX1 Pfam Description: KNOX1 domain
  misc_feature: SWISSPROT Homolog: HD1_BRANA Homeobox protein HD1 with e-value of 4.4e-105 and BLAST sequence identity of 73.9
  misc_feature: SWISSPROT Homolog: KNAP3_MALDO Homeobox protein knotted-1-like 3 (KNAP3) with e-value of 5.0e-97 and BLAST sequence identity of 69.6
  misc_feature: SWISSPROT Homolog: LET12_LYCES Homeobox protein knotted-1-like LET12 with e-value of 2.2e-94 and BLAST sequence identity of 60.1
  misc_feature: SWISSPROT Homolog: KNAT3_ARATH Homeobox protein knotted-1-like 3 (KNAT3) with e-value of 7.5e-94 and BLAST sequence identity of 62.1
  misc_feature: SWISSPROT Homolog: KNAT4_ARATH Homeobox protein knotted-1-like 4 (KNAT4) with e-value of 1.1e-92 and BLAST sequence identity of 67.9
  misc_feature 329560:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature (1)..(317): Functional Homolog of  Ceres CLONE ID no. 336323 at SEQ ID NO. 2994 with e-value of 1.69E-86 and BLAST sequence identity of 67.0
MTFQLPQHHHLSASPSTGPTWLSNAVLRRHDDVLTQTRIEKPENNTNNGSEEELIDSVSDNWERAKCKAEILGHPLYEQLLAAHVACLRIATPVDQLARIDTQLAQSQDVVAKYSGVGRSHVVDEKELDQFMTHYVILLCSFKDQLQQHVRVHAMEAVMACWELEQSLQSLTGVSPGEGTGATMSDDDDDQADSDANLYDGNLDGLDTMGFGPLVPTETERSLMERVRQELKHELKQDYKEKIVDIREEILRKRRAGKLPGDTTSLLKAWWQTHSKWPYPTETGLQLKQINNWFINQRKRNWHSSPSGSTSKSKRKK

SEQ ID NO: 2954 - protein, 271 aa, Zea mays
  misc_feature (1)..(271): Ceres CLONE ID no. 336888
  misc_feature (1)..(271): Also Known As Ceres CDNA ID no. 23767148
  misc_feature (1)..(271): Also Known As Ceres GEMINI ID 538H7
  misc_feature (56)..(101): Pfam Name: zf-C3HC4 Pfam Description: Zinc finger, C3HC4 type (RING finger)
  misc_feature 329674:<222: Transcription Factor
  misc_feature: Phenotype: Activates expression of the gene endogenous to the AtPES (SEQ ID NO 4142) regalutory region Useful for modulating Terpenoid Biosynthesis
MGDHLALIVDRLLTESTLEAAIGGGKHMVDLRQETVDVEYCHRGLGGGSATKVVECRICQEEDWDTCMEAPCACCGSLKYAHRKCIQRWCNEKGDTMCEICLQQFRPGYTSPQQLFHYGSIPMNFRGNWEIARQDLNDSQIITMMPTERDFMDNYDDYFPIRTRSSTLCCRTIAIIFMSLLVLRHTLPLVIGDNGEYSLALFSLLVLRTAGILFPILVMVRALASFHHRRRQQESQEAYISSSESEEEEEEYTVANSAQTNYSQPRFIPVY

SEQ ID NO: 2955 - DNA, 804 bp, Populus balsamifera subsp. trichocarpa
  misc_feature (1)..(804): Ceres ANNOT ID no. 1449337
  misc_feature 329750:<222: Transcription Factor
  misc_feature: Phenotype: Activates expression of the gene endogenous to the AtPES (SEQ ID NO 4142) regalutory region Useful for modulating Terpenoid Biosynthesis
atgggggatcattttgtgttcctggtggatcggttgctaactgaatccacccttgaagctgctattgagagtcaaaaccgattgcggcaaaccatggcttcagcaagtaaagaaaatacaaaagaattttcaccacattggatggatttagaattgacttcattagcaggaaaatcagtagagtgtaggatttgccatgaggaggaggatgacatgaacatggagatgccgtgttcttgccgtggcagtttgaagtatgctcatcgaaaatgtgttcagaggtggtgcaatgagaagggtaacactatctgtgagatctgccatcagcaatttgagcctggttatacagcaccaccccctttgttttgttatggtgctattccaatgaacttcagaggaaattgggagatacccagaagggacctgcacaatcctccatctatagctatggttactactgaccatgaatttttggactctgactttgatgagtattcagcaccctctcctaggagtgtgatgtgctgccgaataattgctattatatttatggttctgttggttttacgtcatactcttgccatcctaattagtggagctggagattactcaatgacattgtttatgttactgatattgagaacagttgggattcttctgcctgtttatgtcatggtcagagcatttactgctattcaacatcggggtcggcagcaggatcctcattttccccttgctgagtcagatgaggaaaatgagttgccgcaacttcagactcattcgcgcattattcatattcagtga

SEQ ID NO: 2956 - protein, 267 aa, Populus balsamifera subsp. trichocarpa
  misc_feature (1)..(267): Ceres ANNOT ID no. 1449337
  misc_feature (62)..(107): Pfam Name: zf-C3HC4 Pfam Description: Zinc finger, C3HC4 type (RING finger)
  misc_feature: SWISSPROT Homolog: MARH2_HUMAN Membrane-associated RING finger protein 2 with e-value of 1.6e-07 and BLAST sequence identity of 36.0
  misc_feature: SWISSPROT Homolog: MARH2_HUMAN Membrane-associated RING-CH protein II MARCH-II (RING finger protein 172)
  misc_feature: SWISSPROT Homolog: MARH2_MOUSE Membrane-associated RING finger protein 2 (Membrane-associated RING-CH protein II) (MARCH-II) with e-value of 4.2e-06 and BLAST sequence identity of 34.0
  misc_feature 329832:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(267): Functional Homolog of  Ceres CLONE ID no. 336888 at SEQ ID NO. 3001 with e-value of 1.09E-68 and BLAST sequence identity of 58.5
MGDHFVFLVDRLLTESTLEAAIESQNRLRQTMASASKENTKEFSPHWMDLELTSLAGKSVECRICHEEEDDMNMEMPCSCRGSLKYAHRKCVQRWCNEKGNTICEICHQQFEPGYTAPPPLFCYGAIPMNFRGNWEIPRRDLHNPPSIAMVTTDHEFLDSDFDEYSAPSPRSVMCCRIIAIIFMVLLVLRHTLAILISGAGDYSMTLFMLLILRTVGILLPVYVMVRAFTAIQHRGRQQDPHFPLAESDEENELPQLQTHSRIIHIQ

SEQ ID NO: 2957 - DNA, 747 bp, Populus balsamifera subsp. trichocarpa
  misc_feature (1)..(747): Ceres ANNOT ID no. 1498512
  misc_feature 329916:<222: Transcription Factor
  misc_feature: Phenotype: Activates expression of the gene endogenous to the AtPES (SEQ ID NO 4142) regalutory region Useful for modulating Terpenoid Biosynthesis
atgggggatcattttgtgttcctggtggatcggttgctaactgaatccacccttgaagctgccattgagagccaaaaccgattgtggcaagctgtgccttctgcaaatatgagttcatcaacaggaatattagaagagtgtagaatttgccatgacgaggatgatgacaaaaacatggagataccatgttcttgccgtggcagtttgaagtatgctcatcggaaatgtgtccagaggtggtgcaacgagaagggtgacattaactgtgagatctgctatcagcaatttgagcctggttatacagctccgcgccctttgtttcgttatggtggtattccaatgaatttcagaggaaattgggagatacccacaagggaattgcatgctcctccatttataccgatgtttactaccgaccgtgaatatttggactctgatttcgaagaagagtatcctttaccctctcctaggagcgtgatgtgctgccgcatagttgctattatatttatggttcttttggttttacgccatacgcttcctatcataattagtggggccggagattactccatgacattgttcatgttaatgatattgagaacagttgggattcttctgcctatttatgtcatggtcagagcatttaccgctatccaacatcggcgccgccagcagcagctgctgctcgagcgcaacctgccagaaatggaagccagaaatgagaagggagaaggatgtccaacatag

SEQ ID NO: 2958 - protein, 248 aa, Populus balsamifera subsp. trichocarpa
  misc_feature (1)..(248): Ceres ANNOT ID no. 1498512
  misc_feature (47)..(92): Pfam Name: zf-C3HC4 Pfam Description: Zinc finger, C3HC4 type (RING finger)
  misc_feature: SWISSPROT Homolog: MARH2_HUMAN Membrane-associated RING finger protein 2 with e-value of 1.6e-07 and BLAST sequence identity of 36.0
  misc_feature: SWISSPROT Homolog: MARH2_HUMAN Membrane-associated RING-CH protein II MARCH-II (RING finger protein 172)
  misc_feature: SWISSPROT Homolog: MARH2_MOUSE Membrane-associated RING finger protein 2 (Membrane-associated RING-CH protein II) (MARCH-II) with e-value of 4.2e-06 and BLAST sequence identity of 34.0
  misc_feature 329996:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(248): Functional Homolog of  Ceres CLONE ID no. 336888 at SEQ ID NO. 3001 with e-value of 2.19E-68 and BLAST sequence identity of 56.4
MGDHFVFLVDRLLTESTLEAAIESQNRLWQAVPSANMSSSTGILEECRICHDEDDDKNMEIPCSCRGSLKYAHRKCVQRWCNEKGDINCEICYQQFEPGYTAPRPLFRYGGIPMNFRGNWEIPTRELHAPPFIPMFTTDREYLDSDFEEEYPLPSPRSVMCCRIVAIIFMVLLVLRHTLPIIISGAGDYSMTLFMLMILRTVGILLPIYVMVRAFTAIQHRRRQQQLLLERNLPEMEARNEKGEGCPT

SEQ ID NO: 2959 - DNA, 795 bp, Populus balsamifera subsp. trichocarpa
  misc_feature (1)..(795): Ceres ANNOT ID no. 1517165
  misc_feature 330077:<222: Transcription Factor
  misc_feature: Phenotype: Activates expression of the gene endogenous to the AtPES (SEQ ID NO 4142) regalutory region Useful for modulating Terpenoid Biosynthesis
atgggggatcactttgtattgctggtgaatcgtttgataactgaatccaccttagaagctgcaattgagagcagaaacctgtcgatgcaagccacagcgtctgacacaaaaattgataaatctttccagaaactggattttggggatatatcaactccgaggaaattggtggagtgcaggatttgccaggatgaggatgaagattctaatatggagacaccatgttcttgttgtggtagtttgaagtatgctcatcgcaggtgtatacagaggtggtgtaatgagaaggggaacactatatgtgagatatgcctccaggagttcaagcctggttatacagcaccaccacccctgttccaaattgggtttccaatgaactttaggggaaattgggagacgtctagaagggagttaaatggtcctcgcttcatagcagtggtctcatctgaacataacttcctgaatactgactattatgagtattcagcttcaactacaagaaacacaatctactgtcgcttgattgctgtgattttcatggttcttttaattctaaggcacactcttcctctcattcttaatggaaccaacaatttctcattcccagtgtttatgttgttatttctacgaattgctgggattattcttccaatctatgtcatgttaaaagcactaactgctctccagcgtcgccgcctccatcaggcgcctccaaattcatcaattcattcatatgatgaagatgctgagcattcaaccctgcagcctcggccacatataataaatgttcattag

SEQ ID NO: 2960 - protein, 264 aa, Populus balsamifera subsp. trichocarpa
  misc_feature (1)..(264): Ceres ANNOT ID no. 1517165
  misc_feature (59)..(104): Pfam Name: zf-C3HC4 Pfam Description: Zinc finger, C3HC4 type (RING finger)
  misc_feature: SWISSPROT Homolog: MARH2_HUMAN Membrane-associated RING finger protein 2 with e-value of 1.6e-07 and BLAST sequence identity of 36.0
  misc_feature: SWISSPROT Homolog: MARH2_HUMAN Membrane-associated RING-CH protein II MARCH-II (RING finger protein 172)
  misc_feature: SWISSPROT Homolog: MARH2_MOUSE Membrane-associated RING finger protein 2 (Membrane-associated RING-CH protein II) (MARCH-II) with e-value of 4.2e-06 and BLAST sequence identity of 34.0
  misc_feature 330159:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(264): Functional Homolog of  Ceres CLONE ID no. 336888 at SEQ ID NO. 3001 with e-value of 4.30E-65 and BLAST sequence identity of 51.6
MGDHFVLLVNRLITESTLEAAIESRNLSMQATASDTKIDKSFQKLDFGDISTPRKLVECRICQDEDEDSNMETPCSCCGSLKYAHRRCIQRWCNEKGNTICEICLQEFKPGYTAPPPLFQIGFPMNFRGNWETSRRELNGPRFIAVVSSEHNFLNTDYYEYSASTTRNTIYCRLIAVIFMVLLILRHTLPLILNGTNNFSFPVFMLLFLRIAGIILPIYVMLKALTALQRRRLHQAPPNSSIHSYDEDAEHSTLQPRPHIINVH

SEQ ID NO: 2961 - DNA, 726 bp, Populus balsamifera subsp. trichocarpa
  misc_feature (1)..(726): Ceres ANNOT ID no. 1539315
  misc_feature 330243:<222: Transcription Factor
  misc_feature: Phenotype: Activates expression of the gene endogenous to the AtPES (SEQ ID NO 4142) regalutory region Useful for modulating Terpenoid Biosynthesis
atgggggatcattttgtgttcctggtggatcggttgctaactgaatccacccttgaagctgccattgagagccaaaaccgattgtggcaagctgtgccttctgcaaatatgagttcatcaacaggaatattagaagagtgtagaatttgccatgacgaggatgatgacaaaaacatggagataccatgttcttgccgtggcagtttgaagtatgctcatcggaaatgtgtccagaggtggtgcaacgagaagggtgacattaactgtgagatctgctatcagcaattcgagcctggttatacagctccgcgccctttgtttcgttatggtggaaattgggagatacccacaagggaattgcatgctcctccatttataccgatgtttactaccgaccgtgaatatttggactctgatttcgaagaagagtatcctttaccctctcctaggagcgtgatgtgctgccgcatagttgctattatatttatggttcttttggttttacgccatacgcttcctatcataattagtggggccggagattactccatgacattgttcatgttaatgatattgagaacagttgggattcttctgcctatttatgtcatggtcagagcatttaccgctatccaacatcggcgccgccagcagcagctgctgctcgagcgcaacctgccagaaatagaagccagaaatgagaagggagaaggatgtccaacatag

SEQ ID NO: 2962 - protein, 241 aa, Populus balsamifera subsp. trichocarpa
  misc_feature (1)..(241): Ceres ANNOT ID no. 1539315
  misc_feature (47)..(92): Pfam Name: zf-C3HC4 Pfam Description: Zinc finger, C3HC4 type (RING finger)
  misc_feature: SWISSPROT Homolog: MARH2_HUMAN Membrane-associated RING finger protein 2 with e-value of 1.6e-07 and BLAST sequence identity of 36.0
  misc_feature: SWISSPROT Homolog: MARH2_HUMAN Membrane-associated RING-CH protein II MARCH-II (RING finger protein 172)
  misc_feature: SWISSPROT Homolog: MARH2_MOUSE Membrane-associated RING finger protein 2 (Membrane-associated RING-CH protein II) (MARCH-II) with e-value of 4.2e-06 and BLAST sequence identity of 34.0
  misc_feature 330323:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(241): Functional Homolog of  Ceres CLONE ID no. 336888 at SEQ ID NO. 3001 with e-value of 1.49E-62 and BLAST sequence identity of 55.5
MGDHFVFLVDRLLTESTLEAAIESQNRLWQAVPSANMSSSTGILEECRICHDEDDDKNMEIPCSCRGSLKYAHRKCVQRWCNEKGDINCEICYQQFEPGYTAPRPLFRYGGNWEIPTRELHAPPFIPMFTTDREYLDSDFEEEYPLPSPRSVMCCRIVAIIFMVLLVLRHTLPIIISGAGDYSMTLFMLMILRTVGILLPIYVMVRAFTAIQHRRRQQQLLLERNLPEIEARNEKGEGCPT

SEQ ID NO: 2963 - DNA, 828 bp, Populus balsamifera subsp. trichocarpa
  misc_feature (1)..(828): Ceres ANNOT ID no. 1463865
  misc_feature 330404:<222: Transcription Factor
  misc_feature: Phenotype: Activates expression of the gene endogenous to the AtPES (SEQ ID NO 4142) regalutory region Useful for modulating Terpenoid Biosynthesis
atgggggatcactttgtattgctggtgaatcgtttgataactgaatccaccttagaagctgcaattgagagcagaaacctgtcgatgcaagccacagcgtctgacacaaaaattgataaatctttccagaaactggattttggggatatatcaactccgaggaaattggtggagtgcaggatttgccaggatgaggatgaagattctaatatggagacaccatgttcttgttgtggtagtttgaagcttgccatgtctgactggttcttcatatcgcagtatgctcatcgcaggtgtatacagaggtggtgtaatgagaaggggaacactatatgtgagatatgcctccaggagttcaagcctggttatacagcaccaccacccctgttccaaattgggtttccaatgaactttaggggaaattgggagacgtctagaagggagttaaatggtcctcgcttcatagcagtggtctcatctgaacataacttcctgaatactgactattatgagtattcagcttcaactacaagaaacacaatctactgtcgcttgattgctgtgattttcatggttcttttaattctaaggcacactcttcctctcattcttaatggaaccaacaatttctcattcccagtgtttatgttgttatttctacgaattgctgggattattcttccaatctatgtcatgttaaaagcactaactgctctccagcgtcgccgcctccatcaggcgcctccaaattcatcaattcattcatatgatgaagatgctgagcattcaaccctgcagcctcggccacatataataaatgttcattag

SEQ ID NO: 2964 - protein, 275 aa, Populus balsamifera subsp. trichocarpa
  misc_feature (1)..(275): Ceres ANNOT ID no. 1463865
  misc_feature (93)..(115): Pfam Name: zf-C3HC4 Pfam Description: Zinc finger, C3HC4 type (RING finger)
  misc_feature: SWISSPROT Homolog: MARH2_HUMAN Membrane-associated RING finger protein 2 with e-value of 1.6e-07 and BLAST sequence identity of 36.0
  misc_feature: SWISSPROT Homolog: MARH2_HUMAN Membrane-associated RING-CH protein II MARCH-II (RING finger protein 172)
  misc_feature: SWISSPROT Homolog: MARH2_MOUSE Membrane-associated RING finger protein 2 (Membrane-associated RING-CH protein II) (MARCH-II) with e-value of 4.2e-06 and BLAST sequence identity of 34.0
  misc_feature 330486:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(275): Functional Homolog of  Ceres CLONE ID no. 336888 at SEQ ID NO. 3001 with e-value of 5.09E-62 and BLAST sequence identity of 51.6
MGDHFVLLVNRLITESTLEAAIESRNLSMQATASDTKIDKSFQKLDFGDISTPRKLVECRICQDEDEDSNMETPCSCCGSLKLAMSDWFFISQYAHRRCIQRWCNEKGNTICEICLQEFKPGYTAPPPLFQIGFPMNFRGNWETSRRELNGPRFIAVVSSEHNFLNTDYYEYSASTTRNTIYCRLIAVIFMVLLILRHTLPLILNGTNNFSFPVFMLLFLRIAGIILPIYVMLKALTALQRRRLHQAPPNSSIHSYDEDAEHSTLQPRPHIINVH

SEQ ID NO: 2965 - DNA, 780 bp, Populus balsamifera subsp. trichocarpa
  misc_feature (1)..(780): Ceres ANNOT ID no. 1502340
  misc_feature 330573:<222: Transcription Factor
  misc_feature: Phenotype: Activates expression of the gene endogenous to the AtPES (SEQ ID NO 4142) regalutory region Useful for modulating Terpenoid Biosynthesis
atgggggatcattttgtgttcctggtggatcggttgctaactgaatccacccttgaagctgctattgagagtcaaaaccgattgcggcaaaccatggcttcagcaagtaaagaaaatacaaaagaattttcaccacattggatggatttagaattgacttcattagcaggaaaatcagtagagtgtaggatttgccatgaggaggaggatgacatgaacatggagatgccgtgttcttgccgtggcagtttgaagaggtggtgcaatgagaagggtaacactatctgtgagatctgccatcagcaatttgagcctggttatacagcaccaccccctttgttttgttatggtgctattccaatgaacttcagaggaaattgggagatacccagaagggacctgcacaatcctccatctatagctatggttactactgaccatgaatttttggactctgactttgatgagtattcagcaccctctcctaggagtgtgatgtgctgccgaataattgctattatatttatggttctgttggttttacgtcatactcttgccatcctaattagtggagctggagattactcaatgacattgtttatgttactgatattgagaacagttgggattcttctgcctgtttatgtcatggtcagagcatttactgctattcaacatcggggtcggcagcaggatcctcattttccccttgctgagtcagatgaggaaaatgagttgccgcaacttcagactcattcgcgcattattcatattcagtga

SEQ ID NO: 2966 - protein, 259 aa, Populus balsamifera subsp. trichocarpa
  misc_feature (1)..(259): Ceres ANNOT ID no. 1502340
  misc_feature (62)..(99): Pfam Name: zf-C3HC4 Pfam Description: Zinc finger, C3HC4 type (RING finger)
  misc_feature: SWISSPROT Homolog: MARH2_HUMAN Membrane-associated RING finger protein 2 with e-value of 1.6e-07 and BLAST sequence identity of 36.0
  misc_feature: SWISSPROT Homolog: MARH2_HUMAN Membrane-associated RING-CH protein II MARCH-II (RING finger protein 172)
  misc_feature: SWISSPROT Homolog: MARH2_MOUSE Membrane-associated RING finger protein 2 (Membrane-associated RING-CH protein II) (MARCH-II) with e-value of 4.2e-06 and BLAST sequence identity of 34.0
  misc_feature 330655:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(259): Functional Homolog of  Ceres CLONE ID no. 336888 at SEQ ID NO. 3001 with e-value of 2.19E-61 and BLAST sequence identity of 57.5
MGDHFVFLVDRLLTESTLEAAIESQNRLRQTMASASKENTKEFSPHWMDLELTSLAGKSVECRICHEEEDDMNMEMPCSCRGSLKRWCNEKGNTICEICHQQFEPGYTAPPPLFCYGAIPMNFRGNWEIPRRDLHNPPSIAMVTTDHEFLDSDFDEYSAPSPRSVMCCRIIAIIFMVLLVLRHTLAILISGAGDYSMTLFMLLILRTVGILLPVYVMVRAFTAIQHRGRQQDPHFPLAESDEENELPQLQTHSRIIHIQ

SEQ ID NO: 2967 - DNA, 795 bp, Populus balsamifera subsp. trichocarpa
  misc_feature (1)..(795): Ceres ANNOT ID no. 1512274
  misc_feature 330739:<222: Transcription Factor
  misc_feature: Phenotype: Activates expression of the gene endogenous to the AtPES (SEQ ID NO 4142) regalutory region Useful for modulating Terpenoid Biosynthesis
atgggggatcattttgtgttgctggtgaatcggctgttaactgaatccacattagaagctgcaattgagagcagaaacctgtcgatgcaagccacagcatcaacagttgatgacactaaaattgataaatctttccagaaaatggattttggtgatatatcgactccaaggaaattggtggagtgcaggatatgccaggatgaggatgatgattccaatatggagacaccatgttcttgttgtggcagcttgaagtatgttcatcgcaggtgcgtacagaggtggtgtaatgagaagggtaacactatatgtgagatatgccaccaggagttcaagcctggttatacagcaccacctcccctgttccaaattgggtttccagtgaacttcaggggaaattgggagacttccagaagggagttaaatggtcctcacttcatagcagtggtctcaactgaacgtaactttttgaacaatgactatgatgagtatgcagcttcaactacaagaaatgcaatctactgtcggttaattgctgtagttttcatggttcttttaattctaaggcactctcttcctcttgttcttaatggaaccaacaatatctcattcccgtcgttatttctacgaactgctgggattattctttcaatctatgtcatgttaaaagcagtgactgccatccagcgttgctgcctccatcaggagcctccaaattcatcatttcattcatatgatgaagatgctgagcatccaaccctgcagcctcggccacatataataaatgttcattag

SEQ ID NO: 2968 - protein, 264 aa, Populus balsamifera subsp. trichocarpa
  misc_feature (1)..(264): Ceres ANNOT ID no. 1512274
  misc_feature (62)..(107): Pfam Name: zf-C3HC4 Pfam Description: Zinc finger, C3HC4 type (RING finger)
  misc_feature: SWISSPROT Homolog: MARH2_HUMAN Membrane-associated RING finger protein 2 with e-value of 1.6e-07 and BLAST sequence identity of 36.0
  misc_feature: SWISSPROT Homolog: MARH2_HUMAN Membrane-associated RING-CH protein II MARCH-II (RING finger protein 172)
  misc_feature: SWISSPROT Homolog: MARH2_MOUSE Membrane-associated RING finger protein 2 (Membrane-associated RING-CH protein II) (MARCH-II) with e-value of 4.2e-06 and BLAST sequence identity of 34.0
  misc_feature 330821:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(264): Functional Homolog of  Ceres CLONE ID no. 336888 at SEQ ID NO. 3001 with e-value of 2.19E-61 and BLAST sequence identity of 52.4
MGDHFVLLVNRLLTESTLEAAIESRNLSMQATASTVDDTKIDKSFQKMDFGDISTPRKLVECRICQDEDDDSNMETPCSCCGSLKYVHRRCVQRWCNEKGNTICEICHQEFKPGYTAPPPLFQIGFPVNFRGNWETSRRELNGPHFIAVVSTERNFLNNDYDEYAASTTRNAIYCRLIAVVFMVLLILRHSLPLVLNGTNNISFPSLFLRTAGIILSIYVMLKAVTAIQRCCLHQEPPNSSFHSYDEDAEHPTLQPRPHIINVH

SEQ ID NO: 2969 - DNA, 825 bp, Populus balsamifera subsp. trichocarpa
  misc_feature (1)..(825): Ceres ANNOT ID no. 1459009
  misc_feature 330905:<222: Transcription Factor
  misc_feature: Phenotype: Activates expression of the gene endogenous to the AtPES (SEQ ID NO 4142) regalutory region Useful for modulating Terpenoid Biosynthesis
atgggggatcattttgtgttgctggtgaatcggctgttaactgaatccacattagaagctgcaattgagagcagaaacctgtcgatgcaagccacagcatcaacagttgatgacactaaaattgataaatctttccagaaaatggattttggtgatatatcgactccaaggaaattggtggagtgcaggatatgccaggatgaggatgatgattccaatatggagacaccatgttcttgttgtggcagcttgaagcttgaaatatcagaatgtcatatagataggtatgttcatcgcaggtgcgtacagaggtggtgtaatgagaagggtaacactatatgtgagatatgccaccaggagttcaagcctggttatacagcaccacctcccctgttccaaattgggtttccagtgaacttcaggggaaattgggagacttccagaagggagttaaatggtcctcacttcatagcagtggtctcaactgaacgtaactttttgaacaatgactatgatgagtatgcagcttcaactacaagaaatgcaatctactgtcggttaattgctgtagttttcatggttcttttaattctaaggcactctcttcctcttgttcttaatggaaccaacaatatctcattcccgtcgttatttctacgaactgctgggattattctttcaatctatgtcatgttaaaagcagtgactgccatccagcgttgctgcctccatcaggagcctccaaattcatcatttcattcatatgatgaagatgctgagcatccaaccctgcagcctcggccacatataataaatgttcattag

SEQ ID NO: 2970 - protein, 274 aa, Populus balsamifera subsp. trichocarpa
  misc_feature (1)..(274): Ceres ANNOT ID no. 1459009
  misc_feature (62)..(86): Pfam Name: zf-C3HC4 Pfam Description: Zinc finger, C3HC4 type (RING finger)
  misc_feature: SWISSPROT Homolog: MARH2_HUMAN Membrane-associated RING finger protein 2 with e-value of 1.6e-07 and BLAST sequence identity of 36.0
  misc_feature: SWISSPROT Homolog: MARH2_HUMAN Membrane-associated RING-CH protein II MARCH-II (RING finger protein 172)
  misc_feature: SWISSPROT Homolog: MARH2_MOUSE Membrane-associated RING finger protein 2 (Membrane-associated RING-CH protein II) (MARCH-II) with e-value of 4.2e-06 and BLAST sequence identity of 34.0
  misc_feature 330987:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(274): Functional Homolog of  Ceres CLONE ID no. 336888 at SEQ ID NO. 3001 with e-value of 1.59E-58 and BLAST sequence identity of 52.4
MGDHFVLLVNRLLTESTLEAAIESRNLSMQATASTVDDTKIDKSFQKMDFGDISTPRKLVECRICQDEDDDSNMETPCSCCGSLKLEISECHIDRYVHRRCVQRWCNEKGNTICEICHQEFKPGYTAPPPLFQIGFPVNFRGNWETSRRELNGPHFIAVVSTERNFLNNDYDEYAASTTRNAIYCRLIAVVFMVLLILRHSLPLVLNGTNNISFPSLFLRTAGIILSIYVMLKAVTAIQRCCLHQEPPNSSFHSYDEDAEHPTLQPRPHIINVH

SEQ ID NO: 2971 - DNA, 888 bp, Populus balsamifera subsp. trichocarpa
  misc_feature (1)..(888): Ceres ANNOT ID no. 1445529
  misc_feature 331074:<222: Transcription Factor
  misc_feature: Phenotype: Activates expression of the gene endogenous to the AtPES (SEQ ID NO 4142) regalutory region Useful for modulating Terpenoid Biosynthesis
atgggggatcattttgtgttcctggtggatcggttgctaactgaatccacccttgaagctgccattgagagccaaaaccgattgtggcaagctgtgccttctgcaaatatgagttcatcaacaggaatattagaagagtgtagaatttgccatgacgaggatgatgacaaaaacatggagataccatgttcttgccgtggcagtttgaaggggcttactttgaacatttttggcacacataaaacaggcataatttccctcaaactcgagcacctcatgattttttgtaaatttttggtactacatttacctcagtatgctcatcggaaatgtgtccagaggtggtgcaacgagaagggtgacattaactgtgagatctgctatcagcaatttgagcctggttatacagctccgcgccctttgtttcgttatggtggtattccaatgaatttcagtgatagtcctaatctgcttgggattttcatctccagaggaaattgggagatacccacaagggaattgcatgctcctccatttataccgatgtttactaccgaccgtgaatatttggactctgatttcgaagaagagtatcctttaccctctcctaggagcgtgatgtgctgccgcatagttgctattatatttatggttcttttggttttacgccatacgcttcctatcataattagtggggccggagattactccatgacattgttcatgttaatgatattgagaacagttgggattcttctgcctatttatgtcatggtcagagcatttaccgctatccaacatcggcgccgccagcagcagctgctgctcgagcgcaacctgccagaaatggaagccagaaatgagaagggagaaggatgtccaacatag

SEQ ID NO: 2972 - protein, 295 aa, Populus balsamifera subsp. trichocarpa
  misc_feature (1)..(295): Ceres ANNOT ID no. 1445529
  misc_feature (105)..(127): Pfam Name: zf-C3HC4 Pfam Description: Zinc finger, C3HC4 type (RING finger)
  misc_feature: SWISSPROT Homolog: MARH2_HUMAN Membrane-associated RING finger protein 2 with e-value of 1.6e-07 and BLAST sequence identity of 36.0
  misc_feature: SWISSPROT Homolog: MARH2_HUMAN Membrane-associated RING-CH protein II MARCH-II (RING finger protein 172)
  misc_feature: SWISSPROT Homolog: MARH2_MOUSE Membrane-associated RING finger protein 2 (Membrane-associated RING-CH protein II) (MARCH-II) with e-value of 4.2e-06 and BLAST sequence identity of 34.0
  misc_feature 331158:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(295): Functional Homolog of  Ceres CLONE ID no. 336888 at SEQ ID NO. 3001 with e-value of 6.19E-57 and BLAST sequence identity of 56.4
MGDHFVFLVDRLLTESTLEAAIESQNRLWQAVPSANMSSSTGILEECRICHDEDDDKNMEIPCSCRGSLKGLTLNIFGTHKTGIISLKLEHLMIFCKFLVLHLPQYAHRKCVQRWCNEKGDINCEICYQQFEPGYTAPRPLFRYGGIPMNFSDSPNLLGIFISRGNWEIPTRELHAPPFIPMFTTDREYLDSDFEEEYPLPSPRSVMCCRIVAIIFMVLLVLRHTLPIIISGAGDYSMTLFMLMILRTVGILLPIYVMVRAFTAIQHRRRQQQLLLERNLPEMEARNEKGEGCPT

SEQ ID NO: 2973 - DNA, 831 bp, Populus balsamifera subsp. trichocarpa
  misc_feature (1)..(831): Ceres ANNOT ID no. 1485901
  misc_feature 331248:<222: Transcription Factor
  misc_feature: Phenotype: Activates expression of the gene endogenous to the AtPES (SEQ ID NO 4142) regalutory region Useful for modulating Terpenoid Biosynthesis
atgggggatcattttgtgttcctggtggatcggttgctaactgaatccacccttgaagctgccattgagagccaaaaccgattgtggcaagctgtgccttctgcaaatatgagttcatcaacaggaatattagaagagtgtagaatttgccatgacgaggatgatgacaaaaacatggagataccatgttcttgccgtggcagtttgaaggggcttactttgaacatttttggcacacataaaacaggcataatttccctcaaactcgagcacctcatgattttttgtaaatttttggtactacatttacctcagtatgctcatcggaaatgtgtccagaggtggtgcaacgagaagggtgacattaactgtgagatctgctatcagcaattcgagcctggttatacagctccgcgccctttgtttcgttatggtggaaattgggagatacccacaagggaattgcatgctcctccatttataccgatgtttactaccgaccgtgaatatttggactctgatttcgaagaagagtatcctttaccctctcctaggagcgtgatgtgctgccgcatagttgctattatatttatggttcttttggttttacgccatacgcttcctatcataattagtggggccggagattactccatgacattgttcatgttaatgatattgagaacagttgggattcttctgcctatttatgtcatggtcagagcatttaccgctatccaacatcggcgccgccagcagcagctgctgctcgagcgcaacctgccagaaatagaagccagaaatgagaagggagaaggatgtccaacatag

SEQ ID NO: 2974 - protein, 276 aa, Populus balsamifera subsp. trichocarpa
  misc_feature (1)..(276): Ceres ANNOT ID no. 1485901
  misc_feature (105)..(127): Pfam Name: zf-C3HC4 Pfam Description: Zinc finger, C3HC4 type (RING finger)
  misc_feature: SWISSPROT Homolog: MARH2_HUMAN Membrane-associated RING finger protein 2 with e-value of 1.6e-07 and BLAST sequence identity of 36.0
  misc_feature: SWISSPROT Homolog: MARH2_HUMAN Membrane-associated RING-CH protein II MARCH-II (RING finger protein 172)
  misc_feature: SWISSPROT Homolog: MARH2_MOUSE Membrane-associated RING finger protein 2 (Membrane-associated RING-CH protein II) (MARCH-II) with e-value of 4.2e-06 and BLAST sequence identity of 34.0
  misc_feature 331330:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(276): Functional Homolog of  Ceres CLONE ID no. 336888 at SEQ ID NO. 3001 with e-value of 2.20E-54 and BLAST sequence identity of 55.5
MGDHFVFLVDRLLTESTLEAAIESQNRLWQAVPSANMSSSTGILEECRICHDEDDDKNMEIPCSCRGSLKGLTLNIFGTHKTGIISLKLEHLMIFCKFLVLHLPQYAHRKCVQRWCNEKGDINCEICYQQFEPGYTAPRPLFRYGGNWEIPTRELHAPPFIPMFTTDREYLDSDFEEEYPLPSPRSVMCCRIVAIIFMVLLVLRHTLPIIISGAGDYSMTLFMLMILRTVGILLPIYVMVRAFTAIQHRRRQQQLLLERNLPEIEARNEKGEGCPT

SEQ ID NO: 2975 - protein, 222 aa, Zea mays
  misc_feature (1)..(222): Ceres CLONE ID no. 355209
  misc_feature (1)..(222): Also Known As Ceres CDNA ID no. 23798983
  misc_feature (1)..(222): Also Known As Ceres GEMINI ID 538B12
  misc_feature (108)..(140): Pfam Name: AP2 Pfam Description: AP2 domain
  misc_feature: Transcription Factor
  misc_feature: Phenotype: Activates expression of the gene endogenous to the AtBBE2 (SEQ ID NO 4151) regalutory region Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
MVSLRRRRLLGLCSGKDSLPVDLPKPIENEKTVEVAHSNVKPFSVHPLPLAKTSDVLIKSSNGSDDSKEEKTQYYPGKEIKCRKRHRRKQYVDQEPCIMRGVYFKNMKWQAAIKIDKKQIHLGTVGTQDEAARLYDRAAFMCGREPNFVLSEEEKQELRRYTWEDFLAVTRNTITSKKQRKVGSLRRSKADLFMGQSDGDTEMANGGGSSNSDNGDAGTSAS

SEQ ID NO: 2976 - DNA, 819 bp, Populus balsamifera subsp. trichocarpa
  misc_feature (1)..(819): Ceres ANNOT ID no. 1498695
  misc_feature 331511:<222: Transcription Factor
  misc_feature: Phenotype: Activates expression of the gene endogenous to the AtBBE2 (SEQ ID NO 4151) regalutory region Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
atggttagcttacggaggcgtaaactcttgggactttgtgctggttccactcagaatggcaggtctgtcagtgtgcatcctctgccatcagatgatgccaaccagccagaggagcctgcctccaccatgagttctctttcattaaccatatcgagccaggagcagacatcatcatctgcagtgcagacaaatccaaatgccatacctatttttacgagacttgagggtgaagcagaagttcttggtaaagagcttgcttttagaaaaagcagtcatcctatctcgggaaagcagaaaaccattgcaaaagtgggagctggctcttcaaatgtttcggcttctagctcgtcaaaagagcagcgatctcaagcatatccagagcaaccagttaaacgcagaaagagacacaggaggaaacatgttcagaaccaggaaccatgcctgatgagaggcgtctattttaaaaatatgaaatggcaggcagcaattaaagttgacaagaagcagattcacctagggactgttggttctcaagaagaggctgctcgtttgtatgacagggctgctttcatgtgcgggagggagcccaattttgagctctcagaggaggaaaagcaagaacttaggaaattcaagtgggatgaatttttggcaatcactcgcagtgcaattaacaataaaaaacacaagagaaggatcggggcaggtttgcagaagagatcagagaccacattgcaggatggtgactgggatgccaaggacggactcaatggcttttcagcttcagaagatgtggaaccagactcatcagcctcttga

SEQ ID NO: 2977 - protein, 272 aa, Populus balsamifera subsp. trichocarpa
  misc_feature (1)..(272): Ceres ANNOT ID no. 1498695
  misc_feature (147)..(204): Pfam Name: AP2 Pfam Description: AP2 domain
  misc_feature 331577:<222: Transcription Factor
  misc_feature: Phenotype: Activates expression of the gene endogenous to the AtBBE2 (SEQ ID NO 4151) regalutory region Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature (1)..(272): Functional Homolog of  Ceres CLONE ID no. 355209 at SEQ ID NO. 3022 with e-value of 1.29E-49 and BLAST sequence identity of 59.8
MVSLRRRKLLGLCAGSTQNGRSVSVHPLPSDDANQPEEPASTMSSLSLTISSQEQTSSSAVQTNPNAIPIFTRLEGEAEVLGKELAFRKSSHPISGKQKTIAKVGAGSSNVSASSSSKEQRSQAYPEQPVKRRKRHRRKHVQNQEPCLMRGVYFKNMKWQAAIKVDKKQIHLGTVGSQEEAARLYDRAAFMCGREPNFELSEEEKQELRKFKWDEFLAITRSAINNKKHKRRIGAGLQKRSETTLQDGDWDAKDGLNGFSASEDVEPDSSAS

SEQ ID NO: 2978 - protein, 171 aa, Zea mays
  misc_feature (1)..(171): Ceres CLONE ID no. 362309
  misc_feature (1)..(171): Also Known As Ceres CDNA ID no. 23796210
  misc_feature (1)..(171): Also Known As Ceres GEMINI ID 538E12
  misc_feature (72)..(166): Pfam Name: B3 Pfam Description: B3 DNA binding domain
  misc_feature 331691:<222: Transcription Factor
  misc_feature: Phenotype: Activates expression of the gene endogenous to the AtHMGS (SEQ ID NO 4144) regalutory region Useful for modulating Terpenoid Biosynthesis
MEPVRRSGRLANLPDKPVYREKVPDFGMKIRRTYGSVRRDLTNRVYATDDARSYAISKAEDLEQELDSSFPIFIKPMTQSHVTGGFWLGLPIHFCRKYLPKRDEMITLVDEDDDESDTLYLAMKRGLSAGWRGFAVQQKLVDGDCLVFQLIEQTKFKVYITRASSYYESED

SEQ ID NO: 2979 - DNA, 684 bp, Populus balsamifera subsp. trichocarpa
  misc_feature (1)..(684): Ceres ANNOT ID no. 1539865
  misc_feature 331749:<222: Transcription Factor
  misc_feature: Phenotype: Activates expression of the gene endogenous to the AtHMGS (SEQ ID NO 4144) regalutory region Useful for modulating Terpenoid Biosynthesis
atggcggcaaaggtaacagcatatgaagaaagtcgccgaaagagaatggaagagaacaagaaaagaatggaagccctcaatctccacaagctttctcgagctcttaaaatttccacccctaccaaatcctctccgatgaaacgctcaaaacctcgagtagtcgagaaacaagtggttgtggttaggaggtccaatcgtgtcgcgaacaagcctgctcctttctttaaagaagttgttcttgatcgagtggtgataccaagaaggatttccaaggcaagagatttgtcaaaccgggtgtatgctactgatgaagccagggcaaaggctatggagaaagcagaaaagctacaatctgatttaggatctgactatccgatctttataaaatcaatgcttcaatcccatgttactggtggattttggctggggtgtcttccactcgacttctgcagaaggaaccttccaaggcgagacgatttcatcactttgatagatgaagaggcagatgagtatcaagttatatatttagcacgaaagaatggactaagtggtggatggaaagggtttgccgttgctcatggactgctagatggagatgctgtggtttttcagttaatcaagcctacagcatgcaaggtatatatcataagggtgaatggctcggaacagggcaatagtctttga

SEQ ID NO: 2980 - protein, 205 aa, Populus balsamifera subsp. trichocarpa
  misc_feature (1)..(205): Ceres ANNOT ID no. 1539865
  misc_feature (104)..(199): Pfam Name: B3 Pfam Description: B3 DNA binding domain
  misc_feature 331804:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(205): Functional Homolog of  Ceres CLONE ID no. 362309 at SEQ ID NO. 3025 with e-value of 5.30E-44 and BLAST sequence identity of 60.1
MEALNLHKLSRALKISTPTKSSPMKRSKPRVVEKQVVVVRRSNRVANKPAPFFKEVVLDRVVIPRRISKARDLSNRVYATDEARAKAMEKAEKLQSDLGSDYPIFIKSMLQSHVTGGFWLGCLPLDFCRRNLPRRDDFITLIDEEADEYQVIYLARKNGLSGGWKGFAVAHGLLDGDAVVFQLIKPTACKVYIIRVNGSEQGNSL

SEQ ID NO: 2981 - protein, 427 aa, Zea mays
  misc_feature (1)..(427): Ceres CLONE ID no. 374674
  misc_feature (1)..(427): Also Known As Ceres CDNA ID no. 23799339
  misc_feature (1)..(427): Also Known As Ceres GEMINI ID 539G9
  misc_feature (29)..(53): Pfam Name: zf-CCCH Pfam Description: Zinc finger C-x8-C-x5-C-x3-H type (and similar)
  misc_feature (361)..(380): Pfam Name: WD40 Pfam Description: WD domain, G-beta repeat
  misc_feature 331902:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
MDIEADGRFGNKRVHNRLGPGSGGAPPSTNGKVCNYWRAGRCNRFPCPFLHSELPEAAPPKRPTGPGGNVWRNPNTGGRGGGHHNRWGKGPGGGSGIASHKPPERPCKYFLAGTECSYGERCRYPHSYCISDSIAMLTLLKGHEQGVTGIALPAGSDKLYSGSKDGTVRMWDCQTGQCAGVITMGREVGCMIIEGPWLFVGIPDAVKVWNMQTAAEMSLTGPTGQVYALAVASELLFAATQAGRILAWRFSAATNCFEPAASLDGHKLAVVSLIVGGMRLYSASMDKTIRVWDLATLQCIQTLSDHTDVVMSVLCWDQFLLSCSLDQTIKVWAATESGNLEVTYTHKEDQGALALSGMPDAQSKPVLLCSLNDNTVRLYDLPSFSDRGRLFSKKEIRAIQMGPGGLFFTGDGTGELKVWQWVDLAQT

SEQ ID NO: 2982 - DNA, 1359 bp, Populus balsamifera subsp. trichocarpa; identical to SEQ ID NO: 721
  misc_feature (1)..(1359): Ceres ANNOT ID no. 1522299
  misc_feature 332009:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis

SEQ ID NO: 2983 - protein, 452 aa, Populus balsamifera subsp. trichocarpa; identical to SEQ ID NO: 722
  misc_feature (1)..(452): Ceres ANNOT ID no. 1522299
  misc_feature (126)..(151): Pfam Name: zf-CCCH Pfam Description: Zinc finger C-x8-C-x5-C-x3-H type (and similar)
  misc_feature (281)..(316): Pfam Name: WD40 Pfam Description: WD domain, G-beta repeat
  misc_feature: SWISSPROT Homolog: KMHB_DICDI Myosin heavy chain kinase B (EC 2.7.11.7) (MHCK B) with e-value of 1.5e-22 and BLAST sequence identity of 32.6
  misc_feature: SWISSPROT Homolog: POF1_SCHPO F-box/WD-repeat protein pof1 (Skp1-binding protein 1) with e-value of 2.9e-19 and BLAST sequence identity of 28.4
  misc_feature: SWISSPROT Homolog: Y2800_ANASP Hypothetical WD-repeat protein alr2800 with e-value of 1.2e-18 and BLAST sequence identity of 30.7
  misc_feature: SWISSPROT Homolog: KMHA_DICDI Myosin heavy chain kinase A (EC 2.7.11.7) (MHCK A) with e-value of 4.0e-17 and BLAST sequence identity of 30.2
  misc_feature: SWISSPROT Homolog: HETE1_PODAN Vegetatible incompatibility protein HET-E-1 with e-value of 5.0e-17 and BLAST sequence identity of 28.3
  misc_feature 332131:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature (1)..(452): Functional Homolog of  Ceres CLONE ID no. 374674 at SEQ ID NO. 3028 with e-value of 2.00E-138 and BLAST sequence identity of 62.1

SEQ ID NO: 2984 - DNA, 1155 bp, Populus balsamifera subsp. trichocarpa; identical to SEQ ID NO: 723
  misc_feature (1)..(1155): Ceres ANNOT ID no. 1527718
  misc_feature 332252:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis

SEQ ID NO: 2985 - protein, 384 aa, Populus balsamifera subsp. trichocarpa; identical to SEQ ID NO: 724
  misc_feature (1)..(384): Ceres ANNOT ID no. 1527718
  misc_feature (128)..(153): Pfam Name: zf-CCCH Pfam Description: Zinc finger C-x8-C-x5-C-x3-H type (and similar)
  misc_feature (239)..(274): Pfam Name: WD40 Pfam Description: WD domain, G-beta repeat
  misc_feature: SWISSPROT Homolog: KMHB_DICDI Myosin heavy chain kinase B (EC 2.7.11.7) (MHCK B) with e-value of 1.5e-22 and BLAST sequence identity of 32.6
  misc_feature: SWISSPROT Homolog: POF1_SCHPO F-box/WD-repeat protein pof1 (Skp1-binding protein 1) with e-value of 2.9e-19 and BLAST sequence identity of 28.4
  misc_feature: SWISSPROT Homolog: Y2800_ANASP Hypothetical WD-repeat protein alr2800 with e-value of 1.2e-18 and BLAST sequence identity of 30.7
  misc_feature: SWISSPROT Homolog: KMHA_DICDI Myosin heavy chain kinase A (EC 2.7.11.7) (MHCK A) with e-value of 4.0e-17 and BLAST sequence identity of 30.2
  misc_feature: SWISSPROT Homolog: HETE1_PODAN Vegetatible incompatibility protein HET-E-1 with e-value of 5.0e-17 and BLAST sequence identity of 28.3
  misc_feature 332368:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature (1)..(384): Functional Homolog of  Ceres CLONE ID no. 374674 at SEQ ID NO. 3028 with e-value of 1.19E-108 and BLAST sequence identity of 63.5

SEQ ID NO: 2986 - protein, 225 aa, Zea mays
  misc_feature (1)..(225): Ceres CLONE ID no. 382267
  misc_feature (66)..(111): Pfam Name: Myb_DNA-binding Pfam Description: Myb-like DNA-binding domain
  misc_feature: Phenotype: ROSETTE LEAVES - Cup-shaped Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Serrate Margins Useful for making plants with increased biomass and foliage
MEKEKEKSRARPSRGHWRPGEDDKLRQLVDKYGPRNWNSIAESLEGRSGKSCRLRWFNQLDPRINRRPFTVAEEELLLRAHRAHGNRWAIISRLFPGRTDNAVKNHWHVVMARRRRRTLVGEAAAIGSVVVPPRHQYFHFGSCSPPPPTRSLCFAVPAGFGPLGLSRPAASCGVRNCNVPTAVALLDDGHRHDMSKDLGGDDDNGGDALAKRKDVQFFDFLGVGI

SEQ ID NO: 2987 - DNA, 1047 bp, Populus balsamifera subsp. trichocarpa
  misc_feature (1)..(1047): Ceres ANNOT ID no. 1456223
  misc_feature 332564:<222: Transcription Factor
  misc_feature: Phenotype: ROSETTE LEAVES - Cup-shaped Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Serrate Margins Useful for making plants with increased biomass and foliage
atggaagatcttaaaggtagctcaagcagtgatgatgggaagactagttgtcatagagggcactggagaccagctgaagatgagaaacttcggcaacttgtcgatcaatatggtcctcagaattggaatttcatcgcggaacatcttcaaggaagatcagggaaaagttgtagattgagatggtacaaccaacttgatccaaatatcaacaaaaggccttttacagaagatgaggaagaaaggctcctaaaagctcatcagattcatggaaacagatgggcttcgatatctaggctctttcctggtagaactgacaacgctgtcaagaatcattaccatgttgttatggcaagaaggaagcgggaacgctgcttgactttccatggtaagagaaataatttccaagtccaatattctactgatcatcatcttcggtccaacagaaatagcagtactcctcctggtagcaattttgggttctttaggcctcaagtgtcacttgattatggttctaaattagggtttcagaataatattattgaaagaaagggtactaacatacccatgacctcttcaaactcatcaccctcttggactaacgttagtgcttcaaccatcacaaatgactcattaagttttgacgtctttgatgcaaaaagaaaggattatattcagtactcaagttctaattcttcattacatcctaaagagggaccacttgctttgaatgaatctcttcactgtacttaccatcctagttctaccatttataacaactaccagaatgttgttggacagcagatccctaatgctaagaaagttgatcctaataatccttttgcattgacaagttatggtgatggttatggaagcaataaagaaaagattaccgaaagccagttagtgagactcaatagcaataatcatgagccagctgcattgtggaaattgccaatggcttctcagcaagaagaaaaagatcatggaggtcaattaaagaaccaggatgttgcctttatagactttctcggtgtgggaatctcttaa

SEQ ID NO: 2988 - protein, 348 aa, Populus balsamifera subsp. trichocarpa
  misc_feature (1)..(348): Ceres ANNOT ID no. 1456223
  misc_feature (19)..(65): Pfam Name: Myb_DNA-binding Pfam Description: Myb-like DNA-binding domain
  misc_feature: SWISSPROT Homolog: MYB_AVIMB Transforming protein Myb with e-value of 1.1e-26 and BLAST sequence identity of 39.2
  misc_feature: SWISSPROT Homolog: MYBB_XENLA Myb-related protein B (B-Myb) (Myb-related protein 1) (XMYB1) with e-value of 1.5e-26 and BLAST sequence identity of 48.5
  misc_feature: SWISSPROT Homolog: MYB_HUMAN Myb proto-oncogene protein (C-myb) with e-value of 1.8e-26 and BLAST sequence identity of 40.4
  misc_feature: SWISSPROT Homolog: MYB_CHICK Myb proto-oncogene protein (C-myb) with e-value of 2.3e-26 and BLAST sequence identity of 39.5
  misc_feature: SWISSPROT Homolog: MYBA_XENLA Myb-related protein A (A-Myb) (XAMYB) (MYB-related protein 2) (XMYB2) with e-value of 2.9e-26 and BLAST sequence identity of 47.5
  misc_feature 332684:<222: Transcription Factor
  misc_feature: Phenotype: ROSETTE LEAVES - Cup-shaped Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Serrate Margins Useful for making plants with increased biomass and foliage
  misc_feature (1)..(348): Functional Homolog of  Ceres CLONE ID no. 382267 at SEQ ID NO. 3033 with e-value of 9.09E-51 and BLAST sequence identity of 81.5
MEDLKGSSSSDDGKTSCHRGHWRPAEDEKLRQLVDQYGPQNWNFIAEHLQGRSGKSCRLRWYNQLDPNINKRPFTEDEEERLLKAHQIHGNRWASISRLFPGRTDNAVKNHYHVVMARRKRERCLTFHGKRNNFQVQYSTDHHLRSNRNSSTPPGSNFGFFRPQVSLDYGSKLGFQNNIIERKGTNIPMTSSNSSPSWTNVSASTITNDSLSFDVFDAKRKDYIQYSSSNSSLHPKEGPLALNESLHCTYHPSSTIYNNYQNVVGQQIPNAKKVDPNNPFALTSYGDGYGSNKEKITESQLVRLNSNNHEPAALWKLPMASQQEEKDHGGQLKNQDVAFIDFLGVGIS

SEQ ID NO: 2989 - DNA, 756 bp, Populus balsamifera subsp. trichocarpa
  misc_feature (1)..(756): Ceres ANNOT ID no. 1467304
  misc_feature 332797:<222: Transcription Factor
  misc_feature: Phenotype: ROSETTE LEAVES - Cup-shaped Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Serrate Margins Useful for making plants with increased biomass and foliage
atgtgcactagaggacattggaggcctgctgaggatgagaaacttaaggaattggttgaaaagtatggtcctcataattggaacgccattgccgaaaagcttcaaggaagatcagaaattaaacaactagcagggtttgggaagagttgtaggttgagatggtttaatcagctggatccaagaatcaatagaagcccgtttacagaagaggaagaagaaagactacttgcttcccacaggattcatgggaatagatgggcaattattgcaagatttttccctggtcgcaccgataatgcagtgaagaatcattggcatgtcatcatggcaagaagatatagagagaggtctagacttcatgcaaaaagggctgctcaaactttggtaaatgataacaaattatcctcaaaacaagatcacatgcacatggattgtgagacgaggaatttttcttcattttccaagaaatattgtgaaaaatatggccaatatcctatggttactcacagctacttaccggccttttgcaaagagttctacaatgaagatccaagtcattgtgaagatcaaagtcggccgattgagttttatgattttctccaagtaaacactgactccaataaaagtgaagtgatagacaatgcaagaagagatgatgaggaggtagatcagcaggaagccttggaaaataatcagagcaaggctgatgttccattcattgattttttctctgttaatggcaaatcctcatcataa

SEQ ID NO: 2990 - protein, 251 aa, Populus balsamifera subsp. trichocarpa
  misc_feature (1)..(251): Ceres ANNOT ID no. 1467304
  misc_feature (64)..(109): Pfam Name: Myb_DNA-binding Pfam Description: Myb-like DNA-binding domain
  misc_feature: SWISSPROT Homolog: MYB_AVIMB Transforming protein Myb with e-value of 1.1e-26 and BLAST sequence identity of 39.2
  misc_feature: SWISSPROT Homolog: MYBB_XENLA Myb-related protein B (B-Myb) (Myb-related protein 1) (XMYB1) with e-value of 1.5e-26 and BLAST sequence identity of 48.5
  misc_feature: SWISSPROT Homolog: MYB_HUMAN Myb proto-oncogene protein (C-myb) with e-value of 1.8e-26 and BLAST sequence identity of 40.4
  misc_feature: SWISSPROT Homolog: MYB_CHICK Myb proto-oncogene protein (C-myb) with e-value of 2.3e-26 and BLAST sequence identity of 39.5
  misc_feature: SWISSPROT Homolog: MYBA_XENLA Myb-related protein A (A-Myb) (XAMYB) (MYB-related protein 2) (XMYB2) with e-value of 2.9e-26 and BLAST sequence identity of 47.5
  misc_feature 332907:<222: Transcription Factor
  misc_feature: Phenotype: ROSETTE LEAVES - Cup-shaped Useful for making ornamental plants with altered leaf shape
  misc_feature: Phenotype: WHOLE PLANT - Dark Green Useful for increasing chlorophyll and photosynthetic capacity
  misc_feature: Phenotype: ROSETTE LEAVES - Serrate Margins Useful for making plants with increased biomass and foliage
  misc_feature (1)..(251): Functional Homolog of  Ceres CLONE ID no. 382267 at SEQ ID NO. 3033 with e-value of 8.59E-44 and BLAST sequence identity of 79.8
MCTRGHWRPAEDEKLKELVEKYGPHNWNAIAEKLQGRSEIKQLAGFGKSCRLRWFNQLDPRINRSPFTEEEEERLLASHRIHGNRWAIIARFFPGRTDNAVKNHWHVIMARRYRERSRLHAKRAAQTLVNDNKLSSKQDHMHMDCETRNFSSFSKKYCEKYGQYPMVTHSYLPAFCKEFYNEDPSHCEDQSRPIEFYDFLQVNTDSNKSEVIDNARRDDEEVDQQEALENNQSKADVPFIDFFSVNGKSSS

SEQ ID NO: 2991 - protein, 364 aa, Zea mays
  misc_feature (1)..(364): Ceres CLONE ID no. 389585
  misc_feature (1)..(364): Also Known As Ceres CDNA ID no. 23810539
  misc_feature (1)..(364): Also Known As Ceres GEMINI ID 539A11
  misc_feature (90)..(263): Pfam Name: DEAD Pfam Description: DEAD/DEAH box helicase
  misc_feature 333022:<222: Transcription Factor
  misc_feature: Phenotype: Activates expression of the gene endogenous to the AtDXPR (SEQ ID NO 4143) regalutory region Useful for modulating Terpenoid Biosynthesis
MEDEENIEGELLLVESQLHDIQGQIKTLLDRQEELYERQAQLKALLEASKLTRNTTINTSSVAPEDWSGSFPWDLEADDTRFNIFGISSYRSNQREIINAVMSGRDVLVIMAAGGGKSLCYQLPAVLRDGIALVVSPLLSLIQDQVIGLSALGIPAYMLTSTTNKEVEKFIYKTLDKGEGELKILYVTPEKISKSKRFMSKLEKCHHAGRLSLIAIDEAHCCSQWGHDFRPDYKNLGILKIQFPSVPMIALTATATSKVQMDLMEMLHIPRCIKFVSTVNRPNLFYKVSEKSPVGKVVIDEITKFISESYPNNESGIIYCFSRKECEQVAKELRERGISADYYHADMDIVNREKIHMRIDTQGM

SEQ ID NO: 2992 - DNA, 2160 bp, Populus balsamifera subsp. trichocarpa
  misc_feature (1)..(2160): Ceres ANNOT ID no. 1500154
  misc_feature 333116:<222: Transcription Factor
  misc_feature: Phenotype: Activates expression of the gene endogenous to the AtDXPR (SEQ ID NO 4143) regalutory region Useful for modulating Terpenoid Biosynthesis
atggaaactgaagcggatgtattagaagagctactcaatatagagacagagattgaagatgttcaagaccagataaagttattactagaaagacaagagaagttgcacgagagacaatctgaattgaagtttttgttggaagcatataaagcatctggaactgggaattctgcaaatgaaaatgcttctcgatcttcttctttggaagactggtcaggttcatttgagtgggattctcaagctgatgatgttaggcttaatatttttggcataccctcttatcgtcaaaatcaaaaggagcttaaactcaaccagatcataaatgctatcatgagcggaagagatgttctagtgattatggctgcaggtggtggtaagagcctttgttaccagctgccagctattcttcgtgatggtgtggccctcgttattagtcctttactctctttgatccaagatcaggttatgggtttgactgctttaggcattccggctttcatgttgacatcgaccactagcaaggaaaatgagaagttcatatacaaggcccttgaaaagggtgagggtgagcttaagatcttgtatgtcacaccagaaaagatatcaaagagcaaaagattcatgtcaaaacttgaaaaatgccataatgcggggcgtctctcactaatttcaattgatgaggcgcattgctgcagtcagtggggtcatgactttcgccccgactacaagagcctcagtatcctcaagactcagttttccaatgttcccgtggtggctttgactgcaactgccacacaaaaagttcagtatgatgtaatggagatgctgcgcattccaaaatgtgttaaatttgtcagtacggtcaataggccaaaccttttctacacggtacggagcaagtcatctgttggtaaggtggttgttgatgaaattgctgaattcattcaagaatcttattcaaacagtgaatctgggatagtgtactgcttctcgagaaaagaatgtgaacaggttgcggcagagttacgtgagagaggaattgcagctgattattaccatgcagatatggatgtaaacgctcgtgagaaagttcatacgtggtggagcaaaaacaagctgcaagtcattgttggtacagtggcatttggaatgggaatcaacaaaccagatggtgttaggtttgtcatccatcacagcctgagtaaatcaatggaaacatattaccaggaaagtggtcgagctggacgagatgggctgccttctgaatgtgtactcttttataggcctgctgatgttcccaggcagagttcgatggttttctatgagaattctggattgcagaatttatatgacatagtaagatactgtcagtctaaaagacaatgtcgtcgaaatgcctttttccgacattttgctgagccattacaagactgcaatgggatgtgtgataattgtgcttttcttagtgaagttatggaagttgatgtatctcgtcatgcgaaagttatggtttcattgctgcaagatacgcaagagaaagatcagaggctgacaatgttgcaattagtggacaaaatgaaaaataagaaggaactaggttctgacataaagaaggaggaaatggaacagcttgtcatacagcttatacttgactttgtttttaaagaagaatatcaacatacagcctatgctacaaatgcttatgtgacaataggtccattggcaaatcaggtgctgcaaggcaagaagatagttaagcttgagatctctagcaaacagaagaataagggtgacagcatgaaatcagcaaagcacagccttgcattttcaggtttggagttgaaacttgatgagttgcgggagaaactctcttcaggtcatggtggaatattcccccattctgtcttgtctagccagcagatgagcatgataagttcccagaaaccaagttcagcacaagagttggagaagataattggaaagctgaagacagaaaagtatgggagtaaaattctagatgagatcaagaagtacactggctctgagccgcctgataatggcatgttgaatgaggaagaaggaagcgggaatagagctagcaagcggttaaagacgaaaaagggtattgttgttatcgagagcagtgatgaggaattataa

SEQ ID NO: 2993 - protein, 719 aa, Populus balsamifera subsp. trichocarpa
  misc_feature (1)..(719): Ceres ANNOT ID no. 1500154
  misc_feature (103)..(272): Pfam Name: DEAD Pfam Description: DEAD/DEAH box helicase
  misc_feature (341)..(418): Pfam Name: Helicase_C Pfam Description: Helicase conserved C-terminal domain
  misc_feature: SWISSPROT Homolog: RECQ1_MOUSE ATP-dependent DNA helicase Q1 (EC 3.6.1.-) (DNA-dependent ATPase Q1) with e-value of 1.5e-81 and BLAST sequence identity of 45.7
  misc_feature: SWISSPROT Homolog: RECQ1_RAT ATP-dependent DNA helicase Q1 (EC 3.6.1.-) (DNA-dependent ATPase Q1) with e-value of 1.0e-80 and BLAST sequence identity of 46.0
  misc_feature: SWISSPROT Homolog: RECQ1_PONPY ATP-dependent DNA helicase Q1 (EC 3.6.1.-) (DNA-dependent ATPase Q1) with e-value of 4.5e-80 and BLAST sequence identity of 45.3
  misc_feature: SWISSPROT Homolog: RECQ1_HUMAN ATP-dependent DNA helicase Q1 (EC 3.6.1.-) (DNA-dependent ATPase Q1) with e-value of 1.2e-79 and BLAST sequence identity of 45.0
  misc_feature: SWISSPROT Homolog: RECQ1_CAEEL Putative ATP-dependent DNA helicase Q1 (EC 3.6.1.-) with e-value of 1.7e-73 and BLAST sequence identity of 44.3
  misc_feature 333267:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(719): Functional Homolog of  Ceres CLONE ID no. 389585 at SEQ ID NO. 3038 with e-value of 1.30E-143 and BLAST sequence identity of 76.9
METEADVLEELLNIETEIEDVQDQIKLLLERQEKLHERQSELKFLLEAYKASGTGNSANENASRSSSLEDWSGSFEWDSQADDVRLNIFGIPSYRQNQKELKLNQIINAIMSGRDVLVIMAAGGGKSLCYQLPAILRDGVALVISPLLSLIQDQVMGLTALGIPAFMLTSTTSKENEKFIYKALEKGEGELKILYVTPEKISKSKRFMSKLEKCHNAGRLSLISIDEAHCCSQWGHDFRPDYKSLSILKTQFSNVPVVALTATATQKVQYDVMEMLRIPKCVKFVSTVNRPNLFYTVRSKSSVGKVVVDEIAEFIQESYSNSESGIVYCFSRKECEQVAAELRERGIAADYYHADMDVNAREKVHTWWSKNKLQVIVGTVAFGMGINKPDGVRFVIHHSLSKSMETYYQESGRAGRDGLPSECVLFYRPADVPRQSSMVFYENSGLQNLYDIVRYCQSKRQCRRNAFFRHFAEPLQDCNGMCDNCAFLSEVMEVDVSRHAKVMVSLLQDTQEKDQRLTMLQLVDKMKNKKELGSDIKKEEMEQLVIQLILDFVFKEEYQHTAYATNAYVTIGPLANQVLQGKKIVKLEISSKQKNKGDSMKSAKHSLAFSGLELKLDELREKLSSGHGGIFPHSVLSSQQMSMISSQKPSSAQELEKIIGKLKTEKYGSKILDEIKKYTGSEPPDNGMLNEEEGSGNRASKRLKTKKGIVVIESSDEEL

SEQ ID NO: 2994 - protein, 124 aa, Zea mays
  misc_feature (1)..(124): Ceres CLONE ID no. 397320
  misc_feature (16)..(108): Pfam Name: DUF1313 Pfam Description: Protein of unknown function (DUF1313)
MEGGETTLSGFGGAGAPGVDTKVLHAFQTSFVQVQTLLDQNRLLINEINHNHESKVPGDLSRNVGLIRELNNNIRRVVDLYADLSSLFAAADGGGGRAASEGGSVGTVRHQAGAGHKRIRSGLD

SEQ ID NO: 2995 - DNA, 345 bp, Populus balsamifera subsp. trichocarpa
  misc_feature (1)..(345): Ceres ANNOT ID no. 1484716
  misc_feature 333480:<222: Transcription Factor
atggagggtgacacattctcaggacttggcaatggtacccagatagatggcaagatcttgcagacatttcaaaagaactttgttcaggtccaaaatatcttggatcagaataggcttctcattaatgagataaatcagaaccatgaatccaagatccctgacaacctgagcagaaatgtgggtttgataagggagctcaacaacaatatcaggagggtagttgacctttatgctgatctttctacctccttcaccaaatccatggacgcctcttctgagggggattctagtggtgccttgaaatctgatggcaaaggtggccacaagagaaatagacctgcatag

SEQ ID NO: 2996 - protein, 114 aa, Populus balsamifera subsp. trichocarpa
  misc_feature (1)..(114): Ceres ANNOT ID no. 1484716
  misc_feature (12)..(100): Pfam Name: DUF1313 Pfam Description: Protein of unknown function (DUF1313)
  misc_feature 333516:<222: Transcription Factor
  misc_feature (1)..(114): Functional Homolog of  Ceres CLONE ID no. 397320 at SEQ ID NO. 3041 with e-value of 3.99E-30 and BLAST sequence identity of 66.0
MEGDTFSGLGNGTQIDGKILQTFQKNFVQVQNILDQNRLLINEINQNHESKIPDNLSRNVGLIRELNNNIRRVVDLYADLSTSFTKSMDASSEGDSSGALKSDGKGGHKRNRPA

SEQ ID NO: 2997 - DNA, 345 bp, Populus balsamifera subsp. trichocarpa
  misc_feature (1)..(345): Ceres ANNOT ID no. 1499354
  misc_feature 333566:<222: Transcription Factor
atggaaggtgatttatttccaggtttaagcaatggaaaccaagtagatggtaaggttttgcaaacattccagaagagttttgtgcaagtccaggacattctggatcaaaacaggttgctaatcaatgaaataaaccaaaaccacgagtcgaagatcccagacaacctgactcgaaatgttggtttgatcaaggagctaaacaataacattagaagggtggtggatctttatgctgatctttcgagcaatttcaccaggtcaatggaaccttcatcagagggtgaatcaagcgggatattgaagtccaatggaaaggcaaattcgaagagaattagatccgggtaa

SEQ ID NO: 2998 - protein, 114 aa, Populus balsamifera subsp. trichocarpa
  misc_feature (1)..(114): Ceres ANNOT ID no. 1499354
  misc_feature (12)..(100): Pfam Name: DUF1313 Pfam Description: Protein of unknown function (DUF1313)
  misc_feature 333602:<222: Transcription Factor
  misc_feature (1)..(114): Functional Homolog of  Ceres CLONE ID no. 397320 at SEQ ID NO. 3041 with e-value of 7.49E-29 and BLAST sequence identity of 69.0
MEGDLFPGLSNGNQVDGKVLQTFQKSFVQVQDILDQNRLLINEINQNHESKIPDNLTRNVGLIKELNNNIRRVVDLYADLSSNFTRSMEPSSEGESSGILKSNGKANSKRIRSG

SEQ ID NO: 2999 - DNA, 345 bp, Populus balsamifera subsp. trichocarpa
  misc_feature (1)..(345): Ceres ANNOT ID no. 1491719
  misc_feature 333652:<222: Transcription Factor
atggaaggtgatttattttcaggcttaagcaatggaaaccaagtagatggcaaggtcttgcaaacattccagaagagttttgtgcaagttcaggatattctagatcaaaacaggttgctaattaatgagataaaccaaaaccatgaatcgaagatccctgacaacttgactcgaaatgttggtttgattaaggagctaaacaacaacattagaagggtggttgacctttatgctgatctttcgaacaatttcaccaggtcaatggaaccttcatcagaaggtgaatcaagtgggatattgaagtctaatggaaaggccaattcgaagagaattagatccgggtaa

SEQ ID NO: 3000 - protein, 114 aa, Populus balsamifera subsp. trichocarpa
  misc_feature (1)..(114): Ceres ANNOT ID no. 1491719
  misc_feature (12)..(100): Pfam Name: DUF1313 Pfam Description: Protein of unknown function (DUF1313)
  misc_feature 333688:<222: Transcription Factor
  misc_feature (1)..(114): Functional Homolog of  Ceres CLONE ID no. 397320 at SEQ ID NO. 3041 with e-value of 1.20E-28 and BLAST sequence identity of 64.0
MEGDLFSGLSNGNQVDGKVLQTFQKSFVQVQDILDQNRLLINEINQNHESKIPDNLTRNVGLIKELNNNIRRVVDLYADLSNNFTRSMEPSSEGESSGILKSNGKANSKRIRSG

SEQ ID NO: 3001 - DNA, 321 bp, Populus balsamifera subsp. trichocarpa
  misc_feature (1)..(321): Ceres ANNOT ID no. 1533409
  misc_feature 333738:<222: Transcription Factor
atgccaggcttaagcaatggaaaccaagtacatagcaagattttgcaaacattccagaagagttttgtgcaagttgaggacattctggatcaaaacaggttactaatcaatgaaataaaccaaaaccaggaatcgaagatcccagacaaattgactcgagatgttggtttgatcaaggagctaaacattaacatcagaagggcggtcggtctttatgctgatctttcctgcaatttcaatatcaggtcaatggaaccttcatcagaaggtgaatcaagtgggatatcgaagtccaattccatgagaactaaatccgggtaa

SEQ ID NO: 3002 - protein, 106 aa, Populus balsamifera subsp. trichocarpa
  misc_feature (1)..(106): Ceres ANNOT ID no. 1533409
  misc_feature (7)..(96): Pfam Name: DUF1313 Pfam Description: Protein of unknown function (DUF1313)
  misc_feature 333774:<222: Transcription Factor
  misc_feature (1)..(106): Functional Homolog of  Ceres CLONE ID no. 397320 at SEQ ID NO. 3041 with e-value of 2.89E-20 and BLAST sequence identity of 62.3
MPGLSNGNQVHSKILQTFQKSFVQVEDILDQNRLLINEINQNQESKIPDKLTRDVGLIKELNINIRRAVGLYADLSCNFNIRSMEPSSEGESSGISKSNSMRTKSG

SEQ ID NO: 3003 - protein, 129 aa, Glycine max
  misc_feature (1)..(129): Ceres CLONE ID no. 463203
  misc_feature (1)..(108): Pfam Name: Yippee Pfam Description: Yippee putative zinc-binding protein
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
MGRLFVVNLEGKIYSCKHCHTHLALYDDIYSRTFHCRHGKAYLFNKVVNVSIGEMEDRPMMTGLHTVADIFCVGCGSIVGWKYETAYEKNQKYKEGKSVLERYKVSGPDGSNYWISNEAHVGGSDADDA

SEQ ID NO: 3004 - DNA, 393 bp, Populus balsamifera subsp. trichocarpa
  misc_feature (1)..(393): Ceres ANNOT ID no. 1511505
  misc_feature 333904:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggggaggctgtttgttgtggatcttgaagggaagatctatagttgcaagcactgcaggacccatcttgctctttatgacgatattgtttcaaagtcttttcactgcaggcatgggaaagcctatctcttcaataaggtagcgaatgtatttttgggagagaaggaagagagaatgatgattaccgggctgcataccgttgctgacattttctgtgtcgggtgtggatcaattgtgggttggaaatatgagactgcacatgaaaggagtcagaagtacaaggaaggaaaatctgtgcttgagcggtttaaggtgtctggtcctgatggaagccattattgggtgaatcatgaacaccaccacatcggtggaagtgatgcagacgatgtttga

SEQ ID NO: 3005 - protein, 130 aa, Populus balsamifera subsp. trichocarpa
  misc_feature (1)..(130): Ceres ANNOT ID no. 1511505
  misc_feature (1)..(108): Pfam Name: Yippee Pfam Description: Yippee putative zinc-binding protein
  misc_feature: SWISSPROT Homolog: YIPL_SOLTU Protein yippee-like with e-value of 9.5e-55 and BLAST sequence identity of 77.3
  misc_feature: SWISSPROT Homolog: YIPL3_ARATH Protein yippee-like At3g11230 with e-value of 4.8e-51 and BLAST sequence identity of 73.6
  misc_feature: SWISSPROT Homolog: YIPL1_ARATH Protein yippee-like At3g08990 with e-value of 6.1e-44 and BLAST sequence identity of 62.5
  misc_feature: SWISSPROT Homolog: YIPL4_ARATH Protein yippee-like At3g55890 with e-value of 2.1e-41 and BLAST sequence identity of 68.4
  misc_feature: SWISSPROT Homolog: YIPL6_ARATH Protein yippee-like At5g53940 with e-value of 1.8e-37 and BLAST sequence identity of 56.6
  misc_feature 334012:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(130): Functional Homolog of  Ceres CLONE ID no. 463203 at SEQ ID NO. 3050 with e-value of 1.99E-58 and BLAST sequence identity of 82.8
MGRLFVVDLEGKIYSCKHCRTHLALYDDIVSKSFHCRHGKAYLFNKVANVFLGEKEERMMITGLHTVADIFCVGCGSIVGWKYETAHERSQKYKEGKSVLERFKVSGPDGSHYWVNHEHHHIGGSDADDV

SEQ ID NO: 3006 - protein, 281 aa, Glycine max
  misc_feature (1)..(281): Ceres CLONE ID no. 464504
  misc_feature (124)..(188): Pfam Name: AP2 Pfam Description: AP2 domain
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: WHOLE PLANT - Small Useful for modulating plant size
MQSSISQSDIFITDYLVPQEVPFQFQFQDMSKNDNNMPMNHTNNNLQMPQITSFSKPPRSSSNLSNRKPSLKNITIPSITSGLATAMSQTTATTTTIATTMYNNNQVSSSSFSSDETNNTKDDKHYRGVRRRPWGKYAAEIRDPNRKGSRVWLGTFDTAIEAAKAYDKAAFKMRGSKAILNFPLEIGSDQSKEESSSSSSSVSSSSIVIKVGVKREREEESERKNNYEKSEFNNNSNSNKHVKKEECPLTPSCWKGFWDTDVMGTIFSVPPLSPLSPLMVV

SEQ ID NO: 3007 - DNA, 864 bp, Populus balsamifera subsp. trichocarpa; identical to SEQ ID NO: 2059
  misc_feature (1)..(864): Ceres ANNOT ID no. 1438401
  misc_feature 334196:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: WHOLE PLANT - Small Useful for modulating plant size

SEQ ID NO: 3008 - protein, 263 aa, Populus balsamifera subsp. trichocarpa
  misc_feature (1)..(263): Ceres ANNOT ID no. 1438401
  misc_feature (104)..(168): Pfam Name: AP2 Pfam Description: AP2 domain
  misc_feature: SWISSPROT Homolog: ERF5_TOBAC Ethylene-responsive transcription factor 5 EREBP-4 (NtERF4) with e-value of 1.8e-37 and BLAST sequence identity of 55.1
  misc_feature: SWISSPROT Homolog: ERF5_NICSY Ethylene-responsive transcription factor 5 EREBP-4 (NsERF4) with e-value of 5.4e-36 and BLAST sequence identity of 45.8
  misc_feature: SWISSPROT Homolog: ERF5_ARATH Ethylene-responsive transcription factor 5 EREBP-5 (AtERF5) with e-value of 2.5e-32 and BLAST sequence identity of 56.2
  misc_feature: SWISSPROT Homolog: ERF6_ARATH Ethylene-responsive transcription factor 6 EREBP-6 (AtERF6) with e-value of 8.2e-30 and BLAST sequence identity of 44.6
  misc_feature: SWISSPROT Homolog: ERF2_ARATH Ethylene-responsive transcription factor 2 EREBP-2 (AtERF2) with e-value of 1.3e-27 and BLAST sequence identity of 61.0
  misc_feature 334311:<222: Transcription Factor
  misc_feature: Phenotype: WHOLE PLANT - Dark Green Useful for increasing chlorophyll and photosynthetic capacity
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature (1)..(263): Functional Homolog of  Ceres CLONE ID no. 464504 at SEQ ID NO. 3053 with e-value of 1.49E-46 and BLAST sequence identity of 55.3
MDSFISNLDDLCSTSTTSTTDDYYIKSESTEFDPFDQPQFKLQTQSSIESKPQYSSPKSSTSLSQRKPSMIKDIAIPPPATLNMNPQVAQPVVNKTDLSSEQDRHYRGVRRRPWGKYAAEIRDPNKKGARVWLGTFDTAIEAAKAYDSAAFRLRGSKAILNFPLEAGKSNSQQPEQFLETSCKKRKFEGIKSSVEGTNSITNKVVKRETSSPESEVKAVASGPLTPSSWKGFWDGETMGIFSVPPLSPLSPHPSFGYSRLMVV

SEQ ID NO: 3009 - protein, 268 aa, Glycine max
  misc_feature (1)..(268): Ceres CLONE ID no. 471089
  misc_feature (1)..(268): Also Known As Ceres CDNA ID no. 23662829
  misc_feature (1)..(268): Also Known As Ceres GEMINI ID 540E4
  misc_feature (171)..(204): Pfam Name: TPR_1 Pfam Description: Tetratricopeptide repeat
  misc_feature (96)..(129): Pfam Name: TPR_2 Pfam Description: Tetratricopeptide repeat
  misc_feature 334435:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature: Phenotype: Activates expression of the gene endogenous to the PsHMCOMT2 (SEQ ID NO 4162) regalutory region Useful for modulating Alkaloid Biosynthesis
MVLIEHEESKQRNANPSNAANDDSDGFETASDTDLAGEGDDSGAGIPEEQNRTEQSHTEKQTEQEPEHDAPRSSKSSENNALISEEESRQKALNQANEAKVEGNKLFVEGKYEEALLQYELALQAAPDMPSSVEIRSICHSNRGVCFLKLGKYDNTIKECTKALELNPVYIKALVRRGEAHEKLEHFEEAIADMKKILEIDLSNDQARKTIRQLEPLAAEKREKMKEEMIAKLKDMGNSVLGRFGMSVDNFKAVKDPNTGSYSISFQR

SEQ ID NO: 3010 - DNA, 837 bp, Populus balsamifera subsp. trichocarpa
  misc_feature (1)..(837): Ceres ANNOT ID no. 1531777
  misc_feature 334527:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature: Phenotype: Activates expression of the gene endogenous to the PsHMCOMT2 (SEQ ID NO 4162) regalutory region Useful for modulating Alkaloid Biosynthesis
atggtggtgatcgatccagaagaaaccgtactcgaaaataccccgaaacctccccaaccagcaccatcaacatcaaaaacgacgacggattcgaccagcagcgaaaccaccacaacgacaacgaaagcagcagcagtgaagggaagcgattccgatggatttgaaacggcaagcgaaagcggagtcagcgacaacgaagaagagcaggtagaaaatgtcagtaaagaaatcagtagcaaaaacaccactgaggatcagccaaaacaagatactcaaaacgacgacgaattgattcagagaggtatagaggaagcaaatgaagcaaagttggaagggaataggttgtttggaaatgggcaatatgaggaggcattattacagtatgatgtggctttacaagtttcccctccggacgtgccatcatccattgagttgcgttccatttgccattccaatcgcggcgtttgtttcttgaaattggggaaatttgaggacacgatcaaggaatgctcaaaagcattagaattaaatccttcttacatgaaagctcttgttagaagaggagaggctcatgaaaagcttgaacatttcgaggaggctattgctgatatgaaaaaaatcttggaattggatccctcaaatgaccaagctaagagaaccattcgccgcttggagccactggctgccgctaagcgagaaaagatgaatgaagagatgattggaaagctgaaagatatggggaacactttgctgggccgctttggcatgagcgttgacaacttcaaagctgttcaagatccaaatactggctcctattccatctcattccaacgttaa

SEQ ID NO: 3011 - protein, 278 aa, Populus balsamifera subsp. trichocarpa
  misc_feature (1)..(278): Ceres ANNOT ID no. 1531777
  misc_feature (105)..(138): Pfam Name: TPR_2 Pfam Description: Tetratricopeptide repeat
  misc_feature: SWISSPROT Homolog: TTC1_HUMAN Tetratricopeptide repeat protein 1 (TPR repeat protein 1) with e-value of 5.4e-36 and BLAST sequence identity of 39.6
  misc_feature: SWISSPROT Homolog: TTC1_MOUSE Tetratricopeptide repeat protein 1 (TPR repeat protein 1) with e-value of 8.8e-36 and BLAST sequence identity of 38.9
  misc_feature: SWISSPROT Homolog: TOM70_MOUSE Mitochondrial precursor proteins import receptor (Translocase of outer membrane TOM70) with e-value of 4.7e-19 and BLAST sequence identity of 32.3
  misc_feature: SWISSPROT Homolog: SPAG1_MOUSE Sperm-associated antigen 1 with e-value of 7.4e-19 and BLAST sequence identity of 30.0
  misc_feature: SWISSPROT Homolog: SPAG1_MOUSE Infertility-related sperm protein Spag-1 TPR-containing protein involved in spermatogenesis TPIS
  misc_feature: SWISSPROT Homolog: SPAG1_MOUSE Sperm-associated antigen 1 with e-value of 1.2e-18 and BLAST sequence identity of 32.3
  misc_feature: SWISSPROT Homolog: SPAG1_MOUSE Infertility-related sperm protein Spag-1 TPR-containing protein involved in spermatogenesis TPIS
  misc_feature 334657:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature (1)..(278): Functional Homolog of  Ceres CLONE ID no. 471089 at SEQ ID NO. 3056 with e-value of 1.50E-80 and BLAST sequence identity of 70.6
MVVIDPEETVLENTPKPPQPAPSTSKTTTDSTSSETTTTTTKAAAVKGSDSDGFETASESGVSDNEEEQVENVSKEISSKNTTEDQPKQDTQNDDELIQRGIEEANEAKLEGNRLFGNGQYEEALLQYDVALQVSPPDVPSSIELRSICHSNRGVCFLKLGKFEDTIKECSKALELNPSYMKALVRRGEAHEKLEHFEEAIADMKKILELDPSNDQAKRTIRRLEPLAAAKREKMNEEMIGKLKDMGNTLLGRFGMSVDNFKAVQDPNTGSYSISFQR

SEQ ID NO: 3012 - DNA, 816 bp, Populus balsamifera subsp. trichocarpa
  misc_feature (1)..(816): Ceres ANNOT ID no. 1508033
  misc_feature 334760:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature: Phenotype: Activates expression of the gene endogenous to the PsHMCOMT2 (SEQ ID NO 4162) regalutory region Useful for modulating Alkaloid Biosynthesis
atggtgatgatccagccagaagaagaaaacgaagagaccgtactacaaaatctaccaaagcctcaagcaacagcttcaacatcaaaaaccaccaccagcgacaccaccacaacaaaagagaacggaagcgactccgatgggtttgaaacggcaagcgagcgcggagtcagcgacaacgaagaagaagatattgtcaataagggaatcaaccccgaaaacagcgctgatgatcaacaacaacaacaacatactcaaaacgatgacgaattgattcagagaggtgtagaagaaggaaatgaagcaaaattggaaggcaatagattgtttgggaacgggcagtatgaggaggcattactacagtatgaacttgctttacaagttgccccacaggacgtgccgtcatccgtcgagttgcgttccatttgccatttcaatcgtggcgtttgcttcttgaaattgggaaaatacgaggacacaatcaaggaatgctcaagagcgttagaattgaatccttcttacacgaaagctcttgttagaagaggagaggctcatgaaaagctcgagcattttgaggaggctattgctgatatgaaaaaaaccttggaattcgatccttcaaatgaccaagcaaagaaaaccattcgccgcttggagccacttgctgcagaaaagcgagaaaagatgaaggaagagatgattggaaagctgaaagagatgggaaactctttgctaggccgctttggcatgagcattgacaacttcaaagctgttcaagatccgaataccggttcctattctatttcattccaacgttag

SEQ ID NO: 3013 - protein, 271 aa, Populus balsamifera subsp. trichocarpa
  misc_feature (1)..(271): Ceres ANNOT ID no. 1508033
  misc_feature (98)..(131): Pfam Name: TPR_2 Pfam Description: Tetratricopeptide repeat
  misc_feature: SWISSPROT Homolog: TTC1_HUMAN Tetratricopeptide repeat protein 1 (TPR repeat protein 1) with e-value of 5.4e-36 and BLAST sequence identity of 39.6
  misc_feature: SWISSPROT Homolog: TTC1_MOUSE Tetratricopeptide repeat protein 1 (TPR repeat protein 1) with e-value of 8.8e-36 and BLAST sequence identity of 38.9
  misc_feature: SWISSPROT Homolog: TOM70_MOUSE Mitochondrial precursor proteins import receptor (Translocase of outer membrane TOM70) with e-value of 4.7e-19 and BLAST sequence identity of 32.3
  misc_feature: SWISSPROT Homolog: SPAG1_MOUSE Sperm-associated antigen 1 with e-value of 7.4e-19 and BLAST sequence identity of 30.0
  misc_feature: SWISSPROT Homolog: SPAG1_MOUSE Infertility-related sperm protein Spag-1 TPR-containing protein involved in spermatogenesis TPIS
  misc_feature: SWISSPROT Homolog: SPAG1_RAT Sperm-associated antigen 1 Infertility- related sperm protein Spag-1  HSD-3.8 with e-value of 1.2e-18 and BLAST sequence identity of 32.3
  misc_feature 334882:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature (1)..(271): Functional Homolog of  Ceres CLONE ID no. 471089 at SEQ ID NO. 3056 with e-value of 7.99E-80 and BLAST sequence identity of 63.0
MVMIQPEEENEETVLQNLPKPQATASTSKTTTSDTTTTKENGSDSDGFETASERGVSDNEEEDIVNKGINPENSADDQQQQQHTQNDDELIQRGVEEGNEAKLEGNRLFGNGQYEEALLQYELALQVAPQDVPSSVELRSICHFNRGVCFLKLGKYEDTIKECSRALELNPSYTKALVRRGEAHEKLEHFEEAIADMKKTLEFDPSNDQAKKTIRRLEPLAAEKREKMKEEMIGKLKEMGNSLLGRFGMSIDNFKAVQDPNTGSYSISFQR

SEQ ID NO: 3014 - protein, 354 aa, Glycine max
  misc_feature (1)..(354): Ceres CLONE ID no. 475001
  misc_feature (1)..(354): Also Known As Ceres CDNA ID no. 23663607
  misc_feature (1)..(354): Also Known As Ceres GEMINI ID 540G9
  misc_feature (306)..(346): Pfam Name: zf-C3HC4 Pfam Description: Zinc finger, C3HC4 type (RING finger)
  misc_feature 335002:<222: Transcription Factor
  misc_feature: Phenotype: Activates expression of the gene endogenous to the AtBBE2 (SEQ ID NO 4151) regalutory region Useful for modulating Alkaloid Biosynthesis
MPVVTEHMKWRRPRNQFRHPISETDDPNPQIPSIIQSSHSKSTFSSLFSSFSTSNETRDQNRNNNNKSNRKFSAATFRGFGCTAGASQKVSVPVPAVIRSSADREGKSSRKKKHRRNSNSGNSTSDDDDDDVWCGPGIGFSTDAAAASVECVVARKNVSARGKLDVVEDRVTHRERSSYFGRRTVKPESFSFLEDEPDIFAARPGLEPFGTARFYRHVPHPSPDGLAEIMILQGRIMMGGRFDSHDQFRDWRLDVDNMSYEQLLELGERIGYVNTGLKEDEMGLNIRKVKPSSSNDASKHQLDKKCSVCQEEYESDDELGRLKCDHSYHFQCIKQWLVHKNFCPVCKQEVVVRH

SEQ ID NO: 3015 - DNA, 1155 bp, Populus balsamifera subsp. trichocarpa
  misc_feature (1)..(1155): Ceres ANNOT ID no. 1467833
  misc_feature 335096:<222: Transcription Factor
  misc_feature: Phenotype: Activates expression of the gene endogenous to the AtBBE2 (SEQ ID NO 4151) regalutory region Useful for modulating Alkaloid Biosynthesis
atgccagtttttgcagagagcagtagcagcacaccagcagctatagcagaccaaatcaagctaagaaaacccagaagccaacaagagctgcaacccatttcaactgaaacagatccaaacccacatgcttccaagtcatccaaatccaacacaattatctcctccctcttccactctcacttctctacaaccccacctgaccaatccaagaagaaaggtgccacctttagaggcctaggatgcactgctggagcagctcagcaagtatcggtgccggcggtgataaggtcatccgcggactgggaagggaaaaaggtcaagaagaaaaagggccatccaaaaagaaagaaagagagcttgaaactttgcagtgacaacaacaatactagtaatagcaatggtgatgttaatggagatggtaattttgcgaattgtatggttatgcaagatgtttggtgcggacctggaatggggttatctggtgctgatgctgttgttgggtcagttgactgtgttgtggctagaagaaacgtgtcaattggtagaggaaagattgacggaggagagaaaattaatcaaagggaaagagagagggagagggagagggagagggatagagagagggagagggagcgtccttgtatagttaggcgggcagcagttaatcctgaaactctttcatttctggatactgatcctgcctttataacatctcgtcctgagccagaagtttttggaactcggtattatcgccatattcgacatccttccccagatggacttgctgagataatgatgctccaaaatagtttcatcatgggaggaagaatggatcgatttagcaactggagactagatattgatcacatgacatacgagcaactgctcgatttaggtgatagaattggttatgtgaatactggattgaaagaagatgagatcagccgctgtgttaagaaaattaatccctcattcatcaaggaactgtcatcacatttacccatggtattggaaaagaagtgcagcatttgtcaggatgactacgaagaagatggtgaggtgggaaaacttgattgtggacatggctttcacatacaatgcataaagcaatggcttggacagaaaaatacctgcccacaatgtcatgctgattga

SEQ ID NO: 3016 - protein, 384 aa, Populus balsamifera subsp. trichocarpa
  misc_feature (1)..(384): Ceres ANNOT ID no. 1467833
  misc_feature (341)..(381): Pfam Name: zf-C3HC4 Pfam Description: Zinc finger, C3HC4 type (RING finger)
  misc_feature: SWISSPROT Homolog: RNF13_MOUSE RING finger protein 13 with e-value of 7.4e-08 and BLAST sequence identity of 53.2
  misc_feature: SWISSPROT Homolog: ATL1Q_ARATH RING-H2 finger protein ATL1Q with e-value of 7.5e-08 and BLAST sequence identity of 27.5
  misc_feature: SWISSPROT Homolog: RHA2B_ARATH RING-H2 zinc finger protein RHA2b with e-value of 1.1e-07 and BLAST sequence identity of 32.9
  misc_feature: SWISSPROT Homolog: ATL4E_ARATH RING-H2 finger protein ATL4E with e-value of 1.4e-07 and BLAST sequence identity of 29.1
  misc_feature: SWISSPROT Homolog: RNF13_CHICK RING finger protein 13 (C-RZF) with e-value of 1.6e-07 and BLAST sequence identity of 51.1
  misc_feature 335203:<222: Transcription Factor
  misc_feature: Phenotype: Activates expression of the gene endogenous to the AtBBE2 (SEQ ID NO 4151) regalutory region Useful for modulating Alkaloid Biosynthesis
  misc_feature (1)..(384): Functional Homolog of  Ceres CLONE ID no. 475001 at SEQ ID NO. 3061 with e-value of 4.30E-81 and BLAST sequence identity of 59.1
MPVFAESSSSTPAAIADQIKLRKPRSQQELQPISTETDPNPHASKSSKSNTIISSLFHSHFSTTPPDQSKKKGATFRGLGCTAGAAQQVSVPAVIRSSADWEGKKVKKKKGHPKRKKESLKLCSDNNNTSNSNGDVNGDGNFANCMVMQDVWCGPGMGLSGADAVVGSVDCVVARRNVSIGRGKIDGGEKINQRERERERERERDRERERERPCIVRRAAVNPETLSFLDTDPAFITSRPEPEVFGTRYYRHIRHPSPDGLAEIMMLQNSFIMGGRMDRFSNWRLDIDHMTYEQLLDLGDRIGYVNTGLKEDEISRCVKKINPSFIKELSSHLPMVLEKKCSICQDDYEEDGEVGKLDCGHGFHIQCIKQWLGQKNTCPQCHAD

SEQ ID NO: 3017 - DNA, 1101 bp, Populus balsamifera subsp. trichocarpa
  misc_feature (1)..(1101): Ceres ANNOT ID no. 1526695
  misc_feature 335311:<222: Transcription Factor
  misc_feature: Phenotype: Activates expression of the gene endogenous to the AtBBE2 (SEQ ID NO 4151) regalutory region Useful for modulating Alkaloid Biosynthesis
atgccggtttttgcagagagcagcaacacaactatagctgaccaaatcaagctaagaaaacacagagagctgcaacccattgcaactgaaacagatccaaacccacatatctctaggacctccaaatccaatacaataatctcctccctcttccactctcacttcactgcaaccccacctgaccaaacaaagaagaaaggtgcaacctttagaggcctaggatgcactgctggagcagcacagcaggtgtcggtgccggcggtgataaggtcatcggctggctgggaagggaaaagggtcaagaagaaaaagggtcatcagaaaagaaagaaagaaagcttgaaactttccagtgacaacaacaacaatagtaataatagcaatggtgatggtgatcttagtggagatggtaatcttgggaattgcatggttatgcaagatgtttggtgtggacctggaattgggttttcaggtgctgatgctgttgttgggtcagttgactgtgttgtcgttagaaggaacgcgcgggctgcagtgaatcctgaaaccccctcgtttctggatactgatcctgcttttgtaacatctcgtcctgaaatagaagtttttggaactcggtattatcgccatatccgacatccttccccagatggacttgctaggcattctgattatttagccgctgttctttcattagtgaccagtactggcaaattgcagatgatgatgctccagaatagttttatcatgggaggaagattggatcgatttagcaactggagacttgatattgatcacatgacatatgagcaactgctcgatttaggtgatagaattggttatgtgaatactggattgaaagaagatgagatcagcagctgtgtcaagaaaattaatccctcaatcatcgaagaactgccatcacatttacacatgacattggaaaagaagtgcagcatttgtcaggatgagttcgaagaagctgatgagttaggcaaactagattgtggacatggttttcacatacaatgtataaagaaatggcttgcacagaaaaatacatgcccggtctgtaaaactgaaccggtggctcgagcctaa

SEQ ID NO: 3018 - protein, 366 aa, Populus balsamifera subsp. trichocarpa
  misc_feature (1)..(366): Ceres ANNOT ID no. 1526695
  misc_feature (318)..(358): Pfam Name: zf-C3HC4 Pfam Description: Zinc finger, C3HC4 type (RING finger)
  misc_feature: SWISSPROT Homolog: RNF13_MOUSE RING finger protein 13 with e-value of 7.4e-08 and BLAST sequence identity of 53.2
  misc_feature: SWISSPROT Homolog: ATL1Q_ARATH RING-H2 finger protein ATL1Q with e-value of 7.5e-08 and BLAST sequence identity of 27.5
  misc_feature: SWISSPROT Homolog: RHA2B_ARATH RING-H2 zinc finger protein RHA2b with e-value of 1.1e-07 and BLAST sequence identity of 32.9
  misc_feature: SWISSPROT Homolog: ATL4E_ARATH RING-H2 finger protein ATL4E with e-value of 1.4e-07 and BLAST sequence identity of 29.1
  misc_feature: SWISSPROT Homolog: RNF13_CHICK RING finger protein 13 (C-RZF) with e-value of 1.6e-07 and BLAST sequence identity of 51.1
  misc_feature 335416:<222: Transcription Factor
  misc_feature: Phenotype: Activates expression of the gene endogenous to the AtBBE2 (SEQ ID NO 4151) regalutory region Useful for modulating Alkaloid Biosynthesis
  misc_feature (1)..(366): Functional Homolog of  Ceres CLONE ID no. 475001 at SEQ ID NO. 3061 with e-value of 1.89E-69 and BLAST sequence identity of 57.5
MPVFAESSNTTIADQIKLRKHRELQPIATETDPNPHISRTSKSNTIISSLFHSHFTATPPDQTKKKGATFRGLGCTAGAAQQVSVPAVIRSSAGWEGKRVKKKKGHQKRKKESLKLSSDNNNNSNNSNGDGDLSGDGNLGNCMVMQDVWCGPGIGFSGADAVVGSVDCVVVRRNARAAVNPETPSFLDTDPAFVTSRPEIEVFGTRYYRHIRHPSPDGLARHSDYLAAVLSLVTSTGKLQMMMLQNSFIMGGRLDRFSNWRLDIDHMTYEQLLDLGDRIGYVNTGLKEDEISSCVKKINPSIIEELPSHLHMTLEKKCSICQDEFEEADELGKLDCGHGFHIQCIKKWLAQKNTCPVCKTEPVARA

SEQ ID NO: 3019 - DNA, 1014 bp, Populus balsamifera subsp. trichocarpa
  misc_feature (1)..(1014): Ceres ANNOT ID no. 1521201
  misc_feature 335518:<222: Transcription Factor
  misc_feature: Phenotype: Activates expression of the gene endogenous to the AtBBE2 (SEQ ID NO 4151) regalutory region Useful for modulating Alkaloid Biosynthesis
atgccagtttttgcagagagcagtagcagcacaccagcagctatagcagaccaaatcaagctaagaaaacccagaagccaacaagagctgcaacccatttcaactgaaacagatccaaacccacatgcttccaagtcatccaaatccaacacaattatctcctccctcttccactctcacttctctacaaccccacctgaccaatccaagaagaaaggtgccacctttagaggcctaggatgcactgctggagcagctcagcaagtatcggtgccggcggtgataaggtcatccgcggactgggaagggaaaaaggtcaagaagaaaaagggccatccaaaaagaaagaaagagagcttgaaactttgcagtgacaacaacaatactagtaatagcaatggtgatgttaatggagatggtaattttgcgaattgtatggttatgcaagatgtttggtgcggacctggaatggggttatctggtgctgatgctgttgttgggtcagttgactgtgttgtggctagaagaaacgtgtcaattggtagaggaaagattgacggaggagagaaaattaatcaaagggaaagagagagggagagggagagggagagggatagagagagggagagggagataatgatgctccaaaatagtttcatcatgggaggaagaatggatcgatttagcaactggagactagatattgatcacatgacatacgagcaactgctcgatttaggtgatagaattggttatgtgaatactggattgaaagaagatgagatcagccgctgtgttaagaaaattaatccctcattcatcaaggaactgtcatcacatttacccatggtattggaaaagaagtgcagcatttgtcaggatgactacgaagaagatggtgaggtgggaaaacttgattgtggacatggctttcacatacaatgcataaagcaatggcttggacagaaaaatacctgcccagtatgtaagacagaaccggtgggtcgaggctag

SEQ ID NO: 3020 - protein, 337 aa, Populus balsamifera subsp. trichocarpa
  misc_feature (1)..(337): Ceres ANNOT ID no. 1521201
  misc_feature (289)..(329): Pfam Name: zf-C3HC4 Pfam Description: Zinc finger, C3HC4 type (RING finger)
  misc_feature: SWISSPROT Homolog: RNF13_MOUSE RING finger protein 13 with e-value of 7.4e-08 and BLAST sequence identity of 53.2
  misc_feature: SWISSPROT Homolog: ATL1Q_ARATH RING-H2 finger protein ATL1Q with e-value of 7.5e-08 and BLAST sequence identity of 27.5
  misc_feature: SWISSPROT Homolog: RHA2B_ARATH RING-H2 zinc finger protein RHA2b with e-value of 1.1e-07 and BLAST sequence identity of 32.9
  misc_feature: SWISSPROT Homolog: ATL4E_ARATH RING-H2 finger protein ATL4E with e-value of 1.4e-07 and BLAST sequence identity of 29.1
  misc_feature: SWISSPROT Homolog: RNF13_CHICK RING finger protein 13 (C-RZF) with e-value of 1.6e-07 and BLAST sequence identity of 51.1
  misc_feature 335619:<222: Transcription Factor
  misc_feature: Phenotype: Activates expression of the gene endogenous to the AtBBE2 (SEQ ID NO 4151) regalutory region Useful for modulating Alkaloid Biosynthesis
  misc_feature (1)..(337): Functional Homolog of  Ceres CLONE ID no. 475001 at SEQ ID NO. 3061 with e-value of 3.50E-63 and BLAST sequence identity of 59.0
MPVFAESSSSTPAAIADQIKLRKPRSQQELQPISTETDPNPHASKSSKSNTIISSLFHSHFSTTPPDQSKKKGATFRGLGCTAGAAQQVSVPAVIRSSADWEGKKVKKKKGHPKRKKESLKLCSDNNNTSNSNGDVNGDGNFANCMVMQDVWCGPGMGLSGADAVVGSVDCVVARRNVSIGRGKIDGGEKINQRERERERERERDREREREIMMLQNSFIMGGRMDRFSNWRLDIDHMTYEQLLDLGDRIGYVNTGLKEDEISRCVKKINPSFIKELSSHLPMVLEKKCSICQDDYEEDGEVGKLDCGHGFHIQCIKQWLGQKNTCPVCKTEPVGRG

SEQ ID NO: 3021 - protein, 335 aa, Glycine max
  misc_feature (1)..(335): Ceres CLONE ID no. 475689
  misc_feature (1)..(335): Also Known As Ceres CDNA ID no. 23666761
  misc_feature (1)..(335): Also Known As Ceres GEMINI ID 540H1
  misc_feature (127)..(155): Pfam Name: WD40 Pfam Description: WD domain, G-beta repeat
  misc_feature 335738:<222: Transcription Factor
  misc_feature: Phenotype: Activates expression of the gene endogenous to the AtATCPS1 (SEQ ID NO 4148) regalutory region Useful for modulating Terpenoid Biosynthesis
MENSTQESHLRSENSVSYESPYPIYGMSFSPSHPHRLALGSFIEEYTNRVDILSFHPDTLSLTPNPSLSFDHPYPPTKLMFHPRKPPSSSSDLLATSGDYLRLWEVRDNSVEAVSLFNNSKTSEFCAPLTSFDWNDIDPNRIATSSIDTTCTIWDIERTLVETQLIAHDKEVYDIAWGEARVFASVSADGSVRIFDLRDKEHSTIIYESPHPDTPLLRLAWNKQDLRYMATILMDSNKVVILDIRSPTTPVAELERHRGSVNAIAWAPHSSTHICSAGDDTQALIWDLPTLASPTGIDPVCMYSAGCEINQLQWSAVQPEWIAIAFANKMQLLKV

SEQ ID NO: 3022 - DNA, 1023 bp, Populus balsamifera subsp. trichocarpa
  misc_feature (1)..(1023): Ceres ANNOT ID no. 1472897
  misc_feature 335826:<222: Transcription Factor
  misc_feature: Phenotype: Activates expression of the gene endogenous to the AtATCPS1 (SEQ ID NO 4148) regalutory region Useful for modulating Terpenoid Biosynthesis
atggagagctcaacccaagaatcccacctaagatcggaaaacaccataacctatgaatctccataccctctctatgccatggcaatctcttcgaccccatctcgcacaaaccaataccaacgcattgccttgggcagcttcactgaagactacaacaaccgcatagacattgtctcttttgaccctgaaaccctctctgtcaaaacccatcaaaatctctctcttgaacacccttatccacccaccaagctcatgttcagcccttcctctcttcacaagtccaatgaccttttagcctcttctggtgactatcttcgcttatgggaagttagagactctgcttctattgagcctgtttttgtgcttaacaatagtaagacaggtgagttttgtgctcctttaacttcttttgattggaatgatattgaacctaaaagaattggtacttgtagtgttgatacaacctgtacgatttgggatattgaaaagggtgctgttgaaacacaacttatagctcatgataaggaagtttatgatattgcttggggtgaagcaagggtttttgcttcagtttcagctgatgggtcagttaggatttttgatttaagagataaggaacattctactattatatatgagagtcctagacctgatacacccttgttgagattggcttggaacaagcaggatttgaggtatatggccaccacgttgatggatagcaataaagttgtgatcttggatattaggtccccaacaatacctgttgcggagttggagaggcatcgttcgagtgtgaatgctattgcttgggctccgcagagttgttgtcatatttgttctgctggtgatgattcacaggctcttatttgggagttgcctactgtggctggacctaatgggattgatccaatgtccatgtgctctgctgcttctgaaattaaccagcttcaatggtctgctgcactgcctgattggattgctatcgcgttttcaaataaaatgcagcttttaaaagtttga

SEQ ID NO: 3023 - protein, 340 aa, Populus balsamifera subsp. trichocarpa
  misc_feature (1)..(340): Ceres ANNOT ID no. 1472897
  misc_feature (132)..(160): Pfam Name: WD40 Pfam Description: WD domain, G-beta repeat
  misc_feature: SWISSPROT Homolog: TTG1_ARATH TRANSPARENT TESTA GLABRA 1 protein (TTG1 protein) with e-value of 6.0e-140 and BLAST sequence identity of 74.9
  misc_feature: SWISSPROT Homolog: WDR68_HUMAN WD-repeat protein 68 (WD-repeat protein An11 homolog) with e-value of 1.8e-90 and BLAST sequence identity of 53.6
  misc_feature: SWISSPROT Homolog: WDR68_MOUSE WD-repeat protein 68 (WD-repeat protein An11 homolog) with e-value of 1.8e-90 and BLAST sequence identity of 53.6
  misc_feature: SWISSPROT Homolog: HAT2_ASHGO Histone acetyltransferase type B subunit 2 (EC 2.3.1.48) with e-value of 2.7e-14 and BLAST sequence identity of 29.4
  misc_feature: SWISSPROT Homolog: PRW1_SCHPO RbAp48-related WD40-repeat protein prw1 with e-value of 2.2e-12 and BLAST sequence identity of 27.2
  misc_feature 335932:<222: Transcription Factor
  misc_feature: Phenotype: Activates expression of the gene endogenous to the AtATCPS1 (SEQ ID NO 4148) regalutory region Useful for modulating Terpenoid Biosynthesis
  misc_feature (1)..(340): Functional Homolog of  Ceres CLONE ID no. 475689 at SEQ ID NO. 3068 with e-value of 1.20E-140 and BLAST sequence identity of 78.7
MESSTQESHLRSENTITYESPYPLYAMAISSTPSRTNQYQRIALGSFTEDYNNRIDIVSFDPETLSVKTHQNLSLEHPYPPTKLMFSPSSLHKSNDLLASSGDYLRLWEVRDSASIEPVFVLNNSKTGEFCAPLTSFDWNDIEPKRIGTCSVDTTCTIWDIEKGAVETQLIAHDKEVYDIAWGEARVFASVSADGSVRIFDLRDKEHSTIIYESPRPDTPLLRLAWNKQDLRYMATTLMDSNKVVILDIRSPTIPVAELERHRSSVNAIAWAPQSCCHICSAGDDSQALIWELPTVAGPNGIDPMSMCSAASEINQLQWSAALPDWIAIAFSNKMQLLKV

SEQ ID NO: 3024 - DNA, 1023 bp, Populus balsamifera subsp. trichocarpa
  misc_feature (1)..(1023): Ceres ANNOT ID no. 1467673
  misc_feature 336031:<222: Transcription Factor
  misc_feature: Phenotype: Activates expression of the gene endogenous to the AtATCPS1 (SEQ ID NO 4148) regalutory region Useful for modulating Terpenoid Biosynthesis
atggagaattcaacccaagaatcccacctaagatcagaaaacactgtaacatatgaatccccataccctctctatgccatggcaatctcttcaaccgcatctcgtgcgaaccaataccagcggattgccttaggtagcttcattgaagactacaacaaccgtatagacatcgtctcttttgaccctgaaaccctctctatcaaaacccaccaaaatctctctgttgagcacccttatccacccacaaagctcatgtttagcccttcatctcttcacaagtccaatgacctcttagcctcttctggtgactatcttcgattgtgggaagttagagactctgcttctgttgagcctcttttggtgcttaacaatagtaagacaagtgagttttgtgcccctttaacttcttttgactggaatgatattgaacctaagagaattggtacttgtagtattgatacaacttgtactatttgggatattgaaaagggtgttgttgaaacacaacttatagctcatgataaagaggttcatgatattgcttggggagaagcaagggtttttgcttcagtttctgctgatgggtcagttaggatttttgatttaagagataaggaacattctactattatatatgagagtcctagacctgatacacccttgttgagattggcttggaacaaacaggatttgaggtatatggctacaatattgatggatagtaataaagttgtgatcttggatattaggtctccaacaatccctgttgctgagttggagaggcatatggcgagtgtcaatgctattgcttgggctccgcagagttgtaggcatatttgctctgctggtgatgattcacaggcacttatttgggagttacctactgtggctgggcctaatgggattgatccaatgtcaatgtgctctgctacttctgaaattaaccagcttcgatggtctgctgcactgcctgattggattgctatcgcgttttcaaacaaaatgcagcttttaaaagtttga

SEQ ID NO: 3025 - protein, 340 aa, Populus balsamifera subsp. trichocarpa
  misc_feature (1)..(340): Ceres ANNOT ID no. 1467673
  misc_feature (132)..(160): Pfam Name: WD40 Pfam Description: WD domain, G-beta repeat
  misc_feature: SWISSPROT Homolog: TTG1_ARATH TRANSPARENT TESTA GLABRA 1 protein (TTG1 protein) with e-value of 6.0e-140 and BLAST sequence identity of 74.9
  misc_feature: SWISSPROT Homolog: WDR68_HUMAN WD-repeat protein 68 (WD-repeat protein An11 homolog) with e-value of 1.8e-90 and BLAST sequence identity of 53.6
  misc_feature: SWISSPROT Homolog: WDR68_MOUSE WD-repeat protein 68 (WD-repeat protein An11 homolog) with e-value of 1.8e-90 and BLAST sequence identity of 53.6
  misc_feature: SWISSPROT Homolog: HAT2_ASHGO Histone acetyltransferase type B subunit 2 (EC 2.3.1.48) with e-value of 2.7e-14 and BLAST sequence identity of 29.4
  misc_feature: SWISSPROT Homolog: PRW1_SCHPO RbAp48-related WD40-repeat protein prw1 with e-value of 2.2e-12 and BLAST sequence identity of 27.2
  misc_feature 336137:<222: Transcription Factor
  misc_feature: Phenotype: Activates expression of the gene endogenous to the AtATCPS1 (SEQ ID NO 4148) regalutory region Useful for modulating Terpenoid Biosynthesis
  misc_feature (1)..(340): Functional Homolog of  Ceres CLONE ID no. 475689 at SEQ ID NO. 3068 with e-value of 2.50E-140 and BLAST sequence identity of 79.0
MENSTQESHLRSENTVTYESPYPLYAMAISSTASRANQYQRIALGSFIEDYNNRIDIVSFDPETLSIKTHQNLSVEHPYPPTKLMFSPSSLHKSNDLLASSGDYLRLWEVRDSASVEPLLVLNNSKTSEFCAPLTSFDWNDIEPKRIGTCSIDTTCTIWDIEKGVVETQLIAHDKEVHDIAWGEARVFASVSADGSVRIFDLRDKEHSTIIYESPRPDTPLLRLAWNKQDLRYMATILMDSNKVVILDIRSPTIPVAELERHMASVNAIAWAPQSCRHICSAGDDSQALIWELPTVAGPNGIDPMSMCSATSEINQLRWSAALPDWIAIAFSNKMQLLKV

SEQ ID NO: 3026 - DNA, 1041 bp, Populus balsamifera subsp. trichocarpa
  misc_feature (1)..(1041): Ceres ANNOT ID no. 1445014
  misc_feature 336236:<222: Transcription Factor
  misc_feature: Phenotype: Activates expression of the gene endogenous to the AtATCPS1 (SEQ ID NO 4148) regalutory region Useful for modulating Terpenoid Biosynthesis
atgggaggtagcagcgacccaaatcaagacgggtcggacgagcaacagaaacgatcagagatctacacatatgaggcaccatggcacatctacgccatgaactggagcgtccgtcgtgacaagaagtaccgtctcgccatcgccagcctcctagaacagtacccaaaccgggtcgagattgtacagctggacgaatccaatggagagatccgatccgacccgaatctgtccttcgagcacccttatccacctaccaaaaccatattcatcccggacaaggagtgccaaaagcctgacctcctcgcgacctccagcgacttcctgcgcgtgtggcgcataaacgatgagcagccgcgcgtggagctcaaaagcctgttaaatggcaacaagaacagcgaattttgcgggcctttgacttcctttgactggaacgaagcagagccaaggcgaattgggacatccagcattgacacgacttgcaccatctgggatatcgagagggagactgttgatacacagttaatcgcccacgacaaggaggtatacgacatcgcatggggcggtgttggggttttcgcttctgtttcagccgacgggtcggttagggttttcgatttacgggataaggagcattcaacgataatctacgagagttcggagcccgacacgcctttggttaggctggggtggaacaagcaggatccgaggtacatggccacgataatcatggacagtgctaaggttgtggtgttggatattcgcttcccaactcttccagtggtggaattgcagaggcatcatgctagtgttaatgccgttgcttgggccccgcatagttcatgccatatttgtactgctggggatgattcacaggcgttaatttgggacctctcttccatgggtcagcctgttgagggtggattggaccccattcttgcttatactgctggtgctgaaatcgagcagttgcagtggtcgtcttctcagcctgattgggttgccattgctttctctaccaagctgcagattctcagggtttga

SEQ ID NO: 3027 - protein, 346 aa, Populus balsamifera subsp. trichocarpa
  misc_feature (1)..(346): Ceres ANNOT ID no. 1445014
  misc_feature (136)..(164): Pfam Name: WD40 Pfam Description: WD domain, G-beta repeat
  misc_feature: SWISSPROT Homolog: TTG1_ARATH TRANSPARENT TESTA GLABRA 1 protein (TTG1 protein) with e-value of 6.0e-140 and BLAST sequence identity of 74.9
  misc_feature: SWISSPROT Homolog: WDR68_HUMAN WD-repeat protein 68 (WD-repeat protein An11 homolog) with e-value of 1.8e-90 and BLAST sequence identity of 53.6
  misc_feature: SWISSPROT Homolog: WDR68_MOUSE WD-repeat protein 68 (WD-repeat protein An11 homolog) with e-value of 1.8e-90 and BLAST sequence identity of 53.6
  misc_feature: SWISSPROT Homolog: HAT2_ASHGO Histone acetyltransferase type B subunit 2 (EC 2.3.1.48) with e-value of 2.7e-14 and BLAST sequence identity of 29.4
  misc_feature: SWISSPROT Homolog: PRW1_SCHPO RbAp48-related WD40-repeat protein prw1 with e-value of 2.2e-12 and BLAST sequence identity of 27.2
  misc_feature 336342:<222: Transcription Factor
  misc_feature: Phenotype: Activates expression of the gene endogenous to the AtATCPS1 (SEQ ID NO 4148) regalutory region Useful for modulating Terpenoid Biosynthesis
  misc_feature (1)..(346): Functional Homolog of  Ceres CLONE ID no. 475689 at SEQ ID NO. 3068 with e-value of 3.70E-114 and BLAST sequence identity of 63.8
MGGSSDPNQDGSDEQQKRSEIYTYEAPWHIYAMNWSVRRDKKYRLAIASLLEQYPNRVEIVQLDESNGEIRSDPNLSFEHPYPPTKTIFIPDKECQKPDLLATSSDFLRVWRINDEQPRVELKSLLNGNKNSEFCGPLTSFDWNEAEPRRIGTSSIDTTCTIWDIERETVDTQLIAHDKEVYDIAWGGVGVFASVSADGSVRVFDLRDKEHSTIIYESSEPDTPLVRLGWNKQDPRYMATIIMDSAKVVVLDIRFPTLPVVELQRHHASVNAVAWAPHSSCHICTAGDDSQALIWDLSSMGQPVEGGLDPILAYTAGAEIEQLQWSSSQPDWVAIAFSTKLQILRV

SEQ ID NO: 3028 - DNA, 1041 bp, Populus balsamifera subsp. trichocarpa
  misc_feature (1)..(1041): Ceres ANNOT ID no. 1471808
  misc_feature 336441:<222: Transcription Factor
  misc_feature: Phenotype: Activates expression of the gene endogenous to the AtATCPS1 (SEQ ID NO 4148) regalutory region Useful for modulating Terpenoid Biosynthesis
atgggagctagcagcgacccgaatcaagacgggtcggacgagcaacaaaaacgatctgagatctacacatacgaggcaccatggcacatctacgctatgaactggagcgtccgccgtgacaagaagtaccgccttgccatcgccagcctcctagaacagtacccaaaccgggtcgagattgttcagctggatgactccaacggagagatccgatccgacccgaacctgtccttcgagcacccttatccacctacgaagaccattttcattccagacaaggagtgccaaaaacctgacctcctcgcaacgtccagcgacttcctgcgcgtgtggcgcataaacgatgaacagccgcgcgtggagctcaaaagcctgttaaacggcaacaagaacagcgagttttgcgggcctttgacttcctttgactggaacgaggcggagcctaggcgaattgggacatccagcatcgacacgacatgcaccatctgggatatcgagaaggagactgttgatacacagttaatcgctcacgacaaggaggtatacgacatcgcatggggtggtgttggggttttcgcttcggtttcagcagacgggtcggttagggttttcgatttacgggataaggagcattcgacgataatctacgagagttcggagcccgacacgcctttggtgagactaggttggaacaagcaggatccgaggtacatggcgacgatcatcatggacagtgctaaggttgtggtgttggatattcgcttcccaactcttccagtggtggaattgcagaggcatcatgctagtgttaatgctgttgcttgggcccctcatagttcttgccacatttgtactgctggggatgattcacaggcattgatttgggatctttcttcgatgggtcagcctgttgagggtggattggaccccattcttgcttacactgctggtgctgaaatcgagcagctgcagtggtcgtcttcgcagcctgattgggttgctattgctttctctaccaagcttcaaattctcagggtttga

SEQ ID NO: 3029 - protein, 346 aa, Populus balsamifera subsp. trichocarpa
  misc_feature (1)..(346): Ceres ANNOT ID no. 1471808
  misc_feature (136)..(164): Pfam Name: WD40 Pfam Description: WD domain, G-beta repeat
  misc_feature: SWISSPROT Homolog: TTG1_ARATH TRANSPARENT TESTA GLABRA 1 protein (TTG1 protein) with e-value of 6.0e-140 and BLAST sequence identity of 74.9
  misc_feature: SWISSPROT Homolog: WDR68_HUMAN WD-repeat protein 68 (WD-repeat protein An11 homolog) with e-value of 1.8e-90 and BLAST sequence identity of 53.6
  misc_feature: SWISSPROT Homolog: WDR68_MOUSE WD-repeat protein 68 (WD-repeat protein An11 homolog) with e-value of 1.8e-90 and BLAST sequence identity of 53.6
  misc_feature: SWISSPROT Homolog: HAT2_ASHGO Histone acetyltransferase type B subunit 2 (EC 2.3.1.48) with e-value of 2.7e-14 and BLAST sequence identity of 29.4
  misc_feature: SWISSPROT Homolog: PRW1_SCHPO RbAp48-related WD40-repeat protein prw1 with e-value of 2.2e-12 and BLAST sequence identity of 27.2
  misc_feature 336547:<222: Transcription Factor
  misc_feature: Phenotype: Activates expression of the gene endogenous to the AtATCPS1 (SEQ ID NO 4148) regalutory region Useful for modulating Terpenoid Biosynthesis
  misc_feature (1)..(346): Functional Homolog of  Ceres CLONE ID no. 475689 at SEQ ID NO. 3068 with e-value of 7.69E-114 and BLAST sequence identity of 63.5
MGASSDPNQDGSDEQQKRSEIYTYEAPWHIYAMNWSVRRDKKYRLAIASLLEQYPNRVEIVQLDDSNGEIRSDPNLSFEHPYPPTKTIFIPDKECQKPDLLATSSDFLRVWRINDEQPRVELKSLLNGNKNSEFCGPLTSFDWNEAEPRRIGTSSIDTTCTIWDIEKETVDTQLIAHDKEVYDIAWGGVGVFASVSADGSVRVFDLRDKEHSTIIYESSEPDTPLVRLGWNKQDPRYMATIIMDSAKVVVLDIRFPTLPVVELQRHHASVNAVAWAPHSSCHICTAGDDSQALIWDLSSMGQPVEGGLDPILAYTAGAEIEQLQWSSSQPDWVAIAFSTKLQILRV

SEQ ID NO: 3030 - DNA, 1029 bp, Populus balsamifera subsp. trichocarpa
  misc_feature (1)..(1029): Ceres ANNOT ID no. 1454998
  misc_feature 336646:<222: Transcription Factor
  misc_feature: Phenotype: Activates expression of the gene endogenous to the AtATCPS1 (SEQ ID NO 4148) regalutory region Useful for modulating Terpenoid Biosynthesis
atgcaaagctcttcagagaaaagaccaggcatctacacttacatagctcagtggcctatatattcactagcctggtcggttcgacaggacaaaaaatcacgtcttgccataggaagtttccttgaagactatagcaacaaggtggaaattgttcaattcaaccgcgacacttctgatttcaccactgatagccgcctaatcttcgaccacccttattcacctacaaacctcatgttcttcccctccgaggatgctgcaaatcctgatatcatcgctacctccggagactacttgcgcatatggcaaattcatgatgaccgaatcgagttgaagtctctccttaatggcaataagagtagtgaattcagttctgccataacttcatttgactgggctgatttcgatgttcatcgtgtggccacttctagtgtcgataccacttgtgtgatttgggacatagagaaggaagttatagacgctcaattagttgcacatgataaagaagtgtttgatatttcatggggttcattcaatattttcgcatcagtgtcgggtgatggctcggttagagttttcgatctaaggaacaaagacagatcaacaataatttatgaaaatacaatgcaagactgtcctttgctaaggctagagtggaacaaaagagacccgagatttatagccacagttggcatggacagtaataaggttgttattctggacattcgctttcctacaactcctttaatggagctatgtaagcataaggcaagtgtgaatgctatatcttggtctccatgcaccggaaggcagatatgctcggtaggtgatgattcaagggctttgttatgggaagtggttagcaaggccggagtgcgaccagaatacagcggtgctggcgctaatagccaagtggaacctgaaatgtggtatggatcaatggcggcgatcaataatgtgaggtggtcacctgtggagttggattggattgctattgctttttttagcaagttacaactcctgaaggtctaa

SEQ ID NO: 3031 - protein, 342 aa, Populus balsamifera subsp. trichocarpa
  misc_feature (1)..(342): Ceres ANNOT ID no. 1454998
  misc_feature (157)..(193): Pfam Name: WD40 Pfam Description: WD domain, G-beta repeat
  misc_feature: SWISSPROT Homolog: TTG1_ARATH TRANSPARENT TESTA GLABRA 1 protein (TTG1 protein) with e-value of 6.0e-140 and BLAST sequence identity of 74.9
  misc_feature: SWISSPROT Homolog: WDR68_HUMAN WD-repeat protein 68 (WD-repeat protein An11 homolog) with e-value of 1.8e-90 and BLAST sequence identity of 53.6
  misc_feature: SWISSPROT Homolog: WDR68_MOUSE WD-repeat protein 68 (WD-repeat protein An11 homolog) with e-value of 1.8e-90 and BLAST sequence identity of 53.6
  misc_feature: SWISSPROT Homolog: HAT2_ASHGO Histone acetyltransferase type B subunit 2 (EC 2.3.1.48) with e-value of 2.7e-14 and BLAST sequence identity of 29.4
  misc_feature: SWISSPROT Homolog: PRW1_SCHPO RbAp48-related WD40-repeat protein prw1 with e-value of 2.2e-12 and BLAST sequence identity of 27.2
  misc_feature 336752:<222: Transcription Factor
  misc_feature: Phenotype: Activates expression of the gene endogenous to the AtATCPS1 (SEQ ID NO 4148) regalutory region Useful for modulating Terpenoid Biosynthesis
  misc_feature (1)..(342): Functional Homolog of  Ceres CLONE ID no. 475689 at SEQ ID NO. 3068 with e-value of 1.20E-94 and BLAST sequence identity of 53.7
MQSSSEKRPGIYTYIAQWPIYSLAWSVRQDKKSRLAIGSFLEDYSNKVEIVQFNRDTSDFTTDSRLIFDHPYSPTNLMFFPSEDAANPDIIATSGDYLRIWQIHDDRIELKSLLNGNKSSEFSSAITSFDWADFDVHRVATSSVDTTCVIWDIEKEVIDAQLVAHDKEVFDISWGSFNIFASVSGDGSVRVFDLRNKDRSTIIYENTMQDCPLLRLEWNKRDPRFIATVGMDSNKVVILDIRFPTTPLMELCKHKASVNAISWSPCTGRQICSVGDDSRALLWEVVSKAGVRPEYSGAGANSQVEPEMWYGSMAAINNVRWSPVELDWIAIAFFSKLQLLKV

SEQ ID NO: 3032 - DNA, 1017 bp, Populus balsamifera subsp. trichocarpa
  misc_feature (1)..(1017): Ceres ANNOT ID no. 1475212
  misc_feature 336851:<222: Transcription Factor
  misc_feature: Phenotype: Activates expression of the gene endogenous to the AtATCPS1 (SEQ ID NO 4148) regalutory region Useful for modulating Terpenoid Biosynthesis
atggaaagctcttcacagaaaggaccagtcatctgcacttacgtagctcaatggcctatatattcactagcctggtctgcccgacgtgacaaaaaaacacgtcttgccataggaagtttccttgaagactatagcaacaaggtggaaattgttcaattcaacagcgacacttctgatttcaccaccgatagccgcctaatattcgatcacccttattcacccacaaacctgatgttcttcccctccgaggatgttgcaaatcctgatatcatcatcacctccggggactacatgcgtatatggcaaatttacgatgaccgaattgagttgaagtctctcctaaatggcaataagtgtagtgaattcaactctgccataacatcttttgattgggctgattttgatgttcatcgtgtggtcagttcgagtgttgactccaccattgttgtttgggatatagagaaggaaactatatatgctcaattagttgcacatgataaagaagtgaatgatatttcatggggttggttcaatattttcgcatcagtatcaggtgatggttcagttagggtttgcgatttaagaaaaaaagagagatcaacaataatttatgaaaatccaatgcaggattgttctttgttaaggctagagtggaacaaaagtgacccgagatttatagccacagtcggcatgaacagtaacaaggttgtaattttggacattcgctttccttcaactcctttaatggagcttagcaagcatagggcaagtgtgaattctatatcctgggctccatgtacaggacgaaagatatgctcggtaggtgatgattcaagggctttgatatgggatgtggccagtaaggctggaaacggaccagaaaacattacaggccaggtggaacctgaaatgtggtatggatcagtgggtgggatcaataatatgcgttggtctccggtggagatggattggattgctattgcttttctgaccaagttacaactcttgaaggtttag

SEQ ID NO: 3033 - protein, 338 aa, Populus balsamifera subsp. trichocarpa
  misc_feature (1)..(338): Ceres ANNOT ID no. 1475212
  misc_feature (123)..(152): Pfam Name: WD40 Pfam Description: WD domain, G-beta repeat
  misc_feature: SWISSPROT Homolog: TTG1_ARATH TRANSPARENT TESTA GLABRA 1 protein (TTG1 protein) with e-value of 6.0e-140 and BLAST sequence identity of 74.9
  misc_feature: SWISSPROT Homolog: WDR68_HUMAN WD-repeat protein 68 (WD-repeat protein An11 homolog) with e-value of 1.8e-90 and BLAST sequence identity of 53.6
  misc_feature: SWISSPROT Homolog: WDR68_MOUSE WD-repeat protein 68 (WD-repeat protein An11 homolog) with e-value of 1.8e-90 and BLAST sequence identity of 53.6
  misc_feature: SWISSPROT Homolog: HAT2_ASHGO Histone acetyltransferase type B subunit 2 (EC 2.3.1.48) with e-value of 2.7e-14 and BLAST sequence identity of 29.4
  misc_feature: SWISSPROT Homolog: PRW1_SCHPO RbAp48-related WD40-repeat protein prw1 with e-value of 2.2e-12 and BLAST sequence identity of 27.2
  misc_feature 336955:<222: Transcription Factor
  misc_feature: Phenotype: Activates expression of the gene endogenous to the AtATCPS1 (SEQ ID NO 4148) regalutory region Useful for modulating Terpenoid Biosynthesis
  misc_feature (1)..(338): Functional Homolog of  Ceres CLONE ID no. 475689 at SEQ ID NO. 3068 with e-value of 6.89E-90 and BLAST sequence identity of 52.7
MESSSQKGPVICTYVAQWPIYSLAWSARRDKKTRLAIGSFLEDYSNKVEIVQFNSDTSDFTTDSRLIFDHPYSPTNLMFFPSEDVANPDIIITSGDYMRIWQIYDDRIELKSLLNGNKCSEFNSAITSFDWADFDVHRVVSSSVDSTIVVWDIEKETIYAQLVAHDKEVNDISWGWFNIFASVSGDGSVRVCDLRKKERSTIIYENPMQDCSLLRLEWNKSDPRFIATVGMNSNKVVILDIRFPSTPLMELSKHRASVNSISWAPCTGRKICSVGDDSRALIWDVASKAGNGPENITGQVEPEMWYGSVGGINNMRWSPVEMDWIAIAFLTKLQLLKV

SEQ ID NO: 3034 - protein, 296 aa, Glycine max
  misc_feature (1)..(296): Ceres CLONE ID no. 480332
  misc_feature (160)..(288): Pfam Name: OTU Pfam Description: OTU-like cysteine protease
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: INFLORESCENCE - Weak Useful for making stronger plants
MLGVLCATRPKPWLLSLVHVHASLPRLPHSPLSPSASPPPRRRHSTACKLFLSGGAAASIWHAIMPRGDDGLRRGVVAVHDLKGEGSWNVAWDARPARWLHRPDSAWLLFGVCACLAPPPGCVDADTNSAGIAVDESCGLLDKEREEDEVSADYRVTGVPADGRCLFRAIAHGACLRNGEKAPDENRQRELADELRAKVVDELLKRREETEWFIEGDFDTYLQRIQQPYVWGGEPELLMASHVLKTPISVFMRDTGSVELVNIAKYGEEYRNDKDISINVLFHGYGHYDILETLRP

SEQ ID NO: 3035 - DNA, 1191 bp, Populus balsamifera subsp. trichocarpa
  misc_feature (1)..(1191): Ceres ANNOT ID no. 1511016
  misc_feature 337153:<222: Transcription Factor
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: INFLORESCENCE - Weak Useful for making stronger plants
atgcttggtgtactctgcgcacgccccaagcctaactggatcctcaactccctcttcactcatttccaccatcaacaccaccaccaccaaagcaacgaccgcctttctttacacctcccccattccttcaccgcggctcgccgccaccactctagcttttgcagcgctgattgcggcggtggaggagcggcggcgatatggcacgtggtccagccggcggattggcggaggaggagggggaggaggagtgtgagaggggaaggttcgtggaacgttgcgtgggatgggagaccggcgaggtggctccaccggcctgattcggcttggttgttgttcggcgtttgtgcttgccttgctccggcgattgagttattttgtgacgtgaatatcgagggaggtgaaaatgttgtcgttgatgttgatcatcaggagaaggagagaattgacggtggtgatttgaatgcgagtgcagtgaattctgatgatgtgaaacaggatagcagtagctctactgctggttctgattataaagtcacaggggtgctggcggatggccgatgcctgtttagagcaattgctcatatggcatgtttgagaaatggagaagaggctcctgatgaaaatcgtcaaagagaactcgcagatgaattaagagctcaagttgtggatgagcttttaaagaggcgggaagaaaccgaatggtttattgaaggagattttgatgcatatgtcaagagaattcaacaaccttatgtatggggtggagaacctgagttgttgatggcttctcatgttttaaagacaatgatatcagtgttcatgagagataggacaacgggtaatttggtaaacatagcaaattacggtgaagagtaccggaaagatgaagtcaatcccattaatgtgctgtttcatggatatggtcactacgatatattggagacaaccccagagaggcagtttgggatttttccaagctaccagagtctcccttcactttgtgcagcttcccctaggatagataacacgatcgcatatgatctttcgtcagcatccattagttggggtagcagttatcccatctttgtatgcacgctgatgccttcagaactttgcctttggtgtggtgctggccacggtcagtctgttcggttttctccgctggaatctctctcctcggcactatattaa

SEQ ID NO: 3036 - protein, 396 aa, Populus balsamifera subsp. trichocarpa
  misc_feature (1)..(396): Ceres ANNOT ID no. 1511016
  misc_feature (182)..(310): Pfam Name: OTU Pfam Description: OTU-like cysteine protease
  misc_feature: SWISSPROT Homolog: OTU6B_XENLA OTU domain-containing protein 6B with e-value of 6.9e-12 and BLAST sequence identity of 32.0
  misc_feature: SWISSPROT Homolog: OTU6B_XENTR OTU domain-containing protein 6B with e-value of 2.0e-09 and BLAST sequence identity of 29.9
  misc_feature: SWISSPROT Homolog: OTU6B_BRARE OTU domain-containing protein 6B with e-value of 2.1e-07 and BLAST sequence identity of 27.3
  misc_feature: SWISSPROT Homolog: OTU6A_HUMAN OTU domain-containing protein 6A with e-value of 2.6e-07 and BLAST sequence identity of 31.9
  misc_feature: SWISSPROT Homolog: OTU6B_CHICK OTU domain-containing protein 6B with e-value of 8.6e-07 and BLAST sequence identity of 29.6
  misc_feature 337273:<222: Transcription Factor
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: INFLORESCENCE - Weak Useful for making stronger plants
  misc_feature (1)..(396): Functional Homolog of  Ceres CLONE ID no. 480332 at SEQ ID NO. 3081 with e-value of 2.50E-92 and BLAST sequence identity of 71.2
MLGVLCARPKPNWILNSLFTHFHHQHHHHQSNDRLSLHLPHSFTAARRHHSSFCSADCGGGGAAAIWHVVQPADWRRRRGRRSVRGEGSWNVAWDGRPARWLHRPDSAWLLFGVCACLAPAIELFCDVNIEGGENVVVDVDHQEKERIDGGDLNASAVNSDDVKQDSSSSTAGSDYKVTGVLADGRCLFRAIAHMACLRNGEEAPDENRQRELADELRAQVVDELLKRREETEWFIEGDFDAYVKRIQQPYVWGGEPELLMASHVLKTMISVFMRDRTTGNLVNIANYGEEYRKDEVNPINVLFHGYGHYDILETTPERQFGIFPSYQSLPSLCAASPRIDNTIAYDLSSASISWGSSYPIFVCTLMPSELCLWCGAGHGQSVRFSPLESLSSALY

SEQ ID NO: 3037 - DNA, 957 bp, Populus balsamifera subsp. trichocarpa
  misc_feature (1)..(957): Ceres ANNOT ID no. 1518556
  misc_feature 337395:<222: Transcription Factor
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: INFLORESCENCE - Weak Useful for making stronger plants
atgcttggtgtactttgcgcacgccccaagcctaactggatcctcaactctctcttcactcatttccacctcaaccaccaccaccaccacaacagtaacaaccgcctctctttgcacctatccggctcctccaccgcggctcgccgccaccactctaacttgtgcagcgctgattcaggctgcggaggagcggcggcgatatggcacgtgattcagccggctgattggcggaggaggacagagaggaggagtgtgagaggggaggggtcgtggaacgcggcgtgggatgggagaccggcgaggtggctccaccggcctgactcggcgtggttgttgttcggcgtttgtgcttgccttgctccggcgatcgagttcttgagtgatgtgaataacatcgatgatgttgatcatcaggagaaagagagaattgacggtggcgatttgaatgcgagttctgatgacgcgaaacaggataacagtgacgctactgttggttctgattataaagttacaggggtgctggcggatgggcgatgtctatttagagcaatagctcacatggcttgtttgagaaatggagaggaggcccctgatgaaaatcgccaaagagaacttgctgatgaattaagagctcaagttgttgatgagcttctaaagaggcgggaagaaactgaatggttcattgaaggagattttgatgcatatgtcaagagaattcaacaaccttatgtatggggtggggaacctgagttgttaatggcttctcatgttttaaagacaatgatatcagtgttcatgagagataggacaacgggtaatttggtaaacatagtaaattacggtgaagagtaccagaaagatgaagtcaatcccattaatgtgctgtttcatggatatggtcactatgacatactggagaccaccccgggtcagagttaccagaaagcggacatctag

SEQ ID NO: 3038 - protein, 318 aa, Populus balsamifera subsp. trichocarpa
  misc_feature (1)..(318): Ceres ANNOT ID no. 1518556
  misc_feature (174)..(302): Pfam Name: OTU Pfam Description: OTU-like cysteine protease
  misc_feature: SWISSPROT Homolog: OTU6B_XENLA OTU domain-containing protein 6B with e-value of 6.9e-12 and BLAST sequence identity of 32.0
  misc_feature: SWISSPROT Homolog: OTU6B_XENTR OTU domain-containing protein 6B with e-value of 2.0e-09 and BLAST sequence identity of 29.9
  misc_feature: SWISSPROT Homolog: OTU6B_BRARE OTU domain-containing protein 6B with e-value of 2.1e-07 and BLAST sequence identity of 27.3
  misc_feature: SWISSPROT Homolog: OTU6A_HUMAN OTU domain-containing protein 6A with e-value of 2.6e-07 and BLAST sequence identity of 31.9
  misc_feature: SWISSPROT Homolog: OTU6B_CHICK OTU domain-containing protein 6B with e-value of 8.6e-07 and BLAST sequence identity of 29.6
  misc_feature 337507:<222: Transcription Factor
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: INFLORESCENCE - Weak Useful for making stronger plants
  misc_feature (1)..(318): Functional Homolog of  Ceres CLONE ID no. 480332 at SEQ ID NO. 3081 with e-value of 9.79E-91 and BLAST sequence identity of 66.8
MLGVLCARPKPNWILNSLFTHFHLNHHHHHNSNNRLSLHLSGSSTAARRHHSNLCSADSGCGGAAAIWHVIQPADWRRRTERRSVRGEGSWNAAWDGRPARWLHRPDSAWLLFGVCACLAPAIEFLSDVNNIDDVDHQEKERIDGGDLNASSDDAKQDNSDATVGSDYKVTGVLADGRCLFRAIAHMACLRNGEEAPDENRQRELADELRAQVVDELLKRREETEWFIEGDFDAYVKRIQQPYVWGGEPELLMASHVLKTMISVFMRDRTTGNLVNIVNYGEEYQKDEVNPINVLFHGYGHYDILETTPGQSYQKADI

SEQ ID NO: 3039 - DNA, 1308 bp, Populus balsamifera subsp. trichocarpa
  misc_feature (1)..(1308): Ceres ANNOT ID no. 1457793
  misc_feature 337614:<222: Transcription Factor
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: INFLORESCENCE - Weak Useful for making stronger plants
atgcttggtgtactctgcgcacgccccaagcctaactggatcctcaactccctcttcactcatttccaccatcaacaccaccaccaccaaagcaacgaccgcctttctttacacctcccccattccttcaccgcggctcgccgccaccactctagcttttgcagcgctgattgcggcggtggaggagcggcggcgatatggcacgtggtccagccggcggattggcggaggaggagggggaggaggagtgtgagaggggaaggttcgtggaacgttgcgtgggatgggagaccggcgaggtggctccaccggcctgattcggcttggttgttgttcggcgtttgtgcttgccttgctccggcgattgagttattttgtgacgtgaatatcgagggaggtgaaaatgttgtcgttgatgttgatcatcaggagaaggagagaattgacggtggtgatttgaatgcgagtgcagtgaattctgatgatgtgaaacaggatagcagtagctctactgctggttctgattataaagtcacaggggtgctggcggatggccgatgcctgtttagagcaattgctcatatggcatgtttgagaaatggagaagaggctcctgatgaaaatcgtcaaagagaactcgcagatgaattaagagctcaagttgtggatgagcttttaaagaggcgggaagaaaccgaatggtttattgaaggagattttgatgcatatgtcaagagaattcaacaaccttatgtatggggtggagaacctgagttgttgatggcttctcatgttttaaaattttgtgaaggaacaaggcttggctctcacattaacggtggggcaggactgtacactaatacctcagccttgttatcggtccagtttgatgaaaaggccccattcaaaactgaatggacaatgatatcagtgttcatgagagataggacaacgggtaatttggtaaacatagcaaattacggtgaagagtaccggaaagatgaagtcaatcccattaatgtgctgtttcatggatatggtcactacgatatattggagacaaccccagagaggcagtttgggatttttccaagctaccagagtctcccttcactttgtgcagcttcccctaggatagataacacgatcgcatatgatctttcgtcagcatccattagttggggtagcagttatcccatctttgtatgcacgctgatgccttcagaactttgcctttggtgtggtgctggccacggtcagtctgttcggttttctccgctggaatctctctcctcggcactatattaa

SEQ ID NO: 3040 - protein, 435 aa, Populus balsamifera subsp. trichocarpa
  misc_feature (1)..(435): Ceres ANNOT ID no. 1457793
  misc_feature (182)..(349): Pfam Name: OTU Pfam Description: OTU-like cysteine protease
  misc_feature: SWISSPROT Homolog: OTU6B_XENLA OTU domain-containing protein 6B with e-value of 6.9e-12 and BLAST sequence identity of 32.0
  misc_feature: SWISSPROT Homolog: OTU6B_XENTR OTU domain-containing protein 6B with e-value of 2.0e-09 and BLAST sequence identity of 29.9
  misc_feature: SWISSPROT Homolog: OTU6B_BRARE OTU domain-containing protein 6B with e-value of 2.1e-07 and BLAST sequence identity of 27.3
  misc_feature: SWISSPROT Homolog: OTU6A_HUMAN OTU domain-containing protein 6A with e-value of 2.6e-07 and BLAST sequence identity of 31.9
  misc_feature: SWISSPROT Homolog: OTU6B_CHICK OTU domain-containing protein 6B with e-value of 8.6e-07 and BLAST sequence identity of 29.6
  misc_feature 337738:<222: Transcription Factor
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: INFLORESCENCE - Weak Useful for making stronger plants
  misc_feature (1)..(435): Functional Homolog of  Ceres CLONE ID no. 480332 at SEQ ID NO. 3081 with e-value of 2.60E-83 and BLAST sequence identity of 71.2
MLGVLCARPKPNWILNSLFTHFHHQHHHHQSNDRLSLHLPHSFTAARRHHSSFCSADCGGGGAAAIWHVVQPADWRRRRGRRSVRGEGSWNVAWDGRPARWLHRPDSAWLLFGVCACLAPAIELFCDVNIEGGENVVVDVDHQEKERIDGGDLNASAVNSDDVKQDSSSSTAGSDYKVTGVLADGRCLFRAIAHMACLRNGEEAPDENRQRELADELRAQVVDELLKRREETEWFIEGDFDAYVKRIQQPYVWGGEPELLMASHVLKFCEGTRLGSHINGGAGLYTNTSALLSVQFDEKAPFKTEWTMISVFMRDRTTGNLVNIANYGEEYRKDEVNPINVLFHGYGHYDILETTPERQFGIFPSYQSLPSLCAASPRIDNTIAYDLSSASISWGSSYPIFVCTLMPSELCLWCGAGHGQSVRFSPLESLSSALY

SEQ ID NO: 3041 - DNA, 1068 bp, Populus balsamifera subsp. trichocarpa
  misc_feature (1)..(1068): Ceres ANNOT ID no. 1465233
  misc_feature 337869:<222: Transcription Factor
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: INFLORESCENCE - Weak Useful for making stronger plants
atgcttggtgtactttgcgcacgccccaagcctaactggatcctcaactctctcttcactcatttccacctcaaccaccaccaccaccacaacagtaacaaccgcctctctttgcacctatccggctcctccaccgcggctcgccgccaccactctaacttgtgcagcgctgattcaggctgcggaggagcggcggcgatatggcacgtgattcagccggctgattggcggaggaggacagagaggaggagtgtgagaggggaggggtcgtggaacgcggcgtgggatgggagaccggcgaggtggctccaccggcctgactcggcgtggttgttgttcggcgtttgtgcttgccttgctccggcgatcgagttcttgagtgatgtgaataacatcgatgatgttgatcatcaggagaaagagagaattgacggtggcgatttgaatgcgagttctgatgacgcgaaacaggataacagtgacgctactgttggttctgattataaagttacaggggtgctggcggatgggcgatgtctatttagagcaatagctcacatggcttgtttgagaaatggagaggaggcccctgatgaaaatcgccaaagagaacttgctgatgaattaagagctcaagttgttgatgagcttctaaagaggcgggaagaaactgaatggttcattgaaggagattttgatgcatatgtcaagagaattcaacaaccttatgtatggggtggggaacctgagttgttaatggcttctcatgttttaaattcttctgaaagagtctccatattagaagatggcctcaggaaacagcaaaatcctgcttttcttcaaagttgtgatttttctggaatctgcatctgcattcatgtttatgggacaatgatatcagtgttcatgagagataggacaacgggtaatttggtaaacatagtaaattacggtgaagagtaccagaaagatgaagtcaatcccattaatgtgctgtttcatggatatggtcactatgacatactggagaccaccccgggtcagagttaccagaaagcggacatctag

SEQ ID NO: 3042 - protein, 355 aa, Populus balsamifera subsp. trichocarpa
  misc_feature (1)..(355): Ceres ANNOT ID no. 1465233
  misc_feature (174)..(339): Pfam Name: OTU Pfam Description: OTU-like cysteine protease
  misc_feature: SWISSPROT Homolog: OTU6B_XENLA OTU domain-containing protein 6B with e-value of 6.9e-12 and BLAST sequence identity of 32.0
  misc_feature: SWISSPROT Homolog: OTU6B_XENTR OTU domain-containing protein 6B with e-value of 2.0e-09 and BLAST sequence identity of 29.9
  misc_feature: SWISSPROT Homolog: OTU6B_BRARE OTU domain-containing protein 6B with e-value of 2.1e-07 and BLAST sequence identity of 27.3
  misc_feature: SWISSPROT Homolog: OTU6A_HUMAN OTU domain-containing protein 6A with e-value of 2.6e-07 and BLAST sequence identity of 31.9
  misc_feature: SWISSPROT Homolog: OTU6B_CHICK OTU domain-containing protein 6B with e-value of 8.6e-07 and BLAST sequence identity of 29.6
  misc_feature 337985:<222: Transcription Factor
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: INFLORESCENCE - Weak Useful for making stronger plants
  misc_feature (1)..(355): Functional Homolog of  Ceres CLONE ID no. 480332 at SEQ ID NO. 3081 with e-value of 1.30E-81 and BLAST sequence identity of 66.5
MLGVLCARPKPNWILNSLFTHFHLNHHHHHNSNNRLSLHLSGSSTAARRHHSNLCSADSGCGGAAAIWHVIQPADWRRRTERRSVRGEGSWNAAWDGRPARWLHRPDSAWLLFGVCACLAPAIEFLSDVNNIDDVDHQEKERIDGGDLNASSDDAKQDNSDATVGSDYKVTGVLADGRCLFRAIAHMACLRNGEEAPDENRQRELADELRAQVVDELLKRREETEWFIEGDFDAYVKRIQQPYVWGGEPELLMASHVLNSSERVSILEDGLRKQQNPAFLQSCDFSGICICIHVYGTMISVFMRDRTTGNLVNIVNYGEEYQKDEVNPINVLFHGYGHYDILETTPGQSYQKADI

SEQ ID NO: 3043 - protein, 197 aa, Glycine max
  misc_feature (1)..(197): Ceres CLONE ID no. 480900
  misc_feature (1)..(197): Also Known As Ceres CDNA ID no. 23666854
  misc_feature (1)..(197): Also Known As Ceres GEMINI ID 540C6
  misc_feature (172)..(196): Pfam Name: RRM_1 Pfam Description: RNA recognition motif. (a.k.a. RRM RBD, or RNP domain)
  misc_feature 338122:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature (191)..(191): Xaa is any aa, unknown, or other
  misc_feature (192)..(192): Xaa is any aa, unknown, or other
MASVHSSFLLPYNLLSLTTPSSSSTQILFTARPSATHLRPLLLTTRRRSGRRPFAAVAEQAATATEAAARRLYVGNIPRTVTNDELAKIVQEHGAVEKAEVMYDKYSGRSRRFAFVTMKTVEDATAVIEKLNGTELGGREIKVNVTEKPLSTLDLPLLQAEESEFIDSPHKVYVGNLAKTVTTDTLKNFFXXKGKVS

SEQ ID NO: 3044 - DNA, 768 bp, Populus balsamifera subsp. trichocarpa
  misc_feature (1)..(768): Ceres ANNOT ID no. 1461433
  misc_feature 338211:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
atggcaacaatctcatctcttacaacaccactacccacgtccacaaaacttgctctttcaagaaaccagtcaaaaccctctttccaaatcctcaaaccagcaaacccttttaaccatttccctaaattcacacatttacataaaattctaaacaccaaagccccccaaaggctctttgcagtagctgaagaaacagcaccggctgctgcagtagacccttcttcagaggctgctaggaggctgtacgttggaaatattcccaggactctgactaatgaggagcttacaaagattgttgaagaacatggtgctgttgaaaaagccgaggttatgtatgataagtactcgggtaggagccgtcgatttgcatttgttacgatgaaaactgctgaggatgcaaatgcggcaattgagaaactgaatggcactgaaattggaggccgtgagatcaaagtaaacatcacggagaagcctttgcagtcattagatctgccttctctccaatcagacgaatcccaatttgttgacagcccttataaggtttatgtgggaaatcttgctaaaacagtagcaacagatacactcaagaactttttttctaagaagggaaacgttcttagtgcaaaggtttcacgagttccagggacctcaaaatctagtgggtttgggtttgtaacattctcttcagaggaggatgtagaagttgccatctcatcttttaacaattctttgttggaagggcagccaattcgtgtaaacaaggcctag

SEQ ID NO: 3045 - protein, 255 aa, Populus balsamifera subsp. trichocarpa
  misc_feature (1)..(255): Ceres ANNOT ID no. 1461433
  misc_feature (181)..(252): Pfam Name: RRM_1 Pfam Description: RNA recognition motif. (a.k.a. RRM RBD, or RNP domain)
  misc_feature: SWISSPROT Homolog: RRP2_SPIOL Plastid-specific 30S ribosomal protein 2, (PSRP-2) with e-value of 1.5e-49 and BLAST sequence identity of 55.7
  misc_feature: SWISSPROT Homolog: ROC5_NICSY 33 kDa ribonucleoprotein, with e-value of 1.4e-24 and BLAST sequence identity of 38.5
  misc_feature: SWISSPROT Homolog: ROC1_NICSY 29 kDa ribonucleoprotein A, (CP29A) with e-value of 4.9e-19 and BLAST sequence identity of 32.4
  misc_feature: SWISSPROT Homolog: ROC1_NICPL 30 kDa ribonucleoprotein, (CP-RBP30) with e-value of 3.4e-18 and BLAST sequence identity of 33.0
  misc_feature: SWISSPROT Homolog: ROC1_SPIOL 28 kDa ribonucleoprotein, chloroplast (28RNP) with e-value of 3.4e-18 and BLAST sequence identity of 42.1
  misc_feature 338323:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature (1)..(255): Functional Homolog of  Ceres CLONE ID no. 480900 at SEQ ID NO. 3090 with e-value of 1.99E-58 and BLAST sequence identity of 70.3
MATISSLTTPLPTSTKLALSRNQSKPSFQILKPANPFNHFPKFTHLHKILNTKAPQRLFAVAEETAPAAAVDPSSEAARRLYVGNIPRTLTNEELTKIVEEHGAVEKAEVMYDKYSGRSRRFAFVTMKTAEDANAAIEKLNGTEIGGREIKVNITEKPLQSLDLPSLQSDESQFVDSPYKVYVGNLAKTVATDTLKNFFSKKGNVLSAKVSRVPGTSKSSGFGFVTFSSEEDVEVAISSFNNSLLEGQPIRVNKA

SEQ ID NO: 3046 - protein, 340 aa, Glycine max
  misc_feature (1)..(340): Ceres CLONE ID no. 481915
  misc_feature (1)..(340): Also Known As Ceres CDNA ID no. 23675593
  misc_feature (1)..(340): Also Known As Ceres GEMINI ID 540D6
  misc_feature (14)..(140): Pfam Name: NAM Pfam Description: No apical meristem (NAM) protein
  misc_feature 338439:<222: Transcription Factor
  misc_feature: Phenotype: Activates expression of the gene endogenous to the AtATTPS3 (SEQ ID NO 4165) regalutory region Useful for modulating Terpenoid Biosynthesis
MGVPERDPLAQLSLPPGFRFYPTDEELLVQYLCRKVAGHHFSLPIIAEVDLYKFDPWVLPGKAAFGEKEWYFFSPRDRKYPNGSRPNRVAGSGYWKATGTDKIITTEGRKVGIKKALVFYVGKAPKGSKTNWIMHEYRLLDSSRKHNLGTAKLDDWVLCRIYKKNSSAQKVEANLLAMECSNGSSPSSSSHVDDMLESLPEIDDRCFTLPRVNSVRTMQQQDEKFGFQNMGSGFFTDWVNPTDLDSVSEFGSGCQTQGMVNYDCNDLFVPSVPPFGHSHVNYMVGAPPSEEEVQSGVRTQQADGAACFQQNPNARLLPGSGDPFGFGFIMGQQVEFGFRD

SEQ ID NO: 3047 - DNA, 1029 bp, Populus balsamifera subsp. trichocarpa
  misc_feature (1)..(1029): Ceres ANNOT ID no. 1466775
  misc_feature 338530:<222: Transcription Factor
  misc_feature: Phenotype: Activates expression of the gene endogenous to the AtATTPS3 (SEQ ID NO 4165) regalutory region Useful for modulating Terpenoid Biosynthesis
atgggactgcaagaaacagaccctctagcccaattgagcttgccaccgggatttcggtttcacccgactgatgaagagcttttggtgcaatacttgtgtaagaaggttgctggtcaccatttctccttgcaaatcattggcgaaattgatttgtacaagtttgatccgtggttcttaccaggtaaggcaatatttggtgaaaaagaatggtattttttcagtccgagagaccgcaagtaccccaatggatcccgacccaacagggttgccgggtctgggtattggaaggccaccggtactgacaaagtaatcacgacagagggacgtaaagttggcatcaagaaagctttggtcttttacgttggcaaagccccaaaaggcaccaaaactaattggatcatgcatgaatatcgccttcttgaatcctctcgcaaaagtggaagtacaaagttggatgaatgggtattgtgtcggatttacaagaagaattcaagtgctgcacagaaatccatgtcaagcgtttcaagcaaagaatacagtactaatggttcatgttcatcatcctcttctcatttggaagatgtccttgactcattgacagagattgatgaccggctctttgctttgcctcgaaccaactcactcaaacaaatgcaacacgaagagaaaatcaacttagcaaatctgggttcagggagctttgactgggcgacacttgctgggctcaactcgttgcctgaactcctacaaactcagcctggtgcgaattactcgaataccaatgtcaatggtgtgcatgtcccttcaatgcccccactctgccacgcggattcatcaacagggaggatggggacctcggttgaagaggaggtccaaagtggggttagaactcagctgcgagatggcaactcgggggcttttcaacaaaactcgggcgtgatgacaccgaacttctcttctaccttactcgacccatatgagctaaggtattcgacccaaccgggaagtgggtatgggtttaggcagtga

SEQ ID NO: 3048 - protein, 342 aa, Populus balsamifera subsp. trichocarpa
  misc_feature (1)..(342): Ceres ANNOT ID no. 1466775
  misc_feature (14)..(140): Pfam Name: NAM Pfam Description: No apical meristem (NAM) protein
  misc_feature: SWISSPROT Homolog: NAC19_ARATH NAC domain-containing protein 19 (ANAC019) (ANAC) (Abscicic-acid-responsive NAC) with e-value of 1.0e-87 and BLAST sequence identity of 56.4
  misc_feature: SWISSPROT Homolog: NAC48_ORYSA NAC domain-containing protein 48 (ONAC048) with e-value of 1.4e-62 and BLAST sequence identity of 68.6
  misc_feature: SWISSPROT Homolog: NAC68_ORYSA NAC domain-containing protein 68 (ONAC068) with e-value of 3.6e-62 and BLAST sequence identity of 61.9
  misc_feature: SWISSPROT Homolog: NAC2_ARATH NAC domain-containing protein 2 (ANAC002) with e-value of 1.8e-60 and BLAST sequence identity of 69.6
  misc_feature: SWISSPROT Homolog: NAC67_ORYSA NAC domain-containing protein 67 (ONAC067) with e-value of 8.9e-59 and BLAST sequence identity of 48.5
  misc_feature 338637:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(342): Functional Homolog of  Ceres CLONE ID no. 481915 at SEQ ID NO. 3093 with e-value of 9.20E-111 and BLAST sequence identity of 67.9
MGLQETDPLAQLSLPPGFRFHPTDEELLVQYLCKKVAGHHFSLQIIGEIDLYKFDPWFLPGKAIFGEKEWYFFSPRDRKYPNGSRPNRVAGSGYWKATGTDKVITTEGRKVGIKKALVFYVGKAPKGTKTNWIMHEYRLLESSRKSGSTKLDEWVLCRIYKKNSSAAQKSMSSVSSKEYSTNGSCSSSSSHLEDVLDSLTEIDDRLFALPRTNSLKQMQHEEKINLANLGSGSFDWATLAGLNSLPELLQTQPGANYSNTNVNGVHVPSMPPLCHADSSTGRMGTSVEEEVQSGVRTQLRDGNSGAFQQNSGVMTPNFSSTLLDPYELRYSTQPGSGYGFRQ

SEQ ID NO: 3049 - protein, 255 aa, Glycine max
  misc_feature (1)..(255): Ceres CLONE ID no. 482122
  misc_feature (65)..(129): Pfam Name: AP2 Pfam Description: AP2 domain
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: ROSETTE LEAVES - Short Petioles Useful for modulating plant size
MNILGQSLHQSNNGSYSCSSPETANSSNLPTTPKAVHSDEEVNTLASAHPKKRAGRRIFKETRHPVYRGVRRRNNNKWVCEVRVPNDKSTRIWLGTYPTPEMAARAHDVAALSLRGKSACLNFADSAWRLPLPASTNAKEIRRVAAAAAVAIAAEDSRGKQLRTNAIDAVADCEVSSSDIGVDENCNNNKASQRFCDLDEITMPDAPVFEDMHEWLQTMAAEPLRSPTFVTYVNVRDVWNFVEDDAEVSLWSFTV

SEQ ID NO: 3050 - DNA, 768 bp, Populus balsamifera subsp. trichocarpa
  misc_feature (1)..(768): Ceres ANNOT ID no. 1438776
  misc_feature 338840:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: ROSETTE LEAVES - Short Petioles Useful for modulating plant size
atggataatttctgccaattctctgatcaacatcctttgaggtcaaattcaatgcccaatgacaggcaagaagcatcttctttctccgatagcagcacgtctcgacgagttgtccattctgatgaagaggtcttactagcaacaagttttccgaaaaaacgcgctggccgcagaatattcagggagactcggcacccggtttttagaggtgttcggaagaggaatggtaacaaatgggtgtgtgagatgcgggaaccaaacaagaagtcacgaatatggttaggaacatatcctacaccagaaatggcagctcgagctcatgatgttgctgctttggcacttagaggcaaatctgcttgccttaacttcgctgattctgcctggaggttgcctgtgccagtttcgaaggattctaaggatattacaagggcagcaaatgaggcagcagaattatttaggcctcaagagtttggtggtcatccggcaaaacaacaagatagcaatgcagtgctagaggattgctcaagtgaagtttgcagcgatgattgcaaaactttccaagaaaatgatgtcttcttcaaggaagcagtgtttgccatgccaggagaaaatgatgtcttcttcgaggaagcagtgtttgacatgccagggttgctcgtggacatggcagaaggtcttctactctctcctccacgttatgtaaggaatgattgcaacgacttggatcatatggagaatggttctgatttgtcgttatggagttattag

SEQ ID NO: 3051 - protein, 255 aa, Populus balsamifera subsp. trichocarpa
  misc_feature (1)..(255): Ceres ANNOT ID no. 1438776
  misc_feature (66)..(129): Pfam Name: AP2 Pfam Description: AP2 domain
  misc_feature: SWISSPROT Homolog: DRE1A_ARATH Dehydration-responsive element-binding protein 1A with e-value of 3.1e-43 and BLAST sequence identity of 61.3
  misc_feature: SWISSPROT Homolog: DRE1A_ARATH DREB1A protein (C-repeat-binding factor 3) C-repeat/dehydration-responsive element-binding factor 3) (CRT/DRE-binding factor 3)
  misc_feature: SWISSPROT Homolog: DRE1D_ARATH Dehydration-responsive element-binding protein 1D with e-value of 1.0e-42 and BLAST sequence identity of 56.5
  misc_feature: SWISSPROT Homolog: DRE1D_ARATH DREB1D protein (C-repeat-binding factor 4) C-repeat/dehydration-responsive element-binding factor 4) (CRT/DRE-binding factor 4)
  misc_feature: SWISSPROT Homolog: DRE1C_ARATH Dehydration-responsive element-binding protein 1C with e-value of 1.0e-42 and BLAST sequence identity of 57.5
  misc_feature: SWISSPROT Homolog: DRE1C_ARATH DREB1C protein (C-repeat-binding factor 2) (C-repeat/dehydration-responsive element-binding factor 2) (CRT/DRE-binding factor 2)
  misc_feature: SWISSPROT Homolog: DRE1F_ARATH Dehydration-responsive element-binding protein 1F (DREB1F protein) with e-value of 2.7e-41 and BLAST sequence identity of 47.4
  misc_feature: SWISSPROT Homolog: DRE1E_ARATH Dehydration-responsive element-binding protein 1E (DREB1E protein) with e-value of 2.2e-39 and BLAST sequence identity of 61.9
  misc_feature 338989:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: ROSETTE LEAVES - Short Petioles Useful for modulating plant size
  misc_feature (1)..(255): Functional Homolog of  Ceres CLONE ID no. 482122 at SEQ ID NO. 3096 with e-value of 2.59E-51 and BLAST sequence identity of 53.3
MDNFCQFSDQHPLRSNSMPNDRQEASSFSDSSTSRRVVHSDEEVLLATSFPKKRAGRRIFRETRHPVFRGVRKRNGNKWVCEMREPNKKSRIWLGTYPTPEMAARAHDVAALALRGKSACLNFADSAWRLPVPVSKDSKDITRAANEAAELFRPQEFGGHPAKQQDSNAVLEDCSSEVCSDDCKTFQENDVFFKEAVFAMPGENDVFFEEAVFDMPGLLVDMAEGLLLSPPRYVRNDCNDLDHMENGSDLSLWSY

SEQ ID NO: 3052 - protein, 273 aa, Glycine max
  misc_feature (1)..(273): Ceres CLONE ID no. 529835
  misc_feature (19)..(186): Pfam Name: adh_short Pfam Description: short chain dehydrogenase
  misc_feature: Utility: ABA Useful for making plants with enhanced tolerance to drought
  misc_feature: Phenotype: WHOLE PLANT - ABA Useful for making plants with enhanced tolerance to drought
MGSVPLASAAALARRLEGKVALITGGASGIGECTARLFSKHGAKVVIADIQDELGHSICKDLDSSSATYIHCDVTKEENIEHAVNTTVSKYGKLDIMHSSAGIVGAWNPSILHNKKSHFEQVISVNLVGTFLGIKHAARVMIPSGRGSIVAMASICGRIGGVASHAYTSSKHGIVGLVRNTAVELGTLGIRVNSVSPYAVPTPMSKTFLNTDDEGIAALYSNLKGTVLKPQDVAEAVLYLGSDESKYVSGHDLVVDGGFTVVNPGLCVFGQSV

SEQ ID NO: 3053 - DNA, 918 bp, Populus balsamifera subsp. trichocarpa
  misc_feature (1)..(918): Ceres ANNOT ID no. 1541881
  misc_feature: Utility: ABA Useful for making plants with enhanced tolerance to drought
  misc_feature 339192:<222: Transcription Factor
  misc_feature: Phenotype: WHOLE PLANT - ABA Useful for making plants with enhanced tolerance to drought
atggctatattagggaagtatcatgtgctaggaaaacacagagagtggctaccaggggagctggtactgattcatggggagtgtttcacttgtctcagcagccctaagaaggtaacgaaagctttttgctggtgttgtaggctagaaggcaaggtggcattgatcactggagggtctagtggcataggagagtccgctgctagactgttcgccaaacatggagctaaagtggtgattgcagacgttcaagatgaactaggccactctgtttgcgaagaattgaagactgaatcagcctcattcgtccactgtgatgttactcaagaaaaagatgttgaaaatgctgttaacacagctgtttctaagcatggaaagctggacatcatgttcaataatgcaggaatagtaggcacgccaaaaccaaacatacttgacaatgacaaggctgaatttgagaaggtcattagtgttaatgtcgtgggcgcattcttaggcactaagcacgcagcccgcgtaatgatccctgttcggcgaggtagcataatctcaaccgctagcgtttgcggaacaattggaggtgttgcatcacatgcctacacaagttcaaagcatggcgtgatagggttaatgagaaacacagctgtggagttagggcagcatggcatccgtgtaaattgcgtgtcgccctacgttgttttgaccccattggtgaaggatttctttaagctggatgatgatgaagtaaatcgtctttactctaatctgaaagaagcagttctgaaagcagaagacattgcggaggctgctctttttctggggagtgatgagtccaagtatgttagtggacataatttgattgtagacgggggcttcaccattgttaatccaggtttttgtatgtttccacaatctatttga

SEQ ID NO: 3054 - protein, 305 aa, Populus balsamifera subsp. trichocarpa
  misc_feature (1)..(305): Ceres ANNOT ID no. 1541881
  misc_feature (51)..(218): Pfam Name: adh_short Pfam Description: short chain dehydrogenase
  misc_feature: SWISSPROT Homolog: TS2_MAIZE Sex determination protein tasselseed-2 with e-value of 5.1e-59 and BLAST sequence identity of 46.4
  misc_feature: SWISSPROT Homolog: HSD_MYCBO 3-alpha-(or 20-beta)-hydroxysteroid dehydrogenase (EC 1.1.1.53) with e-value of 4.9e-42 and BLAST sequence identity of 40.5
  misc_feature: SWISSPROT Homolog: HSD_MYCTU 3-alpha-(or 20-beta)-hydroxysteroid dehydrogenase (EC 1.1.1.53) with e-value of 4.9e-42 and BLAST sequence identity of 40.5
  misc_feature: SWISSPROT Homolog: LINC_PSEPA A 2,5-dichloro-2,5-cyclohexadiene-1,4-diol dehydrogenase EC 1.1.1.-  (2,5-DDOL dehydrogenase) with e-value of 1.4e-37 and BLAST sequence identity of 37.5
  misc_feature: SWISSPROT Homolog: FABG_THEMA 3-oxoacyl-[acyl-carrier-protein] reductase (EC 1.1.1.100) (3-ketoacyl-acyl carrier protein reductase) with e-value of 1.6e-36 and BLAST sequence identity of 37.6
  misc_feature: Utility: ABA Useful for making plants with enhanced tolerance to drought
  misc_feature 339300:<222: Transcription Factor
  misc_feature: Phenotype: WHOLE PLANT - ABA Useful for making plants with enhanced tolerance to drought
  misc_feature (1)..(305): Functional Homolog of  Ceres CLONE ID no. 529835 at SEQ ID NO. 3099 with e-value of 1.80E-98 and BLAST sequence identity of 70.6
MAILGKYHVLGKHREWLPGELVLIHGECFTCLSSPKKVTKAFCWCCRLEGKVALITGGSSGIGESAARLFAKHGAKVVIADVQDELGHSVCEELKTESASFVHCDVTQEKDVENAVNTAVSKHGKLDIMFNNAGIVGTPKPNILDNDKAEFEKVISVNVVGAFLGTKHAARVMIPVRRGSIISTASVCGTIGGVASHAYTSSKHGVIGLMRNTAVELGQHGIRVNCVSPYVVLTPLVKDFFKLDDDEVNRLYSNLKEAVLKAEDIAEAALFLGSDESKYVSGHNLIVDGGFTIVNPGFCMFPQSI

SEQ ID NO: 3055 - DNA, 816 bp, Populus balsamifera subsp. trichocarpa
  misc_feature (1)..(816): Ceres ANNOT ID no. 1487614
  misc_feature: Utility: ABA Useful for making plants with enhanced tolerance to drought
  misc_feature 339399:<222: Transcription Factor
  misc_feature: Phenotype: WHOLE PLANT - ABA Useful for making plants with enhanced tolerance to drought
atgggaagtgtttcgctagtctctgcagccctaagaaggctagaaggcaaggtggcactgatcactggaggatcaagtggcataggagagtccactgcaagactcttcgtcaaacatggagctaaggtggtaattgcagacattcaagatgaattgggccactccgtttgcaaggaattagaacctgaacctgcttcattcatccattgtgatgttactcaagaaaaagatgttgaaaacgctgttaatacagctgtttctaagtatggaaagcttgacatcatgttcaacaacgcaggtacaggaggaacgccaaaaacaaacataattgaaaatgacaaggccgaatttgagaagatcatttgtgccaatttagtaggtgcattcttaggcactaagcatgcagcccgtgtaatgatccctgctcggcgcggtagcataattacaactgcaagtgtttgtgcaataattggaggaggttcatcacatgcctacactagttcaaagcatggtgtgttaggattaatgagaaacacggctgtggaattaggacaatatggcatccgtgtaaattgtgtgtcaccgtacgcggttcctaccccattgtttaagaatttctttaagatgaacgacgatgaagttagttgcatttactctaacctcaaggaagctgtgcttgaagcagaagacattgctgaggctgctctttatttggggagtgatgaatcaaagtatgttagtggacacaatctggtggtagatggtggcttcactattgtaaatccaggtttttgcatgtttccacgatctagctga

SEQ ID NO: 3056 - protein, 271 aa, Populus balsamifera subsp. trichocarpa
  misc_feature (1)..(271): Ceres ANNOT ID no. 1487614
  misc_feature (17)..(184): Pfam Name: adh_short Pfam Description: short chain dehydrogenase
  misc_feature: SWISSPROT Homolog: TS2_MAIZE Sex determination protein tasselseed-2 with e-value of 5.1e-59 and BLAST sequence identity of 46.4
  misc_feature: SWISSPROT Homolog: HSD_MYCBO 3-alpha-(or 20-beta)-hydroxysteroid dehydrogenase (EC 1.1.1.53) with e-value of 4.9e-42 and BLAST sequence identity of 40.5
  misc_feature: SWISSPROT Homolog: HSD_MYCTU 3-alpha-(or 20-beta)-hydroxysteroid dehydrogenase (EC 1.1.1.53) with e-value of 4.9e-42 and BLAST sequence identity of 40.5
  misc_feature: SWISSPROT Homolog: LINC_PSEPA A 2,5-dichloro-2,5-cyclohexadiene-1,4-diol dehydrogenase EC 1.1.1.-  (2,5-DDOL dehydrogenase) with e-value of 1.4e-37 and BLAST sequence identity of 37.5
  misc_feature: SWISSPROT Homolog: FABG_THEMA 3-oxoacyl-[acyl-carrier-protein] reductase (EC 1.1.1.100) (3-ketoacyl-acyl carrier protein reductase) with e-value of 1.6e-36 and BLAST sequence identity of 37.6
  misc_feature: Utility: ABA Useful for making plants with enhanced tolerance to drought
  misc_feature 339503:<222: Transcription Factor
  misc_feature: Phenotype: WHOLE PLANT - ABA Useful for making plants with enhanced tolerance to drought
  misc_feature (1)..(271): Functional Homolog of  Ceres CLONE ID no. 529835 at SEQ ID NO. 3099 with e-value of 2.90E-98 and BLAST sequence identity of 69.2
MGSVSLVSAALRRLEGKVALITGGSSGIGESTARLFVKHGAKVVIADIQDELGHSVCKELEPEPASFIHCDVTQEKDVENAVNTAVSKYGKLDIMFNNAGTGGTPKTNIIENDKAEFEKIICANLVGAFLGTKHAARVMIPARRGSIITTASVCAIIGGGSSHAYTSSKHGVLGLMRNTAVELGQYGIRVNCVSPYAVPTPLFKNFFKMNDDEVSCIYSNLKEAVLEAEDIAEAALYLGSDESKYVSGHNLVVDGGFTIVNPGFCMFPRSS

SEQ ID NO: 3057 - DNA, 828 bp, Populus balsamifera subsp. trichocarpa
  misc_feature (1)..(828): Ceres ANNOT ID no. 1488468
  misc_feature: Utility: ABA Useful for making plants with enhanced tolerance to drought
  misc_feature 339593:<222: Transcription Factor
  misc_feature: Phenotype: WHOLE PLANT - ABA Useful for making plants with enhanced tolerance to drought
atgggaagtgtctcgctactttctacagttgcaagaaggctagaaggtaaagtggcgttgatcaccggtggggctcgtggcattggagagtcaactgcaagacacttcttcaaacatggagcaaaagtagtgattgcagatactcaagatgagttggctcattctgtttgcaaagatttgaactctgaatctgcttcttttatccattgtgacgttacaaaagaaacagatgtagaaaatgcagtgaacacagccatttcaaggcatggcaagctagacgttatgttcaataatgctggcattgtaggagtggtgaaaaccaacatggttgatgtttccatgtctgaattcgaggaagtcattagggttaacctagtaggtgctttcctgggcactaaacatgcagctcgtgtgatgaagcctgctcgacaaggcagcatcataacaacctctagtgtttgtggtattctgggaggttttgcatcccatgcctacacaagttcaaagcatggcgtgttagggctaatgagaaatgcagctgttgagcttggacaatttggcattcgtgtaaattgcgtctccccgtacactgttgcaactgaaatgtcaagaaatttcttgaagatgactgatgatgaaattcgcagtggttattctaaccttaagggggcaattctgacgcctgaagatgtggctgaagcagctctctacttggcaagtgaggactccagatatgtgagcggccacaatctcgtggtagatggcggccacaccatcgtaaataatggttcttgtatgtatgataacccaagtgtgtatggtctctga

SEQ ID NO: 3058 - protein, 275 aa, Populus balsamifera subsp. trichocarpa
  misc_feature (1)..(275): Ceres ANNOT ID no. 1488468
  misc_feature (19)..(254): Pfam Name: Epimerase Pfam Description: NAD dependent epimerase/dehydratase family
  misc_feature: SWISSPROT Homolog: TS2_MAIZE Sex determination protein tasselseed-2 with e-value of 5.1e-59 and BLAST sequence identity of 46.4
  misc_feature: SWISSPROT Homolog: HSD_MYCBO 3-alpha-(or 20-beta)-hydroxysteroid dehydrogenase (EC 1.1.1.53) with e-value of 4.9e-42 and BLAST sequence identity of 40.5
  misc_feature: SWISSPROT Homolog: HSD_MYCTU 3-alpha-(or 20-beta)-hydroxysteroid dehydrogenase (EC 1.1.1.53) with e-value of 4.9e-42 and BLAST sequence identity of 40.5
  misc_feature: SWISSPROT Homolog: LINC_PSEPA A 2,5-dichloro-2,5-cyclohexadiene-1,4-diol dehydrogenase EC 1.1.1.-  (2,5-DDOL dehydrogenase) with e-value of 1.4e-37 and BLAST sequence identity of 37.5
  misc_feature: SWISSPROT Homolog: FABG_THEMA 3-oxoacyl-[acyl-carrier-protein] reductase (EC 1.1.1.100) (3-ketoacyl-acyl carrier protein reductase) with e-value of 1.6e-36 and BLAST sequence identity of 37.6
  misc_feature: Utility: ABA Useful for making plants with enhanced tolerance to drought
  misc_feature 339697:<222: Transcription Factor
  misc_feature: Phenotype: WHOLE PLANT - ABA Useful for making plants with enhanced tolerance to drought
  misc_feature (1)..(275): Functional Homolog of  Ceres CLONE ID no. 529835 at SEQ ID NO. 3099 with e-value of 4.70E-91 and BLAST sequence identity of 65.9
MGSVSLLSTVARRLEGKVALITGGARGIGESTARHFFKHGAKVVIADTQDELAHSVCKDLNSESASFIHCDVTKETDVENAVNTAISRHGKLDVMFNNAGIVGVVKTNMVDVSMSEFEEVIRVNLVGAFLGTKHAARVMKPARQGSIITTSSVCGILGGFASHAYTSSKHGVLGLMRNAAVELGQFGIRVNCVSPYTVATEMSRNFLKMTDDEIRSGYSNLKGAILTPEDVAEAALYLASEDSRYVSGHNLVVDGGHTIVNNGSCMYDNPSVYGL

SEQ ID NO: 3059 - DNA, 831 bp, Populus balsamifera subsp. trichocarpa
  misc_feature (1)..(831): Ceres ANNOT ID no. 1475186
  misc_feature: Utility: ABA Useful for making plants with enhanced tolerance to drought
  misc_feature 339790:<222: Transcription Factor
  misc_feature: Phenotype: WHOLE PLANT - ABA Useful for making plants with enhanced tolerance to drought
atgtcaaccactgcgtttatctccaccatagccagaaggctacaaggaaaggtagccttaatcaccggcggtgctagtggtattggtgaatgcaccgcaaaagtcttctctcaccatggagctaaagtagtaattgctgatatccaagacgaattaggccattcagttgtcgaggccctaggcccttcaaactccacctacgtgcgttgcgatgtcaccgaagaggcccagataaaaaatgctgtggacaaagctatctcaacctatggcaagctagatataatgctcaacaatgctggcattgctgatgacagtaaagcacgcataatcgacaacgaaatggctgattttgaacgtgttcttaagattaacgtgaccggagttttcctcggcatcaagcacgccgcccgcgtcatgatcccagcacgcagtggcaccataatttcaactgctagtgtaagctcactacttggtgcggcagcttcacatgcatactgttgctcaaaacatgctgtgttaggactgacaagaaatgctgcagctgagcttggacagtttggcattagggtgaattgcttatctccttacgcactcgcaactcctttagcaaggaaatttattggggttgatgatgatgaggcgcttgaaattgcgatgaattcatttgctaatctaaagggagtgacccttaagacggaagatgttgccaatgcagctctttatctagccagtgatgaggctaggtatattagtgggcataatttatttatagatggagggttcagcgttcaaaacccgacattccagatgtttcagtatccagattcttga

SEQ ID NO: 3060 - protein, 276 aa, Populus balsamifera subsp. trichocarpa
  misc_feature (1)..(276): Ceres ANNOT ID no. 1475186
  misc_feature (17)..(184): Pfam Name: adh_short Pfam Description: short chain dehydrogenase
  misc_feature: SWISSPROT Homolog: TS2_MAIZE Sex determination protein tasselseed-2 with e-value of 5.1e-59 and BLAST sequence identity of 46.4
  misc_feature: SWISSPROT Homolog: HSD_MYCBO 3-alpha-(or 20-beta)-hydroxysteroid dehydrogenase (EC 1.1.1.53) with e-value of 4.9e-42 and BLAST sequence identity of 40.5
  misc_feature: SWISSPROT Homolog: HSD_MYCTU 3-alpha-(or 20-beta)-hydroxysteroid dehydrogenase (EC 1.1.1.53) with e-value of 4.9e-42 and BLAST sequence identity of 40.5
  misc_feature: SWISSPROT Homolog: LINC_PSEPA A 2,5-dichloro-2,5-cyclohexadiene-1,4-diol dehydrogenase EC 1.1.1.-  (2,5-DDOL dehydrogenase) with e-value of 1.4e-37 and BLAST sequence identity of 37.5
  misc_feature: SWISSPROT Homolog: FABG_THEMA 3-oxoacyl-[acyl-carrier-protein] reductase (EC 1.1.1.100) (3-ketoacyl-acyl carrier protein reductase) with e-value of 1.6e-36 and BLAST sequence identity of 37.6
  misc_feature: Utility: ABA Useful for making plants with enhanced tolerance to drought
  misc_feature 339894:<222: Transcription Factor
  misc_feature: Phenotype: WHOLE PLANT - ABA Useful for making plants with enhanced tolerance to drought
  misc_feature (1)..(276): Functional Homolog of  Ceres CLONE ID no. 529835 at SEQ ID NO. 3099 with e-value of 3.99E-78 and BLAST sequence identity of 56.6
MSTTAFISTIARRLQGKVALITGGASGIGECTAKVFSHHGAKVVIADIQDELGHSVVEALGPSNSTYVRCDVTEEAQIKNAVDKAISTYGKLDIMLNNAGIADDSKARIIDNEMADFERVLKINVTGVFLGIKHAARVMIPARSGTIISTASVSSLLGAAASHAYCCSKHAVLGLTRNAAAELGQFGIRVNCLSPYALATPLARKFIGVDDDEALEIAMNSFANLKGVTLKTEDVANAALYLASDEARYISGHNLFIDGGFSVQNPTFQMFQYPDS

SEQ ID NO: 3061 - DNA, 834 bp, Populus balsamifera subsp. trichocarpa
  misc_feature (1)..(834): Ceres ANNOT ID no. 1454958
  misc_feature: Utility: ABA Useful for making plants with enhanced tolerance to drought
  misc_feature 339987:<222: Transcription Factor
  misc_feature: Phenotype: WHOLE PLANT - ABA Useful for making plants with enhanced tolerance to drought
atgaaaggctcttccttgcttgctcctgtttccaagaggttggaaggaaaggtagccctgattacaggcggagctagtgggattggtgaatcctgtactaggctatttgttcggcatggcgccaaggttgtaattgcagacatccaagatgaccttggccattctgtatgtgaagaaattggctcaaatgaatccctttcctatgtccattgcgacgttacaagagaatctgatgttgaaaaggcagttaatacagctgtttcaaagtacgggaagcttgacatatttttcagcaatgcaggaattcttggaaaaggggatccgcaagcatcagctattgattatgataattttaagagggtcttcgatacaaatgtatatggagcattccttggagctaagcatgcttcaagagtaatgattcctgagaagaaaggcagcattatctacacttcaagtgtggtttcagtaattgttggcaatgttccacatgcctacacagcatcgaagcacgccatcgtaggactgacaaagaacttgtgtgccgagttagggcagtttgggattagagtcaactgcatctctcctgccgccgtacccacccctttaatgaggaatgcatttggaggaattaataggaatgcggcattggaaatagcttctgcaacagcacacttaaagggggtcatgcttgaggaggaagatgtagcagaggcagcattgtacttggcgagcgatgactccaaatatgtgagtgggttgaaccttgtggttgatgggggtatcagcgcgaccaatgcaaatcttgctggtaacttgaaggacatggtttag

SEQ ID NO: 3062 - protein, 277 aa, Populus balsamifera subsp. trichocarpa
  misc_feature (1)..(277): Ceres ANNOT ID no. 1454958
  misc_feature (17)..(185): Pfam Name: adh_short Pfam Description: short chain dehydrogenase
  misc_feature: SWISSPROT Homolog: TS2_MAIZE Sex determination protein tasselseed-2 with e-value of 5.1e-59 and BLAST sequence identity of 46.4
  misc_feature: SWISSPROT Homolog: HSD_MYCBO 3-alpha-(or 20-beta)-hydroxysteroid dehydrogenase (EC 1.1.1.53) with e-value of 4.9e-42 and BLAST sequence identity of 40.5
  misc_feature: SWISSPROT Homolog: HSD_MYCTU 3-alpha-(or 20-beta)-hydroxysteroid dehydrogenase (EC 1.1.1.53) with e-value of 4.9e-42 and BLAST sequence identity of 40.5
  misc_feature: SWISSPROT Homolog: LINC_PSEPA A 2,5-dichloro-2,5-cyclohexadiene-1,4-diol dehydrogenase EC 1.1.1.-  (2,5-DDOL dehydrogenase) with e-value of 1.4e-37 and BLAST sequence identity of 37.5
  misc_feature: SWISSPROT Homolog: FABG_THEMA 3-oxoacyl-[acyl-carrier-protein] reductase (EC 1.1.1.100) (3-ketoacyl-acyl carrier protein reductase) with e-value of 1.6e-36 and BLAST sequence identity of 37.6
  misc_feature: Utility: ABA Useful for making plants with enhanced tolerance to drought
  misc_feature 340091:<222: Transcription Factor
  misc_feature: Phenotype: WHOLE PLANT - ABA Useful for making plants with enhanced tolerance to drought
  misc_feature (1)..(277): Functional Homolog of  Ceres CLONE ID no. 529835 at SEQ ID NO. 3099 with e-value of 3.40E-72 and BLAST sequence identity of 57.9
MKGSSLLAPVSKRLEGKVALITGGASGIGESCTRLFVRHGAKVVIADIQDDLGHSVCEEIGSNESLSYVHCDVTRESDVEKAVNTAVSKYGKLDIFFSNAGILGKGDPQASAIDYDNFKRVFDTNVYGAFLGAKHASRVMIPEKKGSIIYTSSVVSVIVGNVPHAYTASKHAIVGLTKNLCAELGQFGIRVNCISPAAVPTPLMRNAFGGINRNAALEIASATAHLKGVMLEEEDVAEAALYLASDDSKYVSGLNLVVDGGISATNANLAGNLKDMV

SEQ ID NO: 3063 - DNA, 843 bp, Populus balsamifera subsp. trichocarpa
  misc_feature (1)..(843): Ceres ANNOT ID no. 1437875
  misc_feature: Utility: ABA Useful for making plants with enhanced tolerance to drought
  misc_feature 340184:<222: Transcription Factor
  misc_feature: Phenotype: WHOLE PLANT - ABA Useful for making plants with enhanced tolerance to drought
atggccaccgcaagctccactgactcatccctctctcctctaaggttattgggcaaagtagcattggtaacaggtggagctaccggtattggggagagcattgcccggctattttgcagacatggtgcaaaagtttgcatagctgatttgcaagacaaccttggacaaaatgtttgcgagtcgcttggtggtgagccaaaaacttgttatatccattgtgatgtcacaatagaggatgatgttcgccaagctgttgactttactgttgataaatttggaacattggatattatggttaacaatgctgggctgggaggtcccccctgtccagatatccgtaaggtggccttatcagactttgaaaaggtgtttgatgtaaatgtgaagggtgtttttcttggaatgaagcatgcagcacggattatgatccccctaaataagggttcaattgtttctctctgtagtgttgccagtgccatagggggtataggcccacatgcttacacagggtcaaagcatgctgtattgggtctgaccagaagtgttgcagctgaactaggaaaacatgggatacgcgtaaactgtgtctctccttatggagttgcgacaagcttggctgtggctcatttgcccgaggatgagaggactgaggatgccttaataggtttccgctcttttattgggaggaatgctaacttgcaaggtgtggaattgacagttgatgatgtggccaatgccgtgctcttcctagcaagtgatgaagcaaggtacataagtggggataatctaatgcttgatgggggcttcacgtgcacaaaccactcactccgtgtcttcagatga

SEQ ID NO: 3064 - protein, 280 aa, Populus balsamifera subsp. trichocarpa
  misc_feature (1)..(280): Ceres ANNOT ID no. 1437875
  misc_feature (19)..(187): Pfam Name: adh_short Pfam Description: short chain dehydrogenase
  misc_feature: SWISSPROT Homolog: TS2_MAIZE Sex determination protein tasselseed-2 with e-value of 5.1e-59 and BLAST sequence identity of 46.4
  misc_feature: SWISSPROT Homolog: HSD_MYCBO 3-alpha-(or 20-beta)-hydroxysteroid dehydrogenase (EC 1.1.1.53) with e-value of 4.9e-42 and BLAST sequence identity of 40.5
  misc_feature: SWISSPROT Homolog: HSD_MYCTU 3-alpha-(or 20-beta)-hydroxysteroid dehydrogenase (EC 1.1.1.53) with e-value of 4.9e-42 and BLAST sequence identity of 40.5
  misc_feature: SWISSPROT Homolog: LINC_PSEPA A 2,5-dichloro-2,5-cyclohexadiene-1,4-diol dehydrogenase (EC 1.1.1.-) EC.1.1.1.- (2,5-DDOL dehydrogenase) with e-value of 1.4e-37 and BLAST sequence identity of 37.5
  misc_feature: SWISSPROT Homolog: FABG_THEMA 3-oxoacyl-[acyl-carrier-protein] reductase (EC 1.1.1.100) (3-ketoacyl-acyl carrier protein reductase) with e-value of 1.6e-36 and BLAST sequence identity of 37.6
  misc_feature: Utility: ABA Useful for making plants with enhanced tolerance to drought
  misc_feature 340290:<222: Transcription Factor
  misc_feature: Phenotype: WHOLE PLANT - ABA Useful for making plants with enhanced tolerance to drought
  misc_feature (1)..(280): Functional Homolog of  Ceres CLONE ID no. 529835 at SEQ ID NO. 3099 with e-value of 1.30E-65 and BLAST sequence identity of 54.5
MATASSTDSSLSPLRLLGKVALVTGGATGIGESIARLFCRHGAKVCIADLQDNLGQNVCESLGGEPKTCYIHCDVTIEDDVRQAVDFTVDKFGTLDIMVNNAGLGGPPCPDIRKVALSDFEKVFDVNVKGVFLGMKHAARIMIPLNKGSIVSLCSVASAIGGIGPHAYTGSKHAVLGLTRSVAAELGKHGIRVNCVSPYGVATSLAVAHLPEDERTEDALIGFRSFIGRNANLQGVELTVDDVANAVLFLASDEARYISGDNLMLDGGFTCTNHSLRVFR

SEQ ID NO: 3065 - DNA, 918 bp, Populus balsamifera subsp. trichocarpa
  misc_feature (1)..(918): Ceres ANNOT ID no. 1476056
  misc_feature: Utility: ABA Useful for making plants with enhanced tolerance to drought
  misc_feature 340383:<222: Transcription Factor
  misc_feature: Phenotype: WHOLE PLANT - ABA Useful for making plants with enhanced tolerance to drought
atgccttgtcaagtgatgcaagagaaaacccttcaaagcttttatgccgcgggaagggaaaagtcgacagaaaacagtccttgctctcctggaaggttggagggaagagtagcagtggtcacaggtggtgctcgaggaattggagaggcaacagtaaggctttttgcaagacatggtgccaaagtagtgattgctgatgttgaggatactctcggaactttgctagcaaactcactagccccttcagtttcctttgttcattgtgatgttagcttagaagaagacattgagaacctgataaactccacagtttctcactatggtaagctagatgttcttttcaacaatgctggggtgcttggaaatcaatcgaagaacaagagcattgtcaattttgatgctgaagaatttgatcgtgtcatgcaagtgaatgttagaggcgtggcactaggaattaagcacgcggcaagagtgatgattcctagaggagttgggtgtattatttccacagccagtgtagctggtgtcatgggagggcttggtcctcatgcctatacagcttcgaagcatgccattgttgggctcacaaagaacacagcatgtgagcttggcaggtatgggattcgagtcaattgcatctctccatttggggtggctacatctatgcttgttaatgcgtggagaagtggcgatgaagaggaagattgcttgaactttggattgccttgtgaaaaggaagtggagaagatggaagactttgttagaggcctggctaacctaaaaggtccaactctaagggctagagatatagccgaggctgcactttatctagctagtgatgaatccaagtatgttagtggtcataatcttgtcgtggatggtggaattaccacttcaagaaattgtgttggcttgtaa

SEQ ID NO: 3066 - protein, 300 aa, Populus balsamifera subsp. trichocarpa
  misc_feature (1)..(300): Ceres ANNOT ID no. 1476056
  misc_feature (31)..(199): Pfam Name: adh_short Pfam Description: short chain dehydrogenase
  misc_feature: SWISSPROT Homolog: TS2_MAIZE Sex determination protein tasselseed-2 with e-value of 5.1e-59 and BLAST sequence identity of 46.4
  misc_feature: SWISSPROT Homolog: HSD_MYCBO 3-alpha-(or 20-beta)-hydroxysteroid dehydrogenase (EC 1.1.1.53) with e-value of 4.9e-42 and BLAST sequence identity of 40.5
  misc_feature: SWISSPROT Homolog: HSD_MYCTU 3-alpha-(or 20-beta)-hydroxysteroid dehydrogenase (EC 1.1.1.53) with e-value of 4.9e-42 and BLAST sequence identity of 40.5
  misc_feature: SWISSPROT Homolog: LINC_PSEPA A 2,5-dichloro-2,5-cyclohexadiene-1,4-diol dehydrogenase EC 1.1.1.-  (2,5-DDOL dehydrogenase) with e-value of 1.4e-37 and BLAST sequence identity of 37.5
  misc_feature: SWISSPROT Homolog: FABG_THEMA 3-oxoacyl-[acyl-carrier-protein] reductase (EC 1.1.1.100) (3-ketoacyl-acyl carrier protein reductase) with e-value of 1.6e-36 and BLAST sequence identity of 37.6
  misc_feature: Utility: ABA Useful for making plants with enhanced tolerance to drought
  misc_feature 340491:<222: Transcription Factor
  misc_feature: Phenotype: WHOLE PLANT - ABA Useful for making plants with enhanced tolerance to drought
  misc_feature (1)..(300): Functional Homolog of  Ceres CLONE ID no. 529835 at SEQ ID NO. 3099 with e-value of 2.59E-65 and BLAST sequence identity of 56.7
MQEKTLQSFYAAGREKSTENSPCSPGRLEGRVAVVTGGARGIGEATVRLFARHGAKVVIADVEDTLGTLLANSLAPSVSFVHCDVSLEEDIENLINSTVSHYGKLDVLFNNAGVLGNQSKNKSIVNFDAEEFDRVMQVNVRGVALGIKHAARVMIPRGVGCIISTASVAGVMGGLGPHAYTASKHAIVGLTKNTACELGRYGIRVNCISPFGVATSMLVNAWRSGDEEEDCLNFGLPCEKEVEKMEDFVRGLANLKGPTLRARDIAEAALYLASDESKYVSGHNLVVDGGITTSRNCVGL

SEQ ID NO: 3067 - DNA, 918 bp, Populus balsamifera subsp. trichocarpa
  misc_feature (1)..(918): Ceres ANNOT ID no. 1454260
  misc_feature: Utility: ABA Useful for making plants with enhanced tolerance to drought
  misc_feature 340587:<222: Transcription Factor
  misc_feature: Phenotype: WHOLE PLANT - ABA Useful for making plants with enhanced tolerance to drought
atgcctggtcaagtgatgcaagagaaaacccttcaaagcattcatgtcatgggaagggaaaagtcgacagaaaacagcactcgctctcctggaagattggagggaagagttgcaatagtcacaggcggtgcgcgaggaattggagaggccactgtaagactttttgcaagacaaggtgccaaagtagtcattgctgatgttgaggatgctcttggaacttcgctcgtaaactcattagccccttcagtttcctttgttcattgtgatgttagcttagaaaaagacattgagaacctgataaactccacgatttctcaatatggtaagttagatattcttttcaacaatgctggggtgcttggaaatcaatcaaagaacaagagcattgttgattttgatgtagacgaatttgaccgtgtcatgcatgtgaatgttagaggaatggcactaggaattaagcacgcagcacgagtgatgattcctagaggaggtgggtgtattatttccacagctagtgtggctggtgtcatgggagggcttggtcctcatgcttacacagcttcaaagcatgccattgttggactcacaaaaaacacagcttgtgagcttggccggtatggaattcgagttaattgcatttctccatttggggtggccacatctatgcttgttaatgcctggagaagtagtggcgaagaggaagattccttgaattttggattgcctagtgaaaaggaagtggagaagatggaggactttgttagagggctggctaacctaaaaggtccaactctaagggctagagatatagctgaagctgctctttatctagctagcgatgaatcaaagtatgtcagtggtcataatcttgttgtggatggtggaatcacaacttcaacaaattgtgttgggttgtaa

SEQ ID NO: 3068 - protein, 289 aa, Populus balsamifera subsp. trichocarpa
  misc_feature (1)..(289): Ceres ANNOT ID no. 1454260
  misc_feature (20)..(188): Pfam Name: adh_short Pfam Description: short chain dehydrogenase
  misc_feature: SWISSPROT Homolog: TS2_MAIZE Sex determination protein tasselseed-2 with e-value of 5.1e-59 and BLAST sequence identity of 46.4
  misc_feature: SWISSPROT Homolog: HSD_MYCBO 3-alpha-(or 20-beta)-hydroxysteroid dehydrogenase (EC 1.1.1.53) with e-value of 4.9e-42 and BLAST sequence identity of 40.5
  misc_feature: SWISSPROT Homolog: HSD_MYCTU 3-alpha-(or 20-beta)-hydroxysteroid dehydrogenase (EC 1.1.1.53) with e-value of 4.9e-42 and BLAST sequence identity of 40.5
  misc_feature: SWISSPROT Homolog: LINC_PSEPA A 2,5-dichloro-2,5-cyclohexadiene-1,4-diol dehydrogenase (2,5-DDOL dehydrogenase) with e-value of 1.4e-37 and BLAST sequence identity of 37.5
  misc_feature: SWISSPROT Homolog: FABG_THEMA 3-oxoacyl-[acyl-carrier-protein] reductase (EC 1.1.1.100) (3-ketoacyl-acyl carrier protein reductase) with e-value of 1.6e-36 and BLAST sequence identity of 37.6
  misc_feature: Utility: ABA Useful for making plants with enhanced tolerance to drought
  misc_feature 340695:<222: Transcription Factor
  misc_feature: Phenotype: WHOLE PLANT - ABA Useful for making plants with enhanced tolerance to drought
  misc_feature (1)..(289): Functional Homolog of  Ceres CLONE ID no. 529835 at SEQ ID NO. 3099 with e-value of 3.90E-64 and BLAST sequence identity of 55.9
MGREKSTENSTRSPGRLEGRVAIVTGGARGIGEATVRLFARQGAKVVIADVEDALGTSLVNSLAPSVSFVHCDVSLEKDIENLINSTISQYGKLDILFNNAGVLGNQSKNKSIVDFDVDEFDRVMHVNVRGMALGIKHAARVMIPRGGGCIISTASVAGVMGGLGPHAYTASKHAIVGLTKNTACELGRYGIRVNCISPFGVATSMLVNAWRSSGEEEDSLNFGLPSEKEVEKMEDFVRGLANLKGPTLRARDIAEAALYLASDESKYVSGHNLVVDGGITTSTNCVGL

SEQ ID NO: 3069 - protein, 640 aa, Glycine max
  misc_feature (1)..(640): Ceres CLONE ID no. 531768
  misc_feature (1)..(640): Also Known As Ceres CDNA ID no. 23694932
  misc_feature (1)..(640): Also Known As Ceres GEMINI ID 540E5
  misc_feature (292)..(324): Pfam Name: Ank Pfam Description: Ankyrin repeat
  misc_feature (489)..(509): Pfam Name: IQ Pfam Description: IQ calmodulin-binding motif
  misc_feature 340811:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MSKELGDVEESNKPSTSGGYWDTVETENEVGNTTIPSQGHLDTYVLDPSVSHDQLFSIIDYSPSWAFEGSEIKVIISGEFLRSQHEAEQCKWSCMFGEVEVPAVIIAKGVLCCHTPPHKAGRVPFYVTCSNRLACSEVREFDFQVHYTPEDTTGENRGSTFDTFSIRFGELLSLGHAFPQNSDSISVSEKSQLRSKINSLLREDDDDWDKLLKLTQEKDFSPENLREQLLQNLLKDKLHAWLLQKITEEGKGPNVLDEGGQGVLHFAAALGYDWALEPTIVAGVNVNFRDVNGWTSLHWAAFCGRERTVAFLISLGAAPGALTDPCPEHPSGRTPADLASANGHKGIAGYLAESSLSAHLTTLDLNRDAGENSGAKVVQRLQNIAQVNDLDGLSYELSLKDSLAAVCNATQAAARIHQVFRMQSFQRKQLKEYDDDKLGLSDERALSLIKMNVKSHKSGPRDEPVHAAAIRIQNKFRSWKGRREFLMIRQRIVKIQAHVRGHQVRKSCGKIIWSVGILEKVILRWRRKGSGLRGFKPEANSEGTMIQDVSSTDDDYDVLKEGRKQTEQRLQKALARVKSMVQYPEARDQYHRLLNVVTEIQENQVKHESSSNNSEEPREFGDLNDLEALLDEDIFMPTAT

SEQ ID NO: 3070 - DNA, 2937 bp, Populus balsamifera subsp. trichocarpa
  misc_feature (1)..(2937): Ceres ANNOT ID no. 1456366
  misc_feature 340960:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggctatcatgaatggagtatctcttattctagaagaggaaaatgctgctttaatcttcatatttcagcagggaaccaggacaaattttaaccgcattaaagagcatgaagaatgtattccttactctcaagaaactgaagacacaatgcccagttcagagatggacacttctgtttcttcccgtttccaccctaatggttaccaggtgcctacaagaactacagatacaacaagcatgaatagcgctcaggcatcagaatatgaggatgctgaatcagtatataataaccaagccagttccacatttcattcttttcttgaggtgcaaaagcctgcaatggagagaattgatacaggctcatctgttcattatgatcacatgacgttttcaagtgattatcaaggcaaattgtcagctgttcctgggatggacgtcatctcacttgcccaagtggataaaactaaagaaactaatggtactgaatcagcatgtgagcctcagaaagtcattgacttgccgtcgtgggaggatgtattagaaaattatgctcgtggaactgaatctgtgcctttccagactcttttgtcacaagatgatacggtaggaatcatccctaaacaagaagatggaatactggagaagcttttaaccaatagctttgataaaagggaggatattgggagtcatatacttgatcaggaagcatggcagtctatggagggtgtttcttcacatctattaaagtggtccgtggatcaaaagttgcttctgaactcaggatacgatctcactgctaggtttcctgatcaacaacttgatagtggcaacttaatcaatactcttgagcctttatgtacacaggaaaacgatctccatatccaaaatgacattcaaatacagcctgcaaatgcagatcatggtatgaccctagagggaaaatcaatgtactcttcttcggtgaaacatcatatattggatggttcagggacagaaggtttgaagaagcttgatagtttcacccgatggatgagtaaagaacttggagatgtagagccacaggtgcagtccagttctgggtcctattggattactgcagaaagtgaaaacggggttgatgactccagcaatccttctcaaggaaacctggatgcatatttgctttctccttctctctcccaggaccaactctttagcattattgatttctcacccaactgggcatatgcaggcacagagatcaaggtcctaatcatgggaagattcttgaagggtcgagaagcagcagaaaactgccagtggtcaattatgtttggagaagttgaagttcctgcagaggttatagctgatggtgttcttcgttgcaatactccctcgcataaggctggcaggattcctttttatgttacatgttcaaatagggtagcttgtagtgaggtgcgtgaatttgaatacctcagccacacccaagatattacctattactatagtgacagtgttactgaagatcttaatatgcgatttggaaaactactgtccctgagctctgtctccccttcaaaatatgactccagcagtgtggatgagattttgagcagtaaaatcaactcattgctgaatgaggacaatgaaacatgggaccaaatgtttaagcttacttcagaggaggggttttcctcagaaaaagtaaaggaacagcttgttcaaaagctactcaaagaacaattacatgtatggcttttgcagaaggcatctgaaggtggaaaaggccctagcgtattagatgagggtggccaaggggtgctacattttgcagccgcccttggctatgattgggccctggaacctactatagttgctggtgtaagtgtcaattttcgcgatgttaatggatggactgcacttcattgggcagcatcttatggcagagagcgaacagttgcatccctcatccatctaggtgccgctcctggagcattaacagatccaacacccaaatatcccaccagcagaacacctgctgacttagcttctgctaatggacacaaaggaatttccggctttcttgcagaatctgctttgagtgcccacctttcttctctgaatttggaaaagcaggatggcaaggctgcagaatgttctggaacacaagcatcacagacagtttcaggctgtaatgcaactccagtcaatgatgctgacttgccaagtcgactgcccctgaaggattcattagctgctgtttgtaatgctactcaagctgctgctcgtattcaccaagtcttcagagttcagtccttccaaaagaagcagttaaaagagtatggtgatgataaattgggaatgtcacatgagcgcgctctttcgcttattgcagtcaagtcacagaaggcagggcaatacgatgagcctgttcatgctgcaatacgaattcagaacaagttccgtggttggaagggtagaaaagaatttttgataatccggcagcgaattgttaaaattcaggcccatgtaagaggccaccaggtcaggaaaaactacaggaagataatttggtctgtaggcattctggataagattatcttacgttggagacggaaaggaagtggtttgcgtggcttcaaatctgaagcacttactgatggttccagcatgcaagttgtccagtcaaaggatgacgatgatgatttccttaaagaaggcagaaggcaaacagaagaaagatcacaaatagcccttgcaagggtgaaatccatgcatcagcatccagaggcaagagaacaatattgcaggctgcgcaatgttgttgctgagatccaggaggccaaggctatgggcgaatgggctaacaattctgaagtgatggccgagtttgatgacctggtcgatcttggaacattaatggatgatgactctttcatgccttcaaattcttga

SEQ ID NO: 3071 - protein, 929 aa, Populus balsamifera subsp. trichocarpa
  misc_feature (1)..(929): Ceres ANNOT ID no. 1456366
  misc_feature (581)..(613): Pfam Name: Ank Pfam Description: Ankyrin repeat
  misc_feature (756)..(776): Pfam Name: IQ Pfam Description: IQ calmodulin-binding motif
  misc_feature: SWISSPROT Homolog: CMTA2_ARATH Calmodulin-binding transcription activator 2 with e-value of 5.4e-171 and BLAST sequence identity of 53.9
  misc_feature: SWISSPROT Homolog: CMTA2_ARATH Signal-responsive protein 4 Ethylene-induced calmodulin-binding protein c (EICBP.c) AtER66
  misc_feature: SWISSPROT Homolog: CMTA1_ARATH Calmodulin-binding transcription activator 1 with e-value of 3.3e-162 and BLAST sequence identity of 52.1
  misc_feature: SWISSPROT Homolog: CMTA1_ARATH Signal-responsive protein 2 Ethylene-induced calmodulin-binding protein b) (EICBP.b)
  misc_feature: SWISSPROT Homolog: CMTA3_ARATH Calmodulin-binding transcription activator 3 with e-value of 7.6e-156 and BLAST sequence identity of 50.9
  misc_feature: SWISSPROT Homolog: CMTA3_ARATH Signal-responsive protein 1 Ethylene-induced calmodulin-binding protein a (EICBP.a) Ethylene-induced calmodulin-binding protein 1 (EICBP1)
  misc_feature: SWISSPROT Homolog: CMTA4_ARATH Calmodulin-binding transcription activator 4 with e-value of 4.3e-98 and BLAST sequence identity of 38.9
  misc_feature: SWISSPROT Homolog: CMTA4_ARATH Signal-responsive protein 5 Ethylene-induced calmodulin-binding protein d (EICBP.d) Ethylene-induced calmodulin-binding protein 4 (EICBP4)
  misc_feature: SWISSPROT Homolog: CMTA6_ARATH Calmodulin-binding transcription activator 6 with e-value of 1.6e-75 and BLAST sequence identity of 34.0
  misc_feature: SWISSPROT Homolog: CMTA6_ARATH Signal-responsive protein 3 Ethylene-induced calmodulin-binding protein e (EICBP.e) Ethylene-induced calmodulin-binding protein 5 (EICBP5)
  misc_feature 341175:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(929): Functional Homolog of  Ceres CLONE ID no. 531768 at SEQ ID NO. 3116 with e-value of 1.29E-221 and BLAST sequence identity of 69.1
MPSSEMDTSVSSRFHPNGYQVPTRTTDTTSMNSAQASEYEDAESVYNNQASSTFHSFLEVQKPAMERIDTGSSVHYDHMTFSSDYQGKLSAVPGMDVISLAQVDKTKETNGTESACEPQKVIDLPSWEDVLENYARGTESVPFQTLLSQDDTVGIIPKQEDGILEKLLTNSFDKREDIGSHILDQEAWQSMEGVSSHLLKWSVDQKLLLNSGYDLTARFPDQQLDSGNLINTLEPLCTQENDLHIQNDIQIQPANADHGMTLEGKSMYSSSVKHHILDGSGTEGLKKLDSFTRWMSKELGDVEPQVQSSSGSYWITAESENGVDDSSNPSQGNLDAYLLSPSLSQDQLFSIIDFSPNWAYAGTEIKVLIMGRFLKGREAAENCQWSIMFGEVEVPAEVIADGVLRCNTPSHKAGRIPFYVTCSNRVACSEVREFEYLSHTQDITYYYSDSVTEDLNMRFGKLLSLSSVSPSKYDSSSVDEILSSKINSLLNEDNETWDQMFKLTSEEGFSSEKVKEQLVQKLLKEQLHVWLLQKASEGGKGPSVLDEGGQGVLHFAAALGYDWALEPTIVAGVSVNFRDVNGWTALHWAASYGRERTVASLIHLGAAPGALTDPTPKYPTSRTPADLASANGHKGISGFLAESALSAHLSSLNLEKQDGKAAECSGTQASQTVSGCNATPVNDADLPSRLPLKDSLAAVCNATQAAARIHQVFRVQSFQKKQLKEYGDDKLGMSHERALSLIAVKSQKAGQYDEPVHAAIRIQNKFRGWKGRKEFLIIRQRIVKIQAHVRGHQVRKNYRKIIWSVGILDKIILRWRRKGSGLRGFKSEALTDGSSMQVVQSKDDDDDFLKEGRRQTEERSQIALARVKSMHQHPEAREQYCRLRNVVAEIQEAKAMGEWANNSEVMAEFDDLVDLGTLMDDDSFMPSNS

SEQ ID NO: 3072 - DNA, 3300 bp, Populus balsamifera subsp. trichocarpa
  misc_feature (1)..(3300): Ceres ANNOT ID no. 1450869
  misc_feature 341386:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggctgactctagacgttaccctcttggtaaccagctagatattcagcagatactggtagaagcacagaatcgatggctacgccctgccgaaatagttgaaattcttagcaattatcagagatttcgtattgccccagaacctgcacatatgcctccaagtggttcattgttcctttttgatcgcaaagtgctcagatacttcagaaaagatggccataactggagaaagaaaaaagatgggaaaacagtgaaagaagcacacgagaggcttaagggaactttcacacattgtacttgtccattatcgggaagtaaagtgctgaatctagacctgaaatatatgtacaatagccatggaaccaggacaaattttaaccgcattaaagagtatgaagagcctataccttattcccaagaaaccaaagacatgatgccgaattcagagatggatacttctgtttcttccagtttccgctctaatggttaccaggtacccacaggaacgacagattcgacaagcatgaatagcgctctggcatcagaatatgaagatgctgaatcaggatataataaccaagccagttccagatttaactcttttctcgaagtgcaaaggccagcaatggagaaaatggatacaggcacatctattccttatgatcacatgctgttttcaagtggttatcaaggaaaaatgccagctgttcctgtgatggaatttatctcacctgcccaagtggatacagctaaagacactattggtactgaaccagcatccgagccccagaaagtctttgacttaccatcatgggaggatgtattagaaaattgttctcgtggaattgaatctgtgcctttccagacaactttgctgtcacaagtggatacggtgggagtcatccctaaacaagaagatatactggagaagtttcttgccaatagctttgataaaaggcagggtatggtgggagtcatccctaagcaagaagatatactggagaagtttcttaccaatagctttgatagaagtcaggatattgggagtcacctacttgatcaagaagcatggcagactatcgagggtgggtattcgcatcggccaaagtggtccttggatcaaaagttgcatctggactcggatctcactgctaggtttcatgatcaacaacttgatagtggcaactttatcaatacttttgaacctttctgtgcacaggaaaatgataatcatatccaaaatgaccttcaaatacagcctgcaaattcagatcatggtatgaccctagatgagaaatccatctactctacatctatgaaacagcatattttggatgattcaaggacagaaggtttgaagaagctcgatagtttcacccgatggatgagcaaagaacttgaagatgtagatcagccacatttgcaatccagttctgggacatactggatttcggctgaaagtgaaaatgtggttgatgcggacaatccctcacatggacacctggacacatatacgcttggtccatctctctcccaggaccaactctttagcattattgatttctcgcccaactgggcatatgcaggcacagagatcaagatcctagtcatgggaagattcttgaagagccgagaagaagcagaaaactttaaatggtcaattatgtttggagaagttgaagttccagcagagactatagctgatggtattcttcgttgcactactccttcgcataaggctggaagggttcctttttatgttacatgttcgaatagggtagcatgtagtgaagtgcgtgaatttgaatatcgacttagccatgtccaagatattacctataactatattaacattgctactgaagatcttcatatgcgattagcaaaactgttgtctctgagctctgccttcccttcaaaatatgactccagtgatgttgatgagatttcccaattgagcaataaaatcagttcattgctgaaagagggcaatgaaacatgggaccagatgttaaagcttacttcactggagggattttcctcagaaaaactaaaggatcagcttcttcaaaaggcactcaaggaacagttacatgaatggcttttgcagaaggtagctgaaggcggaaaaggccctagtgtattagatgagggtggccaaggggtgctacattttgcagctgctcttggctatgaatgggccctggaacctacaatagttgctggtgtaagtgtcaatttccgcgatgttaatggatggactgcacttcattgggcagcatcttatggcagagagcgaacagttgcttccctaatccatctcggcgctgctcctggagcattaacagatccaactcccaaatatcccacaggcagaacacctgcggacttagcttctgctaatggacacaaagggatttccggctttcttgctgaatctgctttgagtgcccacctatcttctctgaatttggaaaagcaggatggtgatgctgctgaaagttctggaataccagcatcactgacagtttcagactgtaatgaaactcccgtcaaagatgctgacataccaattggactgtccctgaaggattcattagctgctgtttgtaatgctactcaagctgctgctcgtattcatcaagttttcagagttcagtccttccaaaagaagcagttaaaagagtacggtgatgataaatttggaatgtcacacgagcgtgctctttcgcttattgcagtcaagtcacaaaaggcaggacaatatgatgagccagttcatgcagcaatacgaattcagaacaagttccgcggttggaagggtagaaaagaatttttgataattcggcagcgaattgttaaaattcaggcccatgtacgaggccaccaggtcaggaaaaactataggaagataatctggtctgttggcattttggataaaataatcttgcgttggagacgaaaaggaagtggtttgcgtggcttcaaatctgaagcacttactgagggttccagcatgcaagttgtatctacaaaggatgacgatgatgatttccttaaagaaggcagaaagcaaacagaagaaagatcacaaatagcccttgcaagggtgaaatccatgcatcagcatccggaggcaagagaacagtatcacaggctgcgcaatgttgttgctgagatccaagagaccaaggctatgtacgaatgggcaaacaattcagaagcgatggtcgagtttgatgacctgatcaatctcgaaacgttatgggacggtgacactttcttgcctacagattcttga

SEQ ID NO: 3073 - protein, 985 aa, Populus balsamifera subsp. trichocarpa
  misc_feature (1)..(985): Ceres ANNOT ID no. 1450869
  misc_feature (676)..(710): Pfam Name: Ank Pfam Description: Ankyrin repeat
  misc_feature (812)..(832): Pfam Name: IQ Pfam Description: IQ calmodulin-binding motif
  misc_feature: SWISSPROT Homolog: CMTA2_ARATH Calmodulin-binding transcription activator 2 with e-value of 5.4e-171 and BLAST sequence identity of 53.9
  misc_feature: SWISSPROT Homolog: CMTA2_ARATH Signal-responsive protein 4 Ethylene-induced calmodulin-binding protein c (EICBP.c) AtER66
  misc_feature: SWISSPROT Homolog: CMTA1_ARATH Calmodulin-binding transcription activator 1 with e-value of 3.3e-162 and BLAST sequence identity of 52.1
  misc_feature: SWISSPROT Homolog: CMTA1_ARATH Signal-responsive protein 2 Ethylene-induced calmodulin-binding protein b) (EICBP.b)
  misc_feature: SWISSPROT Homolog: CMTA3_ARATH Calmodulin-binding transcription activator 3 with e-value of 7.6e-156 and BLAST sequence identity of 50.9
  misc_feature: SWISSPROT Homolog: CMTA3_ARATH Signal-responsive protein 1 Ethylene-induced calmodulin-binding protein a (EICBP.a) Ethylene-induced calmodulin-binding protein 1 (EICBP1)
  misc_feature: SWISSPROT Homolog: CMTA4_ARATH Calmodulin-binding transcription activator 4 with e-value of 4.3e-98 and BLAST sequence identity of 38.9
  misc_feature: SWISSPROT Homolog: CMTA4_ARATH Signal-responsive protein 5 Ethylene-induced calmodulin-binding protein d (EICBP.d) Ethylene-induced calmodulin-binding protein 4 (EICBP4)
  misc_feature: SWISSPROT Homolog: CMTA6_ARATH Calmodulin-binding transcription activator 6 with e-value of 1.6e-75 and BLAST sequence identity of 34.0
  misc_feature: SWISSPROT Homolog: CMTA6_ARATH Signal-responsive protein 3 Ethylene-induced calmodulin-binding protein e (EICBP.e) Ethylene-induced calmodulin-binding protein 5 (EICBP5)
  misc_feature 341615:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(985): Functional Homolog of  Ceres CLONE ID no. 531768 at SEQ ID NO. 3116 with e-value of 2.49E-220 and BLAST sequence identity of 68.3
MYNSHGTRTNFNRIKEYEEPIPYSQETKDMMPNSEMDTSVSSSFRSNGYQVPTGTTDSTSMNSALASEYEDAESGYNNQASSRFNSFLEVQRPAMEKMDTGTSIPYDHMLFSSGYQGKMPAVPVMEFISPAQVDTAKDTIGTEPASEPQKVFDLPSWEDVLENCSRGIESVPFQTTLLSQVDTVGVIPKQEDILEKFLANSFDKRQGMVGVIPKQEDILEKFLTNSFDRSQDIGSHLLDQEAWQTIEGGYSHRPKWSLDQKLHLDSDLTARFHDQQLDSGNFINTFEPFCAQENDNHIQNDLQIQPANSDHGMTLDEKSIYSTSMKQHILDDSRTEGLKKLDSFTRWMSKELEDVDQPHLQSSSGTYWISAESENVVDADNPSHGHLDTYTLGPSLSQDQLFSIIDFSPNWAYAGTEIKILVMGRFLKSREEAENFKWSIMFGEVEVPAETIADGILRCTTPSHKAGRVPFYVTCSNRVACSEVREFEYRLSHVQDITYNYINIATEDLHMRLAKLLSLSSAFPSKYDSSDVDEISQLSNKISSLLKEGNETWDQMLKLTSLEGFSSEKLKDQLLQKALKEQLHEWLLQKVAEGGKGPSVLDEGGQGVLHFAAALGYEWALEPTIVAGVSVNFRDVNGWTALHWAASYGRERTVASLIHLGAAPGALTDPTPKYPTGRTPADLASANGHKGISGFLAESALSAHLSSLNLEKQDGDAAESSGIPASLTVSDCNETPVKDADIPIGLSLKDSLAAVCNATQAAARIHQVFRVQSFQKKQLKEYGDDKFGMSHERALSLIAVKSQKAGQYDEPVHAAIRIQNKFRGWKGRKEFLIIRQRIVKIQAHVRGHQVRKNYRKIIWSVGILDKIILRWRRKGSGLRGFKSEALTEGSSMQVVSTKDDDDDFLKEGRKQTEERSQIALARVKSMHQHPEAREQYHRLRNVVAEIQETKAMYEWANNSEAMVEFDDLINLETLWDGDTFLPTDS

SEQ ID NO: 3074 - DNA, 3042 bp, Populus balsamifera subsp. trichocarpa
  misc_feature (1)..(3042): Ceres ANNOT ID no. 1447944
  misc_feature 341835:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atgggtcaaggattgacaaatccggaccggtatgatattaatagtctgtttgaagaagcacaaacgcggtggctgaaaccagcagaagtgctttttatattacaaaatcatgataagtatcagttcacaaaggaaccacttcaaaagccaaccagtggatctttgtttctatttaataagaggattcttaggttctttagaagagatggtcatagttggcgcaaaaagaaggatggaagaactgtcggggaagcacatgaaaggctcaaggttggaaatgttgagactataaattgttattatgcacatggtgagcaaaacccaaattttcagagacgcagctattggatgctggacccggcatttgagcacattgtgcttgttcattatagagagatttctgagggaaaaccctctcccggatctgctgcacagctatcacccggattctcttatagtcccagcagtaatactagtcaaactcaaggatcatcctctgcaattagtggtgtatatgaacaacatcagagtttgtccagtccagcatctgtagaagttaactcgggattagacatcaaggacaatggggtggatagtacagcagagcttactagttttgctaataacgaggttactcaatgtttgcgaaggctggaggagcagttgagtttgaacaaggacaacatcaaagaaatcggctcatttggtggtgatgagggagacacaaatgattcaaaaattctggaatacgtaaaccacatctccaaggaggatcaatctaagaatttacttcgtggatcacagtatattgttgattaccaatcttatggtggactttctggaaagcaactagagagaaacaatcttgcaccacttcaggatgcaggtggtaataagtgggtgggtcatgttagatctctggttcaaatcttacctgttgagagaaaagcatgcaaagattttggaagaggtgatagtggcgcataccagcaatcatattctcaatattatacagatggaagtaaagaagacctttcttggaatgaagtgttcgaatcctataacacttcatcaggcattgagtaccaggaaaagcccaagtcttctttaatgatggaaacagctcaagagcaagaaaattctctttggataaattttgctgaaaccaatgttggaaactcttctttgttgccgcctcaagaatttgaaggtttcgaaactcctacatattcttctgttatagaaacacatgaaaacaatgctgactgctatgcaatgctatatgaccaaggccatcttggaatacccattgaggcagattcaaatttgacagttgcacagcagcagaagtttagtatccgtgaaatatccccagaatggggttatgctacagaggctacaaaggtcatcattgttggatcgtttctctgtgacccatcggaatcatcatggacatgcatgtttggtgacactgaagttcctcttcaaatcattcaagaaggcgttattcgttgcgaggctcctccccaccagcccggaaaggtcactctctgcattacttctggcaatcgggagtcctgcagtgagatcagagactttgattaccgagctaaggatagtagctgtgctcactgtaacttttcccaaacagaagctactaagagtccagaagagctattgttacttgtcagatttgtgcagatgcttctgtctgatttctctttgcagagaggagacaacatagaaacgggaattcatctacttcaaaaattgaaggctgatgatgattcatggggttatatcatagaggctcttttagttggcagtggaacttcatccacgacagttgattggcttctgcaacaactactgaaagacaagctgcggcagtggctttcctccaagtctcaggaagaacatgaccatcctggatgttcattgtccaaaaaagagcaagggatcatacacatgcttgctgggttaggttttgagtgggccttaagcccaattctcagtcatggagtcagtataaatttccgtgacattaatgggtggaccgctctccactgggctgctcgttttggaagggaaaaaatggttgctgcccttttagcttctggtgcatcagctggggctgtgaccgatcctagttcaaaagatccaattggcaaaactgcagcatccattgctgccagtagtgggcacaagggacttgctggttatctttcagaagtggcactaactagccatctttcatctctcaaactcaaggaaagtgagctttctaaaggctctgctgagattgaagctgagagagctgtagatagcatctcaaaggagagctttgctgccaatgaagatcaggtttcgcttaaagataccttggctgctgtccggaatgcggctcaggcagctgcccgaatacaatctgctttccgtgcacattctttcagaaagcgacaagagatagaagcttctcttttagatgagtatggtatcagtgccggtgacattcaagggctctcagctatgtcaaagctggcctttcgtaactcccaggatattaattcggctgcattatccattcagaagaaatatcgaggatggaaaggtcgcaaggattttctggaacttagacagaaagttgtgaagatacaggctcatgtgagaggctatcgggttaggaagaactataaggtaatatgttgggctgttggaattctagataaggtagtgctgcggtggcgacgcaaaggaattggtttgcgaggtttccggaatgagacggagtccattgatgaaagggaagatgatgatattctcaagatgttccgcaaacagaaagtggatggaactattgatgaggctttctctcgtgtgctatcaatggttgattctccggatgcacgtcagcaatatcgtcggatgctgcaacgataccgccaagctaaggatgaacttggtaccagtgaagcagcagcgtctacttctctggctgatgcgaatgagatggaaaatgatgatctgtaccgtttccagtag

SEQ ID NO: 3075 - protein, 643 aa, Populus balsamifera subsp. trichocarpa
  misc_feature (1)..(643): Ceres ANNOT ID no. 1447944
  misc_feature (313)..(345): Pfam Name: Ank Pfam Description: Ankyrin repeat
  misc_feature (486)..(506): Pfam Name: IQ Pfam Description: IQ calmodulin-binding motif
  misc_feature: SWISSPROT Homolog: CMTA2_ARATH Calmodulin-binding transcription activator 2 with e-value of 5.4e-171 and BLAST sequence identity of 53.9
  misc_feature: SWISSPROT Homolog: CMTA2_ARATH Signal-responsive protein 4 Ethylene-induced calmodulin-binding protein c (EICBP.c) AtER66
  misc_feature: SWISSPROT Homolog: CMTA1_ARATH Calmodulin-binding transcription activator 1 with e-value of 3.3e-162 and BLAST sequence identity of 52.1
  misc_feature: SWISSPROT Homolog: CMTA1_ARATH Signal-responsive protein 2 Ethylene-induced calmodulin-binding protein b) (EICBP.b)
  misc_feature: SWISSPROT Homolog: CMTA3_ARATH Calmodulin-binding transcription activator 3 with e-value of 7.6e-156 and BLAST sequence identity of 50.9
  misc_feature: SWISSPROT Homolog: CMTA3_ARATH Signal-responsive protein 1 Ethylene-induced calmodulin-binding protein a (EICBP.a) Ethylene-induced calmodulin-binding protein 1 (EICBP1)
  misc_feature: SWISSPROT Homolog: CMTA4_ARATH Calmodulin-binding transcription activator 4 with e-value of 4.3e-98 and BLAST sequence identity of 38.9
  misc_feature: SWISSPROT Homolog: CMTA4_ARATH Signal-responsive protein 5 Ethylene-induced calmodulin-binding protein d (EICBP.d) Ethylene-induced calmodulin-binding protein 4 (EICBP4)
  misc_feature: SWISSPROT Homolog: CMTA6_ARATH Calmodulin-binding transcription activator 6 with e-value of 1.6e-75 and BLAST sequence identity of 34.0
  misc_feature: SWISSPROT Homolog: CMTA6_ARATH Signal-responsive protein 3 Ethylene-induced calmodulin-binding protein e (EICBP.e) Ethylene-induced calmodulin-binding protein 5 (EICBP5)
  misc_feature 342054:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(643): Functional Homolog of  Ceres CLONE ID no. 531768 at SEQ ID NO. 3116 with e-value of 8.49E-108 and BLAST sequence identity of 41.8
MMETAQEQENSLWINFAETNVGNSSLLPPQEFEGFETPTYSSVIETHENNADCYAMLYDQGHLGIPIEADSNLTVAQQQKFSIREISPEWGYATEATKVIIVGSFLCDPSESSWTCMFGDTEVPLQIIQEGVIRCEAPPHQPGKVTLCITSGNRESCSEIRDFDYRAKDSSCAHCNFSQTEATKSPEELLLLVRFVQMLLSDFSLQRGDNIETGIHLLQKLKADDDSWGYIIEALLVGSGTSSTTVDWLLQQLLKDKLRQWLSSKSQEEHDHPGCSLSKKEQGIIHMLAGLGFEWALSPILSHGVSINFRDINGWTALHWAARFGREKMVAALLASGASAGAVTDPSSKDPIGKTAASIAASSGHKGLAGYLSEVALTSHLSSLKLKESELSKGSAEIEAERAVDSISKESFAANEDQVSLKDTLAAVRNAAQAAARIQSAFRAHSFRKRQEIEASLLDEYGISAGDIQGLSAMSKLAFRNSQDINSAALSIQKKYRGWKGRKDFLELRQKVVKIQAHVRGYRVRKNYKVICWAVGILDKVVLRWRRKGIGLRGFRNETESIDEREDDDILKMFRKQKVDGTIDEAFSRVLSMVDSPDARQQYRRMLQRYRQAKDELGTSEAAASTSLADANEMENDDLYRFQ

SEQ ID NO: 3076 - protein, 340 aa, Glycine max
  misc_feature (1)..(340): Ceres CLONE ID no. 533314
  misc_feature (1)..(340): Also Known As Ceres CDNA ID no. 23699071
  misc_feature (1)..(340): Also Known As Ceres GEMINI ID 540F5
  misc_feature 342225:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MGNISSGGNPRRRHSGASRRSHPPPPPPVTPQPEIAANPFVYHGAAAPYPNPPLHYPQYHYPGYYPPVPPMPYHPHQHQHHHRHMDPAWIQGHFPSGPMMPNPAPFVEHQKAVTIKNDVNIRKETLKLEPDVENSGHFLVSFSFDATVSGSITIYFFAKEGEGCILTPMKENQLAPVSVHFEQGLGQKFRQAAGTGIDFSVFEESELLKVGEKDVYPLAVKADASPGNHDESDRSPTSSNTNSQITQTMFEKEKGEFRVKVVKQILWVNGMRYELQEIYGIRNSTENDQGKCVICLSEPRDTIVLPCRHMCMCSGCAKDSRFQTDRCSICRQPVERLLEI

SEQ ID NO: 3077 - DNA, 1098 bp, Populus balsamifera subsp. trichocarpa; identical to SEQ ID NO: 1792
  misc_feature (1)..(1098): Ceres ANNOT ID no. 1528846
  misc_feature 342325:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis

SEQ ID NO: 3078 - protein, 365 aa, Populus balsamifera subsp. trichocarpa; identical to SEQ ID NO: 1793
  misc_feature (1)..(365): Ceres ANNOT ID no. 1528846
  misc_feature (309)..(347): Pfam Name: zf-C3HC4 Pfam Description: Zinc finger, C3HC4 type (RING finger)
  misc_feature: SWISSPROT Homolog: SMR3A_HUMAN Submaxillary gland androgen-regulated protein 3 homolog A precursor (Proline-rich protein 5) (Proline-rich protein PBI) with e-value of 4.2e-06 and BLAST sequence identity of 34.7
  misc_feature 342411:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(365): Functional Homolog of  Ceres CLONE ID no. 533314 at SEQ ID NO. 3123 with e-value of 3.79E-112 and BLAST sequence identity of 68.9

SEQ ID NO: 3079 - DNA, 1296 bp, Populus balsamifera subsp. trichocarpa; identical to SEQ ID NO: 1794
  misc_feature (1)..(1296): Ceres ANNOT ID no. 1538329
  misc_feature 342522:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis

SEQ ID NO: 3080 - protein, 431 aa, Populus balsamifera subsp. trichocarpa; identical to SEQ ID NO: 1795
  misc_feature (1)..(431): Ceres ANNOT ID no. 1538329
  misc_feature (375)..(413): Pfam Name: zf-C3HC4 Pfam Description: Zinc finger, C3HC4 type (RING finger)
  misc_feature: SWISSPROT Homolog: SMR3A_HUMAN Submaxillary gland androgen-regulated protein 3 homolog A precursor (Proline-rich protein 5) (Proline-rich protein PBI) with e-value of 4.2e-06 and BLAST sequence identity of 34.7
  misc_feature 342614:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(431): Functional Homolog of  Ceres CLONE ID no. 533314 at SEQ ID NO. 3123 with e-value of 1.70E-102 and BLAST sequence identity of 68.9

SEQ ID NO: 3081 - protein, 365 aa, Glycine max
  misc_feature (1)..(365): Ceres CLONE ID no. 533932
  misc_feature (23)..(305): Pfam Name: RmlD_sub_bind Pfam Description: RmlD substrate binding domain
MENTEGSRSATNGVLPLARKVALITGITGQDGSYLTEFLLDKGYEVHGLIRRSSNFNTQRIDHIYVDPHNAHKARMKLHYADLSDASSLRRWLDTILPDEVYNLAAQSHVAVSFEIPDYTADVVATGALRLLEAVRSHIAASGRSHIRYYQAGSSEMFGATPPPQSETTPFHPRSPYAASKCAAHWYTVNYREAYSLFACNGILFNHESPRRGENFVTRKITRAVGRIKVGLQSKLFLGNLQASRDWGFAGDYVEAMWLMLQQEKPDDYVVATEESHTVEEFLEVAFGYVGLNWRDHVVIDKRYFRPSEVDNLKGDASKAKKVLGWKPKVGFEQLVKMMVDRDIEMAKKEKVLVDAGYIDAQQQP

SEQ ID NO: 3082 - DNA, 1107 bp, Populus balsamifera subsp. trichocarpa
  misc_feature (1)..(1107): Ceres ANNOT ID no. 1457369
  misc_feature 342827:<222: Transcription Factor
atggcatccgaatcaaaccaacccggatccgactccactattcctgtcaacggcgaaatcacacccaaaatcgccctgatcaccggtataaccggccaagatggttcttatcttaccgaattcctcctgaacaaaggctatgaagttcatggcttgatccgtcggtcatccaatttcaatacgcagcggattaaccatatttatatagatccacacaatgctcataaggcccgaatgaaactccactatgcagatctaagcgacgcgtcgtctctccgtcgttggctcgacaccatcaaccccgacgaagtctataacctggcggcccaatcacacgtggctgtctctttcgaaatccctgattacacggcggatgtcgtcgccaccggagccctccgccttcttgaggcggtgagatctcatattgccgcgacagggcggagccatatcaagtattaccaagcgggatcttcggagatgtttggatctacgccgcctccgcaatcagagaccaccccgtttcatccaagatccccatacgcggcgtcaaaatgcgcggcgcattggtatactgtcaattacagggaagcttatgggttgtatgcttgcaatgggattcttttcaaccatgaatctccacgtaggggagagaattttgtgacccgaaagattacgagagctgttgggagaattaaggtagggttgcagaataagctgtttttagggaatttgcaggcgtcgagggattggggtttcgcaggggattacgtggaagcaatgtggatgatgttgcagcaggaaaagcctgatgattacgtggttgcgacggaggagtcgcatacggtggaggagtttttggatgtggcatttggatatgttggattgaattggaaggatcatgttgtgattgataagaggtattttaggcctgctgaagtggataatttgaaaggggattcgagtaagacgaggaaagtgcttggttggaagcctaaagttgggtttgagcaattggtgaagatgatggttgatgaagatattgatttagccaagagggagaaggttcttgttgatgctggctatatggatgcccagcagcaaccttga

SEQ ID NO: 3083 - protein, 368 aa, Populus balsamifera subsp. trichocarpa
  misc_feature (1)..(368): Ceres ANNOT ID no. 1457369
  misc_feature (26)..(109): Pfam Name: RmlD_sub_bind Pfam Description: RmlD substrate binding domain
  misc_feature: SWISSPROT Homolog: GMD1_ARATH GDP-mannose 4,6 dehydratase 1 (EC 4.2.1.47) (GDP-D-mannose dehydratase 1) (GMD 1) with e-value of 4.2e-171 and BLAST sequence identity of 88.8
  misc_feature: SWISSPROT Homolog: GMD2_ARATH GDP-mannose 4,6 dehydratase 2 (EC 4.2.1.47) (GDP-D-mannose dehydratase 2) (GMD 2) with e-value of 4.8e-170 and BLAST sequence identity of 84.4
  misc_feature: SWISSPROT Homolog: GM4D_ECO57 GDP-mannose 4,6-dehydratase (EC 4.2.1.47) (GDP-D-mannose dehydratase) with e-value of 1.3e-105 and BLAST sequence identity of 61.4
  misc_feature: SWISSPROT Homolog: GM4D_ECOL6 GDP-mannose 4,6-dehydratase (EC 4.2.1.47) (GDP-D-mannose dehydratase) with e-value of 1.3e-105 and BLAST sequence identity of 61.4
  misc_feature: SWISSPROT Homolog: GM4D_ECOLI GDP-mannose 4,6-dehydratase (EC 4.2.1.47) (GDP-D-mannose dehydratase) with e-value of 1.3e-105 and BLAST sequence identity of 61.4
  misc_feature 342929:<222: Transcription Factor
  misc_feature (1)..(368): Functional Homolog of  Ceres CLONE ID no. 533932 at SEQ ID NO. 3128 with e-value of 3.60E-180 and BLAST sequence identity of 91.1
MASESNQPGSDSTIPVNGEITPKIALITGITGQDGSYLTEFLLNKGYEVHGLIRRSSNFNTQRINHIYIDPHNAHKARMKLHYADLSDASSLRRWLDTINPDEVYNLAAQSHVAVSFEIPDYTADVVATGALRLLEAVRSHIAATGRSHIKYYQAGSSEMFGSTPPPQSETTPFHPRSPYAASKCAAHWYTVNYREAYGLYACNGILFNHESPRRGENFVTRKITRAVGRIKVGLQNKLFLGNLQASRDWGFAGDYVEAMWMMLQQEKPDDYVVATEESHTVEEFLDVAFGYVGLNWKDHVVIDKRYFRPAEVDNLKGDSSKTRKVLGWKPKVGFEQLVKMMVDEDIDLAKREKVLVDAGYMDAQQQP

SEQ ID NO: 3084 - DNA, 1107 bp, Populus balsamifera subsp. trichocarpa
  misc_feature (1)..(1107): Ceres ANNOT ID no. 1487745
  misc_feature 343027:<222: Transcription Factor
atggcatccgaatcagaccaaccccgatccgcctccgccactcccgttaacggcgaaatcaaacccaaaatcgccctagtcaccggtataaccggtcaggatggttcatatctcactgaattcctcctcaacaaaggctatgaagttcatgggctgattcgtaggtcctccaatttcaacacgcagcggattaaccatatttatatagatccacacaatgtccataaagcccgaatgaagctccattatgcagatctctctgacgcgtcgtctctccgtcgttggctcgacactatctaccccgacgaagtctacaaccttgcagcccaatcccatgtggcagtctctttcgaagtccctgattacacggcggatgtcgtcgccaccggaactgtccgccttcttgaggcggtgaggtctcatattgccgcgacagggcgaagccatgtcaagtactatcaagcgggatcttcggaaatgtttgggtctacgccgccaccgcaatcagaaaccaccccatttcatccaagatcaccatatgccgcgtcaaaatgcgcggcgcattggtacactgttaattacagggaggcttatgggctgtttgcttgcaatgggattttattcaatcacgaatctcctcgtcgcggggagaattttgtaacccgaaagattacgagggctcttgggagaattaaggtggggttgcagagtaagttgtatttagggaatttgcaggcctcgagggattggggtttcgcaggggattacgtggaggcaatgtggatgatgttgcagcaggaaaagcctgatgattatgtggttgcgacagaggaatcgcatacggtggaggagtttttggaagtggcatttgggtatgttgggatgaattggaaggatcatgttgtaattgataagaagtattttaggcctgctgaagtggataatttgaaaggggattcgagcaaggcgaggaaagtgcttggctggaagcctaaagttgggtttgagcaattggtgaggatgatggtcgatgaagatgttgatttagctaagagggagaaggttcttgttgatgctggttacatcaatgctcagcaacagccttga

SEQ ID NO: 3085 - protein, 368 aa, Populus balsamifera subsp. trichocarpa
  misc_feature (1)..(368): Ceres ANNOT ID no. 1487745
  misc_feature (23)..(308): Pfam Name: RmlD_sub_bind Pfam Description: RmlD substrate binding domain
  misc_feature: SWISSPROT Homolog: GMD1_ARATH GDP-mannose 4,6 dehydratase 1 (EC 4.2.1.47) (GDP-D-mannose dehydratase 1) (GMD 1) with e-value of 4.2e-171 and BLAST sequence identity of 88.8
  misc_feature: SWISSPROT Homolog: GMD2_ARATH GDP-mannose 4,6 dehydratase 2 (EC 4.2.1.47) (GDP-D-mannose dehydratase 2) (GMD 2) with e-value of 4.8e-170 and BLAST sequence identity of 84.4
  misc_feature: SWISSPROT Homolog: GM4D_ECO57 GDP-mannose 4,6-dehydratase (EC 4.2.1.47) (GDP-D-mannose dehydratase) with e-value of 1.3e-105 and BLAST sequence identity of 61.4
  misc_feature: SWISSPROT Homolog: GM4D_ECOL6 GDP-mannose 4,6-dehydratase (EC 4.2.1.47) (GDP-D-mannose dehydratase) with e-value of 1.3e-105 and BLAST sequence identity of 61.4
  misc_feature: SWISSPROT Homolog: GM4D_ECOLI GDP-mannose 4,6-dehydratase (EC 4.2.1.47) (GDP-D-mannose dehydratase) with e-value of 1.3e-105 and BLAST sequence identity of 61.4
  misc_feature 343129:<222: Transcription Factor
  misc_feature (1)..(368): Functional Homolog of  Ceres CLONE ID no. 533932 at SEQ ID NO. 3128 with e-value of 2.30E-178 and BLAST sequence identity of 89.9
MASESDQPRSASATPVNGEIKPKIALVTGITGQDGSYLTEFLLNKGYEVHGLIRRSSNFNTQRINHIYIDPHNVHKARMKLHYADLSDASSLRRWLDTIYPDEVYNLAAQSHVAVSFEVPDYTADVVATGTVRLLEAVRSHIAATGRSHVKYYQAGSSEMFGSTPPPQSETTPFHPRSPYAASKCAAHWYTVNYREAYGLFACNGILFNHESPRRGENFVTRKITRALGRIKVGLQSKLYLGNLQASRDWGFAGDYVEAMWMMLQQEKPDDYVVATEESHTVEEFLEVAFGYVGMNWKDHVVIDKKYFRPAEVDNLKGDSSKARKVLGWKPKVGFEQLVRMMVDEDVDLAKREKVLVDAGYINAQQQP

SEQ ID NO: 3086 - protein, 225 aa, Glycine max
  misc_feature (1)..(225): Ceres CLONE ID no. 534282
  misc_feature (1)..(225): Also Known As Ceres CDNA ID no. 23698626
  misc_feature (1)..(225): Also Known As Ceres GEMINI ID 540G4
  misc_feature (150)..(212): Pfam Name: bZIP_1 Pfam Description: bZIP transcription factor
  misc_feature 343247:<222: Transcription Factor
  misc_feature: Phenotype: Activates expression of the gene endogenous to the AtBBE2 (SEQ ID NO 4151) regalutory region Useful for modulating Alkaloid Biosynthesis
MNLDELLQNVWTAEASKSSVVVGVESENMSSSSSSLQRQASLTLARALSGKTVDDVWREIQQGQKKKYGEDVRSQEGEMTLGETTLEDFLVQAGLFAEASISPAVGLDAMDSLATQGFQQKTGLLSSSPSIGSLSDTRLGRKRDASDAYEKTLERRLRRKIKNRESAARSRARKQAYHNELVGKVSRLEEENVKLKKEKEFEERLLPDPLPERKYQLRRHNSAFF

SEQ ID NO: 3087 - DNA, 831 bp, Populus balsamifera subsp. trichocarpa
  misc_feature (1)..(831): Ceres ANNOT ID no. 1515278
  misc_feature 343317:<222: Transcription Factor
  misc_feature: Phenotype: Activates expression of the gene endogenous to the AtBBE2 (SEQ ID NO 4151) regalutory region Useful for modulating Alkaloid Biosynthesis
atgggtgttcaaacaatggcatctcaaagaaatggccagcagtctcatctacagccgtatcggttgacgaggcaaaactcgtggtataacctcactctcaatgaagttgaaaaccaattaggaaatttagggaagcccttgtgtagcatgaaccttgacgagcttcttaaaaatgtatggagcactgaagctcatcaatccgtgggaatggatagtgaaagtacctcaatgtcttctctccaacatcaggctagtctcacattggccagggcattgagtgggaagacagtggatcaagtctggaaagagattcaacaagggcaggagaagaggtttggtgaggagatgaaagttcaggaaagagagcagactcttggtgaaatgactttggaggatttcttggtacaagcaggactttttgccaaagcaactataagcccttctttggatttagttactgttgatgcagtgaccccacaaagtttttcacagaaaatggtcctttcctcatccccgtcaacaagcacattatctgatactacgacatcaggacggaaaagggataccccagatgcatttgagaagagtattgagaggaagctcaagagaaaaatcaagaacagggaatctgctgcccgttcacgagctagaaaacaggcctatcataacgagctggtgagcaagatttcacatttaggggaggagaatataaagctcaagaaagagaaggaaacctggaagtggattaaggaatttgagaagaagtttccaattgaaccatcagctgaacaaaaatatcagcttagaagaacaagttctacttctttctga

SEQ ID NO: 3088 - protein, 227 aa, Populus balsamifera subsp. trichocarpa
  misc_feature (1)..(227): Ceres ANNOT ID no. 1515278
  misc_feature (146)..(193): Pfam Name: bZIP_2 Pfam Description: Basic region leucine zipper
  misc_feature: SWISSPROT Homolog: GBF4_ARATH G-box-binding factor 4 (AtbZIP40) with e-value of 1.9e-17 and BLAST sequence identity of 40.1
  misc_feature: SWISSPROT Homolog: OCS1_MAIZE Ocs element-binding factor 1 (OCSBF-1) with e-value of 7.6e-07 and BLAST sequence identity of 42.4
  misc_feature 343392:<222: Transcription Factor
  misc_feature: Phenotype: Activates expression of the gene endogenous to the AtBBE2 (SEQ ID NO 4151) regalutory region Useful for modulating Alkaloid Biosynthesis
  misc_feature (1)..(227): Functional Homolog of  Ceres CLONE ID no. 534282 at SEQ ID NO. 3133 with e-value of 1.20E-69 and BLAST sequence identity of 68.9
MNLDELLKNVWSTEAHQSVGMDSESTSMSSLQHQASLTLARALSGKTVDQVWKEIQQGQEKRFGEEMKVQEREQTLGEMTLEDFLVQAGLFAKATISPSLDLVTVDAVTPQSFSQKMVLSSSPSTSTLSDTTTSGRKRDTPDAFEKSIERKLKRKIKNRESAARSRARKQAYHNELVSKISHLGEENIKLKKEKETWKWIKEFEKKFPIEPSAEQKYQLRRTSSTSF

SEQ ID NO: 3089 - DNA, 807 bp, Populus balsamifera subsp. trichocarpa
  misc_feature (1)..(807): Ceres ANNOT ID no. 1439721
  misc_feature 343470:<222: Transcription Factor
  misc_feature: Phenotype: Activates expression of the gene endogenous to the AtBBE2 (SEQ ID NO 4151) regalutory region Useful for modulating Alkaloid Biosynthesis
atggcatcgcaaagcaatggccaacaatctcatatgcagccgtgtcaattgatgaggcaaacctcgtggtataacctcactctcaacgaagttgaaaaccaaatgggaaatttagggaagcccttgtgtagcatgaaccttgatgagcttcttaaaaatgtatggagcaccgaagcaaatcaatcgatgggaatggatagtgaaagtacagcaacatcttctcttcaacgtcaggctagtttcacattggctagggcattgagtgggaagacagtggctcaagtctggaaagagattcaagaagggcagaagaagaggtttggtcaggaaatgaaagttcaggaaagagagcagacacttggcgaaacaactttggaggattttttggtacaagcaggactttttaccgaagcaactataagcccttctttggatttggttactgttgctgcagtgactccgcaatgttttccacagaatatggtcctctcctcatccccttcaactggcacgttatctgactctacgacatcgggatggaacagggatgcccctgagaagagtactgagaggaggctcaagagaaagatcaagaacagggaatctgctgcccgttctcgagctagaaaacaggcctatcataatgagttggtgagcaaggtttcacgtttagaggaggagaatataaagctcaagaaagagaaggtaggaaggatatttcattttaatcaagctgttttctatttctttttccgtgaacacttgtcaaccactccaagaggaaagatgaaagaaatggccaaatga

SEQ ID NO: 3090 - protein, 251 aa, Populus balsamifera subsp. trichocarpa
  misc_feature (1)..(251): Ceres ANNOT ID no. 1439721
  misc_feature (170)..(217): Pfam Name: bZIP_1 Pfam Description: bZIP transcription factor
  misc_feature: SWISSPROT Homolog: GBF4_ARATH G-box-binding factor 4 (AtbZIP40) with e-value of 1.9e-17 and BLAST sequence identity of 40.1
  misc_feature: SWISSPROT Homolog: OCS1_MAIZE Ocs element-binding factor 1 (OCSBF-1) with e-value of 7.6e-07 and BLAST sequence identity of 42.4
  misc_feature 343545:<222: Transcription Factor
  misc_feature: Phenotype: Activates expression of the gene endogenous to the AtBBE2 (SEQ ID NO 4151) regalutory region Useful for modulating Alkaloid Biosynthesis
  misc_feature (1)..(251): Functional Homolog of  Ceres CLONE ID no. 534282 at SEQ ID NO. 3133 with e-value of 4.59E-61 and BLAST sequence identity of 71.0
MRQTSWYNLTLNEVENQMGNLGKPLCSMNLDELLKNVWSTEANQSMGMDSESTATSSLQRQASFTLARALSGKTVAQVWKEIQEGQKKRFGQEMKVQEREQTLGETTLEDFLVQAGLFTEATISPSLDLVTVAAVTPQCFPQNMVLSSSPSTGTLSDSTTSGWNRDAPEKSTERRLKRKIKNRESAARSRARKQAYHNELVSKVSRLEEENIKLKKEKVGRIFHFNQAVFYFFFREHLSTTPRGKMKEMAK

SEQ ID NO: 3091 - DNA, 843 bp, Populus balsamifera subsp. trichocarpa
  misc_feature (1)..(843): Ceres ANNOT ID no. 1474632
  misc_feature 343626:<222: Transcription Factor
  misc_feature: Phenotype: Activates expression of the gene endogenous to the AtBBE2 (SEQ ID NO 4151) regalutory region Useful for modulating Alkaloid Biosynthesis
atgggatctcaagttggttcatttgaagaagaaaatccagagtcattgattgggcaaggctcattgtacagcctgacacttgatgaggttcaaaaccagttggggaatttggggaaaccattggggagcatgaatcttgatgaacttctcaagagtgtggacactgagggttcttggtcctcacctgtgcatagacaagggagcctaacattgtcaaggagcctgagcaagaagactgttgaggaggtatggagaaatatacaacaggagaataagaaagatgctgaaaatcaagagagaaatgctccttttggtgagatgactcttgaggacttcttggttaaagcaggcgtggttacagagtcggctccgcagcaacaacaggaaagtgctcagtggatgcaattccagaaccccacagtgcaggagccaccatatcaaaacaacatgatgacaggctttatgcaaggacaccctgttcagcaatcccttcctgttgcggatgcagcatatccgaattcccaaatgaacttatctccatcttctttgatgggtactttgtcggacacgcagactcctgggaggaaaagggttgcttcgggagatgtagctgagaagactgttgaaaggaagcagaagaggatgattaagaaccgggaatctgctgcccgctcgagggcaaggaggcaggcttatacaaacgaactggagatcaaggtatatcatctagaagaggagaatgaaagacttagaagacagaaggaggtggagaaggttttgccatgtgcacctcctccggagcccaagtctcagctgcgcagaacaagctcagccagtttctga

SEQ ID NO: 3092 - protein, 237 aa, Populus balsamifera subsp. trichocarpa
  misc_feature (1)..(237): Ceres ANNOT ID no. 1474632
  misc_feature (162)..(218): Pfam Name: bZIP_1 Pfam Description: bZIP transcription factor
  misc_feature: SWISSPROT Homolog: GBF4_ARATH G-box-binding factor 4 (AtbZIP40) with e-value of 1.9e-17 and BLAST sequence identity of 40.1
  misc_feature: SWISSPROT Homolog: OCS1_MAIZE Ocs element-binding factor 1 (OCSBF-1) with e-value of 7.6e-07 and BLAST sequence identity of 42.4
  misc_feature 343703:<222: Transcription Factor
  misc_feature: Phenotype: Activates expression of the gene endogenous to the AtBBE2 (SEQ ID NO 4151) regalutory region Useful for modulating Alkaloid Biosynthesis
  misc_feature (1)..(237): Functional Homolog of  Ceres CLONE ID no. 534282 at SEQ ID NO. 3133 with e-value of 3.00E-34 and BLAST sequence identity of 57.5
MNLDELLKSVDTEGSWSSPVHRQGSLTLSRSLSKKTVEEVWRNIQQENKKDAENQERNAPFGEMTLEDFLVKAGVVTESAPQQQQESAQWMQFQNPTVQEPPYQNNMMTGFMQGHPVQQSLPVADAAYPNSQMNLSPSSLMGTLSDTQTPGRKRVASGDVAEKTVERKQKRMIKNRESAARSRARRQAYTNELEIKVYHLEEENERLRRQKEVEKVLPCAPPPEPKSQLRRTSSASF

SEQ ID NO: 3093 - protein, 494 aa, Glycine max
  misc_feature (1)..(494): Ceres CLONE ID no. 534311
  misc_feature (1)..(494): Also Known As Ceres CDNA ID no. 23697027
  misc_feature (1)..(494): Also Known As Ceres GEMINI ID 552G2
  misc_feature 343795:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
MTRLTRDFGDTMQRDAVPAVSSDVVFASSRFPNYRIGANNQIIETKDDPKVLSMKEVVARETAQLLEQHNRLSVRDLASKFEKGLAAAAKLSEEARLREAASLEKHVLLKKLRDALESLKGRVAGRNKDDVEEAIAMVEALAVQLTQREGELIQEKAEVKKLANFLKQASEDAKKLVDEERAFARAEIEDARAAVQRVEEALQEHERMSQASGKQDLEQLMREVQEARRIKMLHQPSKVMDMEHELRALRSQLAEKTRQYLRLQKELTRTKKGGENVPHLYELEGNETLGSYLQIQPCSDNAPEVSKCSIQWYRVSSDGAKKELISGATKSVYAPEPFDVGRILQVDIISESEHVTLSTAGPIDPAAGLGTYVEALVRKHDTEFNVVVTQMNGSHHPTESIHVLHVGKMRIKLCKGKTTIAKEYYSSSMQLCGVRGGGNAAAQALFWQPKQGHSFVLAFESERERNAAIMLARRFAFDCNIMLAGPDDRAPLGT

SEQ ID NO: 3094 - DNA, 1485 bp, Populus balsamifera subsp. trichocarpa
  misc_feature (1)..(1485): Ceres ANNOT ID no. 1440272
  misc_feature 343928:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
atgactagggtaacccgtgattttggagatactatgcaaaaagatgctgtcctagctgtatcagcagatgttgcatttgcttctagtcggtttcctaattacaaaattggagctaccaatcagattctggatgcaaaagatgaccccaaagtattgtccatgaaggaggttgtggcacgcgagactgctttgcttttggaacagcagaaacgcctctctgtccgtgaccttgccagtaaatttgaaaagggattggctgctgctgctaagttgtcagaagaggctaggctcagagaggctgcttcattagagaaacatgtcctattgaagaagcttagggatgcgctagaatcattaaaaggacgtgtggcaggtagaaacaaggatgatgtggaggaagctattgccatggtggaagctttagcggttcagctgactcagagggaaggagagttgattcaagaaaaagcagaagtaaagaagctagcaaattttcttaagcaggcttcagaagatgccaagaaacttgtcgatgaggaaagagcttatgctcgtgctgaaattgagagtgccagagcgacagttcagagggtggaagaagctcttcaagaacatgaacgaatgtctcgagctttggggaagcaggacttggaagaattaatgaaggaggttcaagaggctagaaggatcaaaatgctgcatcagccaagcaaggttatggacatggaacatgagctacgagcattgaggatgcaacttgctgagaagtctaaatgttctctgcagcttcagaaggagcttgcgaggagcaggagaggcgggcagagcatgttccatttatttgaattagatggctctgaagcattaggttcatgtttgcggatcaatccttgctctgaaaatgctccagaactttctgaatgttccattcaatggtttcgtctatcatctgaagatgtcaaaaaggcgcttatatcaggagcaaccaaaccagtgtatgctccagagccttttgatgttgggcgagtcctgcaagctgaaataatttctgatggccaacaattcactttgaccactacttgtgccattgatcctgctgctggtctcggaagctatgtagaggcacttgtgcgaaaacatgatgttgaattcaatgtagttgttacccagatgaatgggttggatcatacatcagaatctattcatgtgcttcacgtcggaaagatgaggatgaagcttcgcaaagggaagtcgacaattgctaaagagtactactctacttcaatgcagctgtgtggagttagaggaggtgggaacgctgcagctcaagcattgttttggcaagcaaagaaaggggtttcctttgtattagcatttgaatcagcaagagagaggaatgcagccatcatgcttgcaaggaggtttgcttttgattgcaatattatgctcgctgggccagatgacagagctcctttaggaagttaa

SEQ ID NO: 3095 - protein, 494 aa, Populus balsamifera subsp. trichocarpa
  misc_feature (1)..(494): Ceres ANNOT ID no. 1440272
  misc_feature: SWISSPROT Homolog: AMOL2_MOUSE Angiomotin-like protein 2 with e-value of 6.0e-08 and BLAST sequence identity of 28.0
  misc_feature: SWISSPROT Homolog: AMOL2_HUMAN Angiomotin-like protein 2 (Leman coiled-coil protein) (LCCP) with e-value of 1.0e-07 and BLAST sequence identity of 28.0
  misc_feature: SWISSPROT Homolog: MAD1_ASHGO Spindle assembly checkpoint component MAD1 (Mitotic arrest deficient protein 1) with e-value of 1.3e-07 and BLAST sequence identity of 24.1
  misc_feature: SWISSPROT Homolog: M5_STRP5 M protein, serotype 5 precursor with e-value of 8.2e-07 and BLAST sequence identity of 24.6
  misc_feature: SWISSPROT Homolog: CENPE_HUMAN Centromeric protein E (CENP-E protein) with e-value of 9.2e-07 and BLAST sequence identity of 24.0
  misc_feature 344056:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(494): Functional Homolog of  Ceres CLONE ID no. 534311 at SEQ ID NO. 3140 with e-value of 1.60E-216 and BLAST sequence identity of 84.2
MTRVTRDFGDTMQKDAVLAVSADVAFASSRFPNYKIGATNQILDAKDDPKVLSMKEVVARETALLLEQQKRLSVRDLASKFEKGLAAAAKLSEEARLREAASLEKHVLLKKLRDALESLKGRVAGRNKDDVEEAIAMVEALAVQLTQREGELIQEKAEVKKLANFLKQASEDAKKLVDEERAYARAEIESARATVQRVEEALQEHERMSRALGKQDLEELMKEVQEARRIKMLHQPSKVMDMEHELRALRMQLAEKSKCSLQLQKELARSRRGGQSMFHLFELDGSEALGSCLRINPCSENAPELSECSIQWFRLSSEDVKKALISGATKPVYAPEPFDVGRVLQAEIISDGQQFTLTTTCAIDPAAGLGSYVEALVRKHDVEFNVVVTQMNGLDHTSESIHVLHVGKMRMKLRKGKSTIAKEYYSTSMQLCGVRGGGNAAAQALFWQAKKGVSFVLAFESARERNAAIMLARRFAFDCNIMLAGPDDRAPLGS

SEQ ID NO: 3096 - DNA, 1788 bp, Populus balsamifera subsp. trichocarpa
  misc_feature (1)..(1788): Ceres ANNOT ID no. 1474707
  misc_feature 344197:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
atgacgaagataagtcccgaaattgaggaaaatatgaagggagaagtagtttttcctgtttcagctgatgtgagctttgcttctgatgggtttccaaaatataaattaggacctgataatcagattttggaagagccaaaagaggacaacaagggtccatctttaaaggaggttgtcgaacaggaaaccacacagctgtcagatcaacacaagcgactctcagttcgtgaccttgcttgtaaattcgacaagaacttgactgctgcagcaaagttggccgaagaggcaaagcttagagaggtggcttctttggaaggacatgttcttttaaagaagcttagagatgccttggaatctttaagaggtcgtatggcagggcgaaacaaggaagatgtggagaaagccatctctatggtggaggcattagcagttaaactgactcaaaaagaaggagaattaattcaagaaaaatttgaagtgaaaaagttggctaactttcttaaacaggcttctgaagatgctaaaaagttagtgaaccaagagaaatcttttgcttgtgctgaaattgaaagtgccagagcagttgtgcaaaggattggagaggccctggatgaagaagaaagggacgctcaaaattcaaaaaaccaggctgctgatgtggaggaactagtcgaggaggttcaagaggctagacgaattaaattattgcatcagccaagcaaggttatagacatggagcatgagcttcgtgctctacgaaatcaaattcgggagaaatctctagtttcagttaaacttcagaaagagctggcaaagagcaagagagctgagcaaaataaatctgctccatatgtcctagatggttctgaaactctaggttcatctctacaactcaagcctcgttcagatagttctccacccctttccaagtgttcagttcagtggtaccgtgtatcatctgaagacagccaaaatgaagttatttcaggtgccaataaaactttttatgctcctgaaccctttgatgttggccgagtattgcaagtagacattgtttcaaatggccagaaagtcatcgtgacaacttccggtcccattgaacctggtcggtctgcaggattggcaacccgtgtagagaatcttttgagaaaatctagctgtgaattcagcgtggttatttcccagatgaatggacaagatcatccatcacattctgttcatgtgtttaatgtgggaaagatgaggctaaagctttgcagagggtggattacaaaggctagagaaatttattcagcatcaatgcagttgtgtggagttagaaccaatgccaacactgctgcaaggtccttgttttggcaaccaaggaagggcctttcatttgtattaacatttgaatcagagcgagacaggaatgcagcgataatgcttgcccggaaatacgcttatgattgcaacggggtacctttttattctttctattttacatgccaacacaatcttttcagcattaaaagttcagtcccctttcctgatatttttgctggaaaacgctcttgtccctcacgcttagcttgcaattacaggtcatacttgcaggaccagaagatcaagtatagaaggaaatgccaacatgaaaatcaagtagaagagaaggaaaaagaaaagaaaacaaaggctacacgcgccactccagctactattgagctaaacgcactgcttattcgtggaggagacgttgagatgcttgatcatcctgcacccgggataaccccgcgtaaagaaaggtga

SEQ ID NO: 3097 - protein, 595 aa, Populus balsamifera subsp. trichocarpa
  misc_feature (1)..(595): Ceres ANNOT ID no. 1474707
  misc_feature: SWISSPROT Homolog: AMOL2_MOUSE Angiomotin-like protein 2 with e-value of 6.0e-08 and BLAST sequence identity of 28.0
  misc_feature: SWISSPROT Homolog: AMOL2_HUMAN Angiomotin-like protein 2 (Leman coiled-coil protein) (LCCP) with e-value of 1.0e-07 and BLAST sequence identity of 28.0
  misc_feature: SWISSPROT Homolog: MAD1_ASHGO Spindle assembly checkpoint component MAD1 (Mitotic arrest deficient protein 1) with e-value of 1.3e-07 and BLAST sequence identity of 24.1
  misc_feature: SWISSPROT Homolog: M5_STRP5 M protein, serotype 5 precursor with e-value of 8.2e-07 and BLAST sequence identity of 24.6
  misc_feature: SWISSPROT Homolog: CENPE_HUMAN Centromeric protein E (CENP-E protein) with e-value of 9.2e-07 and BLAST sequence identity of 24.0
  misc_feature 344335:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(595): Functional Homolog of  Ceres CLONE ID no. 534311 at SEQ ID NO. 3140 with e-value of 6.00E-162 and BLAST sequence identity of 65.2
MTKISPEIEENMKGEVVFPVSADVSFASDGFPKYKLGPDNQILEEPKEDNKGPSLKEVVEQETTQLSDQHKRLSVRDLACKFDKNLTAAAKLAEEAKLREVASLEGHVLLKKLRDALESLRGRMAGRNKEDVEKAISMVEALAVKLTQKEGELIQEKFEVKKLANFLKQASEDAKKLVNQEKSFACAEIESARAVVQRIGEALDEEERDAQNSKNQAADVEELVEEVQEARRIKLLHQPSKVIDMEHELRALRNQIREKSLVSVKLQKELAKSKRAEQNKSAPYVLDGSETLGSSLQLKPRSDSSPPLSKCSVQWYRVSSEDSQNEVISGANKTFYAPEPFDVGRVLQVDIVSNGQKVIVTTSGPIEPGRSAGLATRVENLLRKSSCEFSVVISQMNGQDHPSHSVHVFNVGKMRLKLCRGWITKAREIYSASMQLCGVRTNANTAARSLFWQPRKGLSFVLTFESERDRNAAIMLARKYAYDCNGVPFYSFYFTCQHNLFSIKSSVPFPDIFAGKRSCPSRLACNYRSYLQDQKIKYRRKCQHENQVEEKEKEKKTKATRATPATIELNALLIRGGDVEMLDHPAPGITPRKER

SEQ ID NO: 3098 - protein, 248 aa, Glycine max
  misc_feature (1)..(248): Ceres CLONE ID no. 534367
  misc_feature (1)..(248): Also Known As Ceres CDNA ID no. 23691708
  misc_feature (1)..(248): Also Known As Ceres GEMINI ID 552F4
  misc_feature (144)..(185): Pfam Name: zf-C3HC4 Pfam Description: Zinc finger, C3HC4 type (RING finger)
  misc_feature 344517:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MGSMGNSNPNLNPNPNPNPWTPKDCSEGICSIYCPQWCYKVYSPPPPILLGDGDDDPSGFEFSPLIVAVIGILASTFILVTYYTIISRFCRRRNNTNDSTEDDGNSELARVSSSANSGLDEALIKSITVCKYNKRGGLVEGHDCSVCLSEFEENEDLRLLPKCNHAFHLPCIDTWLKSHATCPLCRASVTACPNPNSSMEPPPRVIVNALEHQQRSNHVVVVVESSEEQEKVVSFDAHTLSDGEGYHT

SEQ ID NO: 3099 - DNA, 909 bp, Populus balsamifera subsp. trichocarpa
  misc_feature (1)..(909): Ceres ANNOT ID no. 1479391
  misc_feature 344591:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atgggttctactgctgacaaccaaaatccttggtcaccatatagcacctataaagattgttcacaaggaatttgtagcgtctattgtccacaatggtgttacatcattttccctcctccgcctcctttgtcactcggtgatgatgcttctaatactgatttatcccctcttactatagcatttatcggcatcctggcaagtgctttcatcttggtaacttaccacactctcgtttccaagtactgtagtcggcgaggtcatggcaatgataccactgaattgaatgacaatcaagatcagatgggaaatgaagcatcgcaaggtatcccaggtggactagatgaggcagttttaaagtctatcacaatttgcaagtacaagaaaggtgatggtttcgttgaaggcacagattgctcagtctgtcttggtgaatttcaagaaaacgagagcttaaggcgtttgccaaagtgtagccatgcatttcatctcctttgcattgatacatggctcaaatctcatgcaagttgtcctctatgccgtgccaatattgctgatcccgctaatgttttgcctagtgctcaagcaccaccagctgtgccggtccaagaaaatctgccaagctctaatgcttcaacacttcaataccaacaaaggaccaatgatgctgttttagtgattcaagatttagaagggagtgttgggcaagagggtagtgatgatctacacccaggactccagttaatcaagatcttgaaaatttccattgctgatatattacggatcagtgaagaagatgaggatggtgatggagttggcatcttgaatttagttaccagtccatttctacaggaagatttatgttcacaaggaagatttatgttctatgatttcaaattgatgagcatatag

SEQ ID NO: 3100 - protein, 302 aa, Populus balsamifera subsp. trichocarpa
  misc_feature (1)..(302): Ceres ANNOT ID no. 1479391
  misc_feature (138)..(179): Pfam Name: zf-C3HC4 Pfam Description: Zinc finger, C3HC4 type (RING finger)
  misc_feature: SWISSPROT Homolog: ATL5G_ARATH Probable RING-H2 finger protein ATL5G with e-value of 4.2e-61 and BLAST sequence identity of 52.3
  misc_feature: SWISSPROT Homolog: ATL3A_ARATH RING-H2 finger protein ATL3A with e-value of 2.4e-56 and BLAST sequence identity of 55.0
  misc_feature: SWISSPROT Homolog: ATL4H_ARATH Putative RING-H2 finger protein ATL4H with e-value of 1.8e-35 and BLAST sequence identity of 38.4
  misc_feature: SWISSPROT Homolog: ATL1O_ARATH RING-H2 finger protein ATL1O (RING-H2 finger protein ATL11) with e-value of 6.6e-32 and BLAST sequence identity of 36.1
  misc_feature: SWISSPROT Homolog: ATL5F_ARATH RING-H2 finger protein ATL5F with e-value of 7.0e-27 and BLAST sequence identity of 41.1
  misc_feature 344691:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(302): Functional Homolog of  Ceres CLONE ID no. 534367 at SEQ ID NO. 3145 with e-value of 3.39E-65 and BLAST sequence identity of 60.7
MGSTADNQNPWSPYSTYKDCSQGICSVYCPQWCYIIFPPPPPLSLGDDASNTDLSPLTIAFIGILASAFILVTYHTLVSKYCSRRGHGNDTTELNDNQDQMGNEASQGIPGGLDEAVLKSITICKYKKGDGFVEGTDCSVCLGEFQENESLRRLPKCSHAFHLLCIDTWLKSHASCPLCRANIADPANVLPSAQAPPAVPVQENLPSSNASTLQYQQRTNDAVLVIQDLEGSVGQEGSDDLHPGLQLIKILKISIADILRISEEDEDGDGVGILNLVTSPFLQEDLCSQGRFMFYDFKLMSI

SEQ ID NO: 3101 - DNA, 1050 bp, Populus balsamifera subsp. trichocarpa; identical to SEQ ID NO: 2572
  misc_feature (1)..(1050): Ceres ANNOT ID no. 1469954
  misc_feature 344782:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis

SEQ ID NO: 3102 - protein, 349 aa, Populus balsamifera subsp. trichocarpa; identical to SEQ ID NO: 2573
  misc_feature (1)..(349): Ceres ANNOT ID no. 1469954
  misc_feature (139)..(180): Pfam Name: zf-C3HC4 Pfam Description: Zinc finger, C3HC4 type (RING finger)
  misc_feature: SWISSPROT Homolog: ATL5G_ARATH Probable RING-H2 finger protein ATL5G with e-value of 4.2e-61 and BLAST sequence identity of 52.3
  misc_feature: SWISSPROT Homolog: ATL3A_ARATH RING-H2 finger protein ATL3A with e-value of 2.4e-56 and BLAST sequence identity of 55.0
  misc_feature: SWISSPROT Homolog: ATL4H_ARATH Putative RING-H2 finger protein ATL4H with e-value of 1.8e-35 and BLAST sequence identity of 38.4
  misc_feature: SWISSPROT Homolog: ATL1O_ARATH RING-H2 finger protein ATL1O (RING-H2 finger protein ATL11) with e-value of 6.6e-32 and BLAST sequence identity of 36.1
  misc_feature: SWISSPROT Homolog: ATL5F_ARATH RING-H2 finger protein ATL5F with e-value of 7.0e-27 and BLAST sequence identity of 41.1
  misc_feature 344886:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(349): Functional Homolog of  Ceres CLONE ID no. 534367 at SEQ ID NO. 3145 with e-value of 1.49E-64 and BLAST sequence identity of 61.1

SEQ ID NO: 3103 - DNA, 1107 bp, Populus balsamifera subsp. trichocarpa
  misc_feature (1)..(1107): Ceres ANNOT ID no. 1447025
  misc_feature 344986:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggcatctctagacgccccccaaacttggattccacacgtgaacattaaagactgttctcaaggattttgtagcttatactgcccacaatggtgttacatcatctcccctcctccgcctccctttgagttccctgatgacgattcgagtccaattttttctcctcttgtcattgccattataggcatactggccagtgctttccttctagtgtgttactacaccatcatatctaaatattgtggaaacgattattcggcaaggagaagggatcaaaatcatggacaaaatgaggaatttgaggacgatcacaactcatctctccacgagccttggcatgctgcaacaactggcgttgatgaggctcttataaggtccatcacagtttgcaagtacaaaaagggagatggtttgattgaagggacagattgctcagtttgtctaagtgagtttgaagaagatgagagcataaggcttttgccaaagtgtagccatgctttccatgtcccttgcattgatacatggcttcgctctcactcgaattgcccactatgccgtgccaacatagtcttctttagtgcttccctgcctcaattgcctcctccagtgacagaaactcctcaaggcaatgaatctttgcaagaaagccaacgagctaatgagaatgtgtcggttacacaagacacggaaagggttgctagagatgagcaagcgacacagaatcttgcaggggctccaaagactccgtcacgagtgtttagagattcggggaacttggaagagagagatatcataattgagatgcgagatatagatagatatcaacgcattaggagatcattttcaatggatcatccatgtcaaagccacacttccatcgctgaaattattcggatgaatcaggatgaagttgttccagtagaagactgttcgggagacgttggatcatcgaaacattcagcagaaatcagcaaatgcgtgtctagcagctgcagaagagtcttgaattgtgtactcaatcctgttaccatgaagagatcattttctagtggaagattctttctcactgggcatggaagaatgcgtgacaccataagtcttgtttaa

SEQ ID NO: 3104 - protein, 368 aa, Populus balsamifera subsp. trichocarpa
  misc_feature (1)..(368): Ceres ANNOT ID no. 1447025
  misc_feature (144)..(185): Pfam Name: zf-C3HC4 Pfam Description: Zinc finger, C3HC4 type (RING finger)
  misc_feature: SWISSPROT Homolog: ATL5G_ARATH Probable RING-H2 finger protein ATL5G with e-value of 4.2e-61 and BLAST sequence identity of 52.3
  misc_feature: SWISSPROT Homolog: ATL3A_ARATH RING-H2 finger protein ATL3A with e-value of 2.4e-56 and BLAST sequence identity of 55.0
  misc_feature: SWISSPROT Homolog: ATL4H_ARATH Putative RING-H2 finger protein ATL4H with e-value of 1.8e-35 and BLAST sequence identity of 38.4
  misc_feature: SWISSPROT Homolog: ATL1O_ARATH RING-H2 finger protein ATL1O (RING-H2 finger protein ATL11) with e-value of 6.6e-32 and BLAST sequence identity of 36.1
  misc_feature: SWISSPROT Homolog: ATL5F_ARATH RING-H2 finger protein ATL5F with e-value of 7.0e-27 and BLAST sequence identity of 41.1
  misc_feature 345092:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(368): Functional Homolog of  Ceres CLONE ID no. 534367 at SEQ ID NO. 3145 with e-value of 2.49E-60 and BLAST sequence identity of 57.6
MASLDAPQTWIPHVNIKDCSQGFCSLYCPQWCYIISPPPPPFEFPDDDSSPIFSPLVIAIIGILASAFLLVCYYTIISKYCGNDYSARRRDQNHGQNEEFEDDHNSSLHEPWHAATTGVDEALIRSITVCKYKKGDGLIEGTDCSVCLSEFEEDESIRLLPKCSHAFHVPCIDTWLRSHSNCPLCRANIVFFSASLPQLPPPVTETPQGNESLQESQRANENVSVTQDTERVARDEQATQNLAGAPKTPSRVFRDSGNLEERDIIIEMRDIDRYQRIRRSFSMDHPCQSHTSIAEIIRMNQDEVVPVEDCSGDVGSSKHSAEISKCVSSSCRRVLNCVLNPVTMKRSFSSGRFFLTGHGRMRDTISLV

SEQ ID NO: 3105 - DNA, 1107 bp, Populus balsamifera subsp. trichocarpa
  misc_feature (1)..(1107): Ceres ANNOT ID no. 1538933
  misc_feature 345198:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggcatcactcggcaccccaaaaactaggattccatacgtgaacaataaagactgttctcaaggattttgtagcttatactgtccacaatggtgctacatcattttccctcctccacctccccttgaattccttgatgacaattcaagtccaaaaatctctccccttgtcattgccattataggcatactgctcagtgctttccttttagtaatttactacaccataatatctaaatactgtggaaacaatgatccagcaaggagaagggatcaaaaccatggccaaaatgaggaatttgagggagatcacaacccctctctccatgagccttggcatgctgcaacaactggcttagatgaggctcttataaggtccatcacagtatgcaagtacaaaaagggagatggtttgattgacgggacagattgctcagtttgtctcagcgagtttcaagaagatgagagcataaggcttttgcctaagtgcagccatgctttccatgttccttgcattgatacatggctccgctctcactcgaattgcccactgtgtcgtgccaacattgttttctttagtgcttccccgcctcaattgcctcctccagtggctgaaactcctcgaggcaatgaatcttggcaaaatagccaacgatccaacgacaatgtggctgctacacaaggcacggaaagggttgctagagatgagcaagtgatgcagaatcctgctggggatccaaagactccgtggcgcgtatttagtgatttgggaaacttggaagagagagataccataattgagatgcgagatattgatgggtatcaacgcattaggagatcagtttcaatggatcatccatgtcaaagccacgcttctgtcgctgatattttacgcatgaatcaggatggagttgttcgagtagaagactgttcaggagatgttggatcatcaaaacattcagcagaagacagcaaattcacgtctagcaacagaagaagagtcttgcattgtgtgcttaatcccgttaccatgaagagatcattttcaagcggaagattctttcccaccggccatggaagagtacgtgacgccactagtcctgtttaa

SEQ ID NO: 3106 - protein, 368 aa, Populus balsamifera subsp. trichocarpa
  misc_feature (1)..(368): Ceres ANNOT ID no. 1538933
  misc_feature (144)..(185): Pfam Name: zf-C3HC4 Pfam Description: Zinc finger, C3HC4 type (RING finger)
  misc_feature: SWISSPROT Homolog: ATL5G_ARATH Probable RING-H2 finger protein ATL5G with e-value of 4.2e-61 and BLAST sequence identity of 52.3
  misc_feature: SWISSPROT Homolog: ATL3A_ARATH RING-H2 finger protein ATL3A with e-value of 2.4e-56 and BLAST sequence identity of 55.0
  misc_feature: SWISSPROT Homolog: ATL4H_ARATH Putative RING-H2 finger protein ATL4H with e-value of 1.8e-35 and BLAST sequence identity of 38.4
  misc_feature: SWISSPROT Homolog: ATL1O_ARATH RING-H2 finger protein ATL1O (RING-H2 finger protein ATL11) with e-value of 6.6e-32 and BLAST sequence identity of 36.1
  misc_feature: SWISSPROT Homolog: ATL5F_ARATH RING-H2 finger protein ATL5F with e-value of 7.0e-27 and BLAST sequence identity of 41.1
  misc_feature 345304:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(368): Functional Homolog of  Ceres CLONE ID no. 534367 at SEQ ID NO. 3145 with e-value of 6.19E-57 and BLAST sequence identity of 55.7
MASLGTPKTRIPYVNNKDCSQGFCSLYCPQWCYIIFPPPPPLEFLDDNSSPKISPLVIAIIGILLSAFLLVIYYTIISKYCGNNDPARRRDQNHGQNEEFEGDHNPSLHEPWHAATTGLDEALIRSITVCKYKKGDGLIDGTDCSVCLSEFQEDESIRLLPKCSHAFHVPCIDTWLRSHSNCPLCRANIVFFSASPPQLPPPVAETPRGNESWQNSQRSNDNVAATQGTERVARDEQVMQNPAGDPKTPWRVFSDLGNLEERDTIIEMRDIDGYQRIRRSVSMDHPCQSHASVADILRMNQDGVVRVEDCSGDVGSSKHSAEDSKFTSSNRRRVLHCVLNPVTMKRSFSSGRFFPTGHGRVRDATSPV

SEQ ID NO: 3107 - DNA, 1164 bp, Populus balsamifera subsp. trichocarpa
  misc_feature (1)..(1164): Ceres ANNOT ID no. 1485513
  misc_feature 345410:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggcatcactcggcaccccaaaaactaggattccatacgtgaacaataaagactgttctcaaggattttgtagcttatactgtccacaatggtgctacatcattttccctcctccacctccccttgaattccttgatgacaattcaagtccaaaaatctctccccttgtcattgccattataggcatactgctcagtgctttccttttagtaatttactacaccataatatctaaatactgtggaaacaatgatccagcaaggagaagggatcaaaaccatggccaaaatgaggaatttgagggagatcacaacccctctctccatgagccttggcatgctgcaacaactggcttagatgaggctcttataaggtccatcacagtatgcaagtacaaaaagggagatggtttgattgacgggacagattgctcagtttgtctcagcgagtttcaagaagatgagagcataaggcttttgcctaagtgcagccatgctttccatgttccttgcattgatacatggctccgctctcactcgaattgcccactgtgtcgtgccaacattgttttctttagtgcttccccgcctcaattgcctcctccagtggctgaaactcctcgaggcaatgaatcttggcaaaatagccaacgatccaacgacaatgtggctgctacacaaggcacggaaagggttgctagagatgagcaagtgatgcagaatcctgctggggatccaaagactccgtggcgcgtatttagtgatttgggaaacttggaagagagagataccataattgagatgcgagatattgatgggtatcaacgcattaggagatcagtttcaatggatcatccatgtcaaagccacgcttctgtcgctgatattttacgcatgaatcaggatggagttgttcgagtagaagactgttcaggagatgttggatcatcaaaacattcagcagaagacagcaaattcacgtctagcaacagaagaagagtcttgcattgtgtgcttaatcccgttaccatgaagagatcattttcaagcggaagattctttcccaccggccatggaagacttgaaaggctgccacgtgtagcaggggctgcaagaaaattttcttctcctcccaaattctctcagcatcgccaatatatgtaa

SEQ ID NO: 3108 - protein, 387 aa, Populus balsamifera subsp. trichocarpa
  misc_feature (1)..(387): Ceres ANNOT ID no. 1485513
  misc_feature (144)..(185): Pfam Name: zf-C3HC4 Pfam Description: Zinc finger, C3HC4 type (RING finger)
  misc_feature: SWISSPROT Homolog: ATL5G_ARATH Probable RING-H2 finger protein ATL5G with e-value of 4.2e-61 and BLAST sequence identity of 52.3
  misc_feature: SWISSPROT Homolog: ATL3A_ARATH RING-H2 finger protein ATL3A with e-value of 2.4e-56 and BLAST sequence identity of 55.0
  misc_feature: SWISSPROT Homolog: ATL4H_ARATH Putative RING-H2 finger protein ATL4H with e-value of 1.8e-35 and BLAST sequence identity of 38.4
  misc_feature: SWISSPROT Homolog: ATL1O_ARATH RING-H2 finger protein ATL1O (RING-H2 finger protein ATL11) with e-value of 6.6e-32 and BLAST sequence identity of 36.1
  misc_feature: SWISSPROT Homolog: ATL5F_ARATH RING-H2 finger protein ATL5F with e-value of 7.0e-27 and BLAST sequence identity of 41.1
  misc_feature 345518:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(387): Functional Homolog of  Ceres CLONE ID no. 534367 at SEQ ID NO. 3145 with e-value of 6.19E-57 and BLAST sequence identity of 55.7
MASLGTPKTRIPYVNNKDCSQGFCSLYCPQWCYIIFPPPPPLEFLDDNSSPKISPLVIAIIGILLSAFLLVIYYTIISKYCGNNDPARRRDQNHGQNEEFEGDHNPSLHEPWHAATTGLDEALIRSITVCKYKKGDGLIDGTDCSVCLSEFQEDESIRLLPKCSHAFHVPCIDTWLRSHSNCPLCRANIVFFSASPPQLPPPVAETPRGNESWQNSQRSNDNVAATQGTERVARDEQVMQNPAGDPKTPWRVFSDLGNLEERDTIIEMRDIDGYQRIRRSVSMDHPCQSHASVADILRMNQDGVVRVEDCSGDVGSSKHSAEDSKFTSSNRRRVLHCVLNPVTMKRSFSSGRFFPTGHGRLERLPRVAGAARKFSSPPKFSQHRQYM

SEQ ID NO: 3109 - protein, 474 aa, Glycine max
  misc_feature (1)..(474): Ceres CLONE ID no. 534397
  misc_feature (31)..(474): Pfam Name: p450 Pfam Description: Cytochrome P450
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Serrate Margins Useful for making plants with increased biomass and foliage
MELLSFLFLSLLFFLYLYIQFLARKKPRNNKAFKDYPLIGTLPEFLKNRHRFLEWTTQVLRDSPTNTGVFSRPYKLHGILTANPDNVEHVLKTKFDNYPKGERFIHLLQDFLGNGIFNSDGDLWKVQRKTASYEFSTKSLRNFVVDAVTFELQTRLLPILSKASETNKVLDLQDLLERFAFDNVCKLAFNVDPACLGGDGTAGGEFMRAFEDAAVLSSGRFMSILPVVWKIKKLFNFGSERRLRESITTVHQFADSIIRSRLESKDQIGDEDLLSRFIRTENTSPEFLRDVVISFILAGRDTTSSALSWFFWILSSRPDVQRKIRDEIETVRSEKSKGAFGYEEVKEMRYLQAAISETMRLYPPVPFDTMECLNDDVLPDGTRVGKGWFVTYHTYAMGRMESVWGKDCTEFKPERWLENRAESPFRYPVFHAGPRMCLGKEMAYIQMKSIAASLLERFLLRLWIRTRVRSMFCL

SEQ ID NO: 3110 - DNA, 1653 bp, Populus balsamifera subsp. trichocarpa
  misc_feature (1)..(1653): Ceres ANNOT ID no. 1453458
  misc_feature 345759:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Serrate Margins Useful for making plants with increased biomass and foliage
atggaagtcttatcagttcaacttcttataatactcttccttctttccctttggatctacctctacgttaccacctcttcacaaaagaaatccaccaacaagggcttcaaaatttaccctatagtaggggtcttaccggaattcataaaaaaccgtgcccgtgttcatgactggttcactgaaaccctcagccattgccccggaaacactgatgtccttcgccttcctggcatagaacctggtataatcactgccaaccctttgaatgttgaatactttctcaagaccaacttcgagaactacccgaaaggggaactgcttattaccacgcttgaagacttccttggccgaggaatctttaactcgaatggtgagctatggagggtccaaagaaagactgctagctatgtgttcaacacaaagtcacttcgaagttttgtcatggataacgtggtggttgaaatttcgacgaggttagttccaattcttgcaaaagcctcggaaacaagacaagtactggatttgcaagacatgttggagagattcgcatttgataacatttgtaaagtggcttttaatgttgatcctgctggtcttggcggcgatagaactgacggcagtgaatttatgcaagcatttgacgatgctgccgcacttagtacagagagattcctgtgctctcttccacttctttggaaattctacaagtttttcgacattgggtccgagagaaaattgaaaaaatcaattaaaattgtccatgaattcgccgacaatatcatacagtctagaatggaacaaaagatggaaaaaaaagatgaagatttactatcccggtttataggaaatgatgagaactcgaatgaatttctccgagatattgtcataagcttcattcttgcagggcgagacacaacatcttcagctttgagttggttcttttggctattatcattaaacccggatgtggaaagtaacatattaaaggagcttgaaacaatacggtcacgcaaccgcagaaagatcggcgacgcttacagttttgaggagctccgagacatgcattatttgcacgcaacaatatcagagacattaagattgtatccaccagtaccagtggatatcttggcttgcagaagtgatgatgtattgccggatggtgcatttgtcggaagaaaatggtttgtagtatactgtgcttatgccatgggaagaatggagagtatatggggcaagagctgcctagagtttctgcctgaaagatggctagagaatggaatatataggcaagagagtccattcaagtttccggtattccatgccggaccaagaatgtgtctcgggaaacatatggcttatattcagatgaaatcaatagcagcatcagtgattgagcggtttaagattgatgtacaaaataaagacaagtgtcccgagcatgtcttgtctttaacacttaggatgaagtctgggttgcagcagtactctatacttcaaattaagataattaaatctcaagcaaggagagagcactgtctattccatatacgagtgagcctctatagcaagagtttggatcaccttcttacagttcctggaacgaaaactgacagagaaataggcttatcaagtctattggcttcttcttcgtag

SEQ ID NO: 3111 - protein, 550 aa, Populus balsamifera subsp. trichocarpa
  misc_feature (1)..(550): Ceres ANNOT ID no. 1453458
  misc_feature (114)..(476): Pfam Name: p450 Pfam Description: Cytochrome P450
  misc_feature: SWISSPROT Homolog: C94A1_VICSA Cytochrome P450 94A1 (EC 1.14.-.-) (P450-dependent fatty acid omega-hydroxylase) with e-value of 1.2e-116 and BLAST sequence identity of 48.8
  misc_feature: SWISSPROT Homolog: C94A2_VICSA Cytochrome P450 94A2 (EC 1.14.-.-) (P450-dependent fatty acid omega-hydroxylase) with e-value of 1.1e-106 and BLAST sequence identity of 45.0
  misc_feature: SWISSPROT Homolog: C86A1_ARATH Cytochrome P450 86A1 (EC 1.14.-.-) (CYPLXXXVI) (P450-dependent fatty acid omega-hydroxylase) with e-value of 4.1e-86 and BLAST sequence identity of 41.3
  misc_feature: SWISSPROT Homolog: C86A2_ARATH Cytochrome P450 86A2 (EC 1.14.-.-) with e-value of 9.3e-80 and BLAST sequence identity of 42.6
  misc_feature: SWISSPROT Homolog: CP52E_CANMA Cytochrome P450 52A5 (EC 1.14.14.-) (CYPLIIA5) (Alkane-inducible P450-ALK2-A) (CYP52A3-B) with e-value of 3.5e-41 and BLAST sequence identity of 27.9
  misc_feature 345900:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Serrate Margins Useful for making plants with increased biomass and foliage
  misc_feature (1)..(550): Functional Homolog of  Ceres CLONE ID no. 534397 at SEQ ID NO. 3156 with e-value of 3.89E-158 and BLAST sequence identity of 64.9
MEVLSVQLLIILFLLSLWIYLYVTTSSQKKSTNKGFKIYPIVGVLPEFIKNRARVHDWFTETLSHCPGNTDVLRLPGIEPGIITANPLNVEYFLKTNFENYPKGELLITTLEDFLGRGIFNSNGELWRVQRKTASYVFNTKSLRSFVMDNVVVEISTRLVPILAKASETRQVLDLQDMLERFAFDNICKVAFNVDPAGLGGDRTDGSEFMQAFDDAAALSTERFLCSLPLLWKFYKFFDIGSERKLKKSIKIVHEFADNIIQSRMEQKMEKKDEDLLSRFIGNDENSNEFLRDIVISFILAGRDTTSSALSWFFWLLSLNPDVESNILKELETIRSRNRRKIGDAYSFEELRDMHYLHATISETLRLYPPVPVDILACRSDDVLPDGAFVGRKWFVVYCAYAMGRMESIWGKSCLEFLPERWLENGIYRQESPFKFPVFHAGPRMCLGKHMAYIQMKSIAASVIERFKIDVQNKDKCPEHVLSLTLRMKSGLQQYSILQIKIIKSQARREHCLFHIRVSLYSKSLDHLLTVPGTKTDREIGLSSLLASSS

SEQ ID NO: 3112 - DNA, 1755 bp, Populus balsamifera subsp. trichocarpa
  misc_feature (1)..(1755): Ceres ANNOT ID no. 1489056
  misc_feature 346052:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Serrate Margins Useful for making plants with increased biomass and foliage
atgtctattattgagctcttagcatcacttgcccttttacttgtcccactcttcttctatctcaccaagaattccaagtccaaagcatcatcaaaatctaatccaaacctaaaatcataccccttaattggatcctctgtagccatttttgccaatagaaaccgattcatccagtggacttcagatcttatccaaaactcacccactgccactgttgttatccgccgtctcttcgatgatagccgtgttcttacaggaaaccctgcaaatgtccaacacatgcttaaaacccagttttacaactatgagaaaggtagcaaagctcggcgcaccctctttgattttcttggaaacggtatctttaacattgatggtgattcttggaagtttcaaagacaagtttccagccatgaattcaacaccaaatcattgcgtaaattcgttgagaccgttgtcgacactgaagtatctcaacgcttaatcccgattctcttcactgctgcggctaacaatacagttcttgatttgcaagacatacttcaaagattcgcttttgacaacatctgcaagatcgctttcggatacgatcctgcatacttgctgcctgatctcgccgaagccgaatttgcgaaaacttttgatgaagctgccaagatatccagtgacaggttctctacgctattcccctttctttggaagattaagagggtcttcaatattggatcagagaaacgcctcaaagaagcatcctctgaattacgtgagttcgccagaaacatcatcaaagaaaagaagcaggaactcagcaacaaatcatccctcgaaaccgtagatcttctatcacgtttcttgagctcaggccattctgacgaggactttgtcactgatattgtcatcagttttatactagcaggccgagacaccacttccgctgccttaacatggtatttctggctactctctcaaaacccagaagtggaaaaggaaatagtcagagaaataaaagacaaatcggagagtccagtttatgaagaagtcaaggacatggtctacacacatgcttctttatgtgagagcatgaggctgtaccctccagtcccaatagatggcaaggttgcaatgcaggacgatgtcttgcctgacgggactgtgattaagaagggaatgagagtgtcttaccatccgtatgcaatggggaggctcgagatgttgtggggtccggactgggaaaagttcaagccagagagatggctgcagggatctggcgatggagttaatagtaatgggaagtggagttttgtagggagggacccatactcctaccctgtttttcaggccggaccaaggatttgtttgggtaaggacatggctttcttgcaaatgaaaagggtggtagccgggattttacggaggtttaaggttgttcctgctgcagaggagggttttgagcccgtgtttgtctcttatttgacgtccaaaatgcagggtggttttcctgtgagcatgttcgcttctcttccccctcattcctgccttcactcgattgaggataaacgagagaggagaagcgcagtcaggagcgatagactgactacggatgtagcaagcggttttatggttactgtcacgatgagaagaaaaggtaattcgctgggatcttatcatgcttcccagagatgctggttcgaatccagctctggattccgctctatccagcttgcttttcatagtagagctgggcaagcgcggcattga

SEQ ID NO: 3113 - protein, 584 aa, Populus balsamifera subsp. trichocarpa
  misc_feature (1)..(584): Ceres ANNOT ID no. 1489056
  misc_feature (35)..(502): Pfam Name: p450 Pfam Description: Cytochrome P450
  misc_feature: SWISSPROT Homolog: C94A1_VICSA Cytochrome P450 94A1 (EC 1.14.-.-) (P450-dependent fatty acid omega-hydroxylase) with e-value of 1.2e-116 and BLAST sequence identity of 48.8
  misc_feature: SWISSPROT Homolog: C94A2_VICSA Cytochrome P450 94A2 (EC 1.14.-.-) (P450-dependent fatty acid omega-hydroxylase) with e-value of 1.1e-106 and BLAST sequence identity of 45.0
  misc_feature: SWISSPROT Homolog: C86A1_ARATH Cytochrome P450 86A1 (EC 1.14.-.-) (CYPLXXXVI) (P450-dependent fatty acid omega-hydroxylase) with e-value of 4.1e-86 and BLAST sequence identity of 41.3
  misc_feature: SWISSPROT Homolog: C86A2_ARATH Cytochrome P450 86A2 (EC 1.14.-.-) with e-value of 9.3e-80 and BLAST sequence identity of 42.6
  misc_feature: SWISSPROT Homolog: CP52E_CANMA Cytochrome P450 52A5 (EC 1.14.14.-) (CYPLIIA5) (Alkane-inducible P450-ALK2-A) (CYP52A3-B) with e-value of 3.5e-41 and BLAST sequence identity of 27.9
  misc_feature 346197:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Serrate Margins Useful for making plants with increased biomass and foliage
  misc_feature (1)..(584): Functional Homolog of  Ceres CLONE ID no. 534397 at SEQ ID NO. 3156 with e-value of 1.50E-119 and BLAST sequence identity of 51.7
MSIIELLASLALLLVPLFFYLTKNSKSKASSKSNPNLKSYPLIGSSVAIFANRNRFIQWTSDLIQNSPTATVVIRRLFDDSRVLTGNPANVQHMLKTQFYNYEKGSKARRTLFDFLGNGIFNIDGDSWKFQRQVSSHEFNTKSLRKFVETVVDTEVSQRLIPILFTAAANNTVLDLQDILQRFAFDNICKIAFGYDPAYLLPDLAEAEFAKTFDEAAKISSDRFSTLFPFLWKIKRVFNIGSEKRLKEASSELREFARNIIKEKKQELSNKSSLETVDLLSRFLSSGHSDEDFVTDIVISFILAGRDTTSAALTWYFWLLSQNPEVEKEIVREIKDKSESPVYEEVKDMVYTHASLCESMRLYPPVPIDGKVAMQDDVLPDGTVIKKGMRVSYHPYAMGRLEMLWGPDWEKFKPERWLQGSGDGVNSNGKWSFVGRDPYSYPVFQAGPRICLGKDMAFLQMKRVVAGILRRFKVVPAAEEGFEPVFVSYLTSKMQGGFPVSMFASLPPHSCLHSIEDKRERRSAVRSDRLTTDVASGFMVTVTMRRKGNSLGSYHASQRCWFESSSGFRSIQLAFHSRAGQARH

SEQ ID NO: 3114 - DNA, 1590 bp, Populus balsamifera subsp. trichocarpa
  misc_feature (1)..(1590): Ceres ANNOT ID no. 1442794
  misc_feature 346355:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Serrate Margins Useful for making plants with increased biomass and foliage
atgtctattattgagctgttagcatcaattgcccttgttgtctcactcttcttctatctcaccaaaaactccaactccaaagcatcatcaaaatccaatccatatctcccaaaaccataccccttaattggatcctctgtagccatctatgccaatagaaaccgagtcatccaatggacatcagatcttatccaaaactcccccactgccactattgttctccaccgtttcttggatgacagccgtgtccatacaggaaacccagcaaatgtccaacatatacttaaaacccagtttcacaactatgggaaaggcagcaaatttcggcgaattctcttcgattttcttggaaacggtatctttaacattgatggcgattcttggaagtttcaaaggcaagtttccagcaatgaattcaacaccaaatcactgcgtaaattcgtcgagaccctcgttgatactgaactctctcaacgcttgatcccgattctctcctccgctgctgctaacaatacagttcttgatttgcaagacatacttcaaagattcgcttttgacaacatatgcaatatcgctttcggatacgaccctgcatacttgctgcctgatctccctgaagcagaatttgcaaaaactttcgatgacgctgccaagataagcagcgagaggttaaattcagttttcccctatctttggaagattaaaagggtcttgaatattggttcagagaaacgcctcaaagaagcatcctctcaactacgtcagttcgccaaaaatatcatcaaagaaaagaagcaagaactcagcaaaaaaccatcactcgaatccgtcgatctattatcccggttcttgagctctggtcattctgatgaagactttgtcactgatattgtcatcagttttatactagctggccgggacacgacttctgctgccttaacatggtatttctggctactctctcagaaccaagaagtggagaaggaagtacttagggaaataaaagagaaatcggagagtccagtttatgaagaacttaaggacatggtttacacacatgcttctttatgtgagagcatgaggctgtaccctcctgtcccaatagacagcaaggttgcaaagcacgacgatgttttgcctgatgggactgtggttaagaagggtatgagagtgtcttaccatccctatgcaatggggaggctcgaggtgttgtggggttcagattgggaaaagttcaagccagagagatggctggagagtgctgccgatggagctactaagaatgggaagtggagttttgtggggagggacccgtatacctaccctgtttttcaggctgggccaaggatttgtttgggtaaggacatggctttcttgcaaatgaagaaggtggtggctggaatattacggaggtttaaggttgtaccggtggcagaggatggttttgagcccgagtttgttgcttatttgacgggcaagatgaagggtggttttcctgtgaggttcgagaagagagctgacggtatgattgttgattttgattttggttatcatcccacacgcagtgcacaaaactttcgctctccttga

SEQ ID NO: 3115 - protein, 529 aa, Populus balsamifera subsp. trichocarpa
  misc_feature (1)..(529): Ceres ANNOT ID no. 1442794
  misc_feature (91)..(500): Pfam Name: p450 Pfam Description: Cytochrome P450
  misc_feature: SWISSPROT Homolog: C94A1_VICSA Cytochrome P450 94A1 (EC 1.14.-.-) (P450-dependent fatty acid omega-hydroxylase) with e-value of 1.2e-116 and BLAST sequence identity of 48.8
  misc_feature: SWISSPROT Homolog: C94A2_VICSA Cytochrome P450 94A2 (EC 1.14.-.-) (P450-dependent fatty acid omega-hydroxylase) with e-value of 1.1e-106 and BLAST sequence identity of 45.0
  misc_feature: SWISSPROT Homolog: C86A1_ARATH Cytochrome P450 86A1 (EC 1.14.-.-) (CYPLXXXVI) (P450-dependent fatty acid omega-hydroxylase) with e-value of 4.1e-86 and BLAST sequence identity of 41.3
  misc_feature: SWISSPROT Homolog: C86A2_ARATH Cytochrome P450 86A2 (EC 1.14.-.-) with e-value of 9.3e-80 and BLAST sequence identity of 42.6
  misc_feature: SWISSPROT Homolog: CP52E_CANMA Cytochrome P450 52A5 (EC 1.14.14.-) (CYPLIIA5) (Alkane-inducible P450-ALK2-A) (CYP52A3-B) with e-value of 3.5e-41 and BLAST sequence identity of 27.9
  misc_feature 346494:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Serrate Margins Useful for making plants with increased biomass and foliage
  misc_feature (1)..(529): Functional Homolog of  Ceres CLONE ID no. 534397 at SEQ ID NO. 3156 with e-value of 4.00E-117 and BLAST sequence identity of 51.5
MSIIELLASIALVVSLFFYLTKNSNSKASSKSNPYLPKPYPLIGSSVAIYANRNRVIQWTSDLIQNSPTATIVLHRFLDDSRVHTGNPANVQHILKTQFHNYGKGSKFRRILFDFLGNGIFNIDGDSWKFQRQVSSNEFNTKSLRKFVETLVDTELSQRLIPILSSAAANNTVLDLQDILQRFAFDNICNIAFGYDPAYLLPDLPEAEFAKTFDDAAKISSERLNSVFPYLWKIKRVLNIGSEKRLKEASSQLRQFAKNIIKEKKQELSKKPSLESVDLLSRFLSSGHSDEDFVTDIVISFILAGRDTTSAALTWYFWLLSQNQEVEKEVLREIKEKSESPVYEELKDMVYTHASLCESMRLYPPVPIDSKVAKHDDVLPDGTVVKKGMRVSYHPYAMGRLEVLWGSDWEKFKPERWLESAADGATKNGKWSFVGRDPYTYPVFQAGPRICLGKDMAFLQMKKVVAGILRRFKVVPVAEDGFEPEFVAYLTGKMKGGFPVRFEKRADGMIVDFDFGYHPTRSAQNFRSP

SEQ ID NO: 3116 - DNA, 1530 bp, Populus balsamifera subsp. trichocarpa
  misc_feature (1)..(1530): Ceres ANNOT ID no. 1495713
  misc_feature 346643:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Serrate Margins Useful for making plants with increased biomass and foliage
atgtctattaccgagctcttagcatcgatttcccttttactactcccaatcttcttctatctcaccaaaagttccaagtccaaagcatcatcaatatcatatcccaatgccccgaaatcatacccactaattggatcctctttagccatctttgccaataaaagccgacgcatccaatggatatcagatcttatccaaaactccccctctgccactgttgttctccaccgtttcttcttggacgatagccatattcttacaggaaatccagcaaatgtccaacacatgcttaaaacccagtttcacaactatgagaaaggtagcaaaactcgtcggattctcttcgattttcttggaaacggtatctttaacattaatggcgattcttggaagtttcaaaggaaagtttccagcaatgaattcaacgccaaatcactgcgtaaattcgtcgagaccgttgtcgatgccgaactctctcaacgcttgatcccgattctctccacggctgctgctaataatgcagttcttgatttgcaagacatacttcaaagattcgcttttgacaacatatgcaagatcgctttcgggtacgaccctgcatacttgctgcctgatctccctgaagccgaatttgcaaaaactttcgatgacgctgtcaatataagcagccagaggttcaattcagtgttcccctatctttggaagattaaaaagttcttgaatattggatcagagaaacgcctcaaagaagcatcctctcaactacgtcagttcgccaaaaacatcatcaaagaaaagaagcaagaactcagcaataaatcatcactcgaatcagtcgatctcttatcccggttcttgagctctggccattctgatgaagactttgtcactgatattgtcatcagttttatactagctggccgggacacgacttctgctgccttaacatggtatttctggctactctctcagaaccaagaagtggagaaggaagtacttagggaaataaaagagaaatcggagagtccagtttatgaagaagttaaggacatggtttacacacatgcttctttgtgtgagagcatgaggctgtaccctcctgtcccaatagatagcaaggttgcaaagcacgacgatgttttgcctgatgggactgtggttaagaagggttcgagagtgtgttaccatccctacgcaatggggaggctcgaggttttgtggggttcagattgggaaaagttcaagccagagagatggctggagagtgctgccgatggagctaataagaatgggaagtggagttttgtggggagggacccgtatacctaccctgtttttcaggctgggccaaggatttgtttgggtaaggacatggctttcttgcaaatgaagagggtggttgccgggatcttacggaggtttaaggttgtaccagtggcagatgatggttttgagcccgtgtttattgctgatttgacgagcaagatgaagggtggttttcccgtgaggttcaaagagagatctgattaa

SEQ ID NO: 3117 - protein, 509 aa, Populus balsamifera subsp. trichocarpa
  misc_feature (1)..(509): Ceres ANNOT ID no. 1495713
  misc_feature (117)..(503): Pfam Name: p450 Pfam Description: Cytochrome P450
  misc_feature: SWISSPROT Homolog: C94A1_VICSA Cytochrome P450 94A1 (EC 1.14.-.-) (P450-dependent fatty acid omega-hydroxylase) with e-value of 1.2e-116 and BLAST sequence identity of 48.8
  misc_feature: SWISSPROT Homolog: C94A2_VICSA Cytochrome P450 94A2 (EC 1.14.-.-) (P450-dependent fatty acid omega-hydroxylase) with e-value of 1.1e-106 and BLAST sequence identity of 45.0
  misc_feature: SWISSPROT Homolog: C86A1_ARATH Cytochrome P450 86A1 (EC 1.14.-.-) (CYPLXXXVI) (P450-dependent fatty acid omega-hydroxylase) with e-value of 4.1e-86 and BLAST sequence identity of 41.3
  misc_feature: SWISSPROT Homolog: C86A2_ARATH Cytochrome P450 86A2 (EC 1.14.-.-) with e-value of 9.3e-80 and BLAST sequence identity of 42.6
  misc_feature: SWISSPROT Homolog: CP52E_CANMA Cytochrome P450 52A5 (EC 1.14.14.-) (CYPLIIA5) (Alkane-inducible P450-ALK2-A) (CYP52A3-B) with e-value of 3.5e-41 and BLAST sequence identity of 27.9
  misc_feature 346780:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Serrate Margins Useful for making plants with increased biomass and foliage
  misc_feature (1)..(509): Functional Homolog of  Ceres CLONE ID no. 534397 at SEQ ID NO. 3156 with e-value of 1.80E-114 and BLAST sequence identity of 52.3
MSITELLASISLLLLPIFFYLTKSSKSKASSISYPNAPKSYPLIGSSLAIFANKSRRIQWISDLIQNSPSATVVLHRFFLDDSHILTGNPANVQHMLKTQFHNYEKGSKTRRILFDFLGNGIFNINGDSWKFQRKVSSNEFNAKSLRKFVETVVDAELSQRLIPILSTAAANNAVLDLQDILQRFAFDNICKIAFGYDPAYLLPDLPEAEFAKTFDDAVNISSQRFNSVFPYLWKIKKFLNIGSEKRLKEASSQLRQFAKNIIKEKKQELSNKSSLESVDLLSRFLSSGHSDEDFVTDIVISFILAGRDTTSAALTWYFWLLSQNQEVEKEVLREIKEKSESPVYEEVKDMVYTHASLCESMRLYPPVPIDSKVAKHDDVLPDGTVVKKGSRVCYHPYAMGRLEVLWGSDWEKFKPERWLESAADGANKNGKWSFVGRDPYTYPVFQAGPRICLGKDMAFLQMKRVVAGILRRFKVVPVADDGFEPVFIADLTSKMKGGFPVRFKERSD

SEQ ID NO: 3118 - DNA, 1653 bp, Populus balsamifera subsp. trichocarpa
  misc_feature (1)..(1653): Ceres ANNOT ID no. 1442797
  misc_feature 346923:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Serrate Margins Useful for making plants with increased biomass and foliage
atgtctattaccgagctcttagcatcgatttcccttttactactcccaatcttcttctatctcaccaaaagttccaagtccaaagcatcatcaatatcatatcccaatgccccgaaatcatacccactaattggatcctctttagccatctttgccaataaaagccgacgcatccaatggatatcagatcttatccaaaactccccctctgccactgttgttctccaccgtttcttcttggacgatagccatattcttacaggaaatccagcaaatgtccaacacatgcttaaaacccagtttcacaactatgagaaaggtagcaaaactcgtcggattctcttcgattttcttggaaacggtatctttaacattaatggcgattcttggaagtttcaaaggaaagtttccagcaatgaattcaacgccaaatcactgcgtaaattcgtcgagaccgttgtcgatgccgaactctctcaacgcttgatcccgattctctccacggctgctgctaataatgcagttcttgatttgcaagacatacttcaaagattcgcttttgacaacatatgcaagatcgctttcgggtacgaccctgcatacttgctgcctgatctccctgaagccgaatttgcaaaaactttcgatgacgctgtcaatataagcagccagaggttcaattcagtgttcccctatctttggaagattaaaaagttcttgaatattggatcagagaaacgcctcaaagaagcatcctctcaactacgtcagttcgccaaaaacatcatcaaagaaaagaagcaagaactcagcaataaatcatcactcgaatcagtcgatctcttatcccggttcttgagctctggccattctgatgaagactttgtcactgatattgtcatcagttttatactagctggccgggacacgacttctgctgccttaacatggtatttctggctactctctcagaaccaagaagtggagaaggaagtacttagggaaataaaagagaaatcggagagtccagtttatgaagaagttaaggacatggtttacacacatgcttctttgtgtgagagcatgaggctgtaccctcctgtcccaatagatagcaaggttgcaaagcacgacgatgttttgcctgatgggactgtggttaagaagggttcgagagtgtgttaccatccctacgcaatggggaggctcgaggttttgtggggttcagattgggaaaagttcaagccagagagatggctggagagtgctgccgatggagctaataagaatgggaagtggagttttgtggggagggacccgtatacctaccctgtttttcaggctgggccaaggatttgtttgggtaaggacatggctttcttgcaaatgaagagggtggttgccgggatcttacggaggtttaaggttgtaccagtggcagatgatggttttgagcccgtgtttattgctgatttgacgagcaagatgaagggtggtatgattattgatttcgagtttgggacatcatcaatcccacacaaaacgcataaaatcacagagcatgctacaacctgtataccatgcccggaggacctctccctccacccaagatggaccccatgcctgcccccctataaccagacagaggtatag

SEQ ID NO: 3119 - protein, 550 aa, Populus balsamifera subsp. trichocarpa
  misc_feature (1)..(550): Ceres ANNOT ID no. 1442797
  misc_feature (117)..(503): Pfam Name: p450 Pfam Description: Cytochrome P450
  misc_feature: SWISSPROT Homolog: C94A1_VICSA Cytochrome P450 94A1 (EC 1.14.-.-) (P450-dependent fatty acid omega-hydroxylase) with e-value of 1.2e-116 and BLAST sequence identity of 48.8
  misc_feature: SWISSPROT Homolog: C94A2_VICSA Cytochrome P450 94A2 (EC 1.14.-.-) (P450-dependent fatty acid omega-hydroxylase) with e-value of 1.1e-106 and BLAST sequence identity of 45.0
  misc_feature: SWISSPROT Homolog: C86A1_ARATH Cytochrome P450 86A1 (EC 1.14.-.-) (CYPLXXXVI) (P450-dependent fatty acid omega-hydroxylase) with e-value of 4.1e-86 and BLAST sequence identity of 41.3
  misc_feature: SWISSPROT Homolog: C86A2_ARATH Cytochrome P450 86A2 (EC 1.14.-.-) with e-value of 9.3e-80 and BLAST sequence identity of 42.6
  misc_feature: SWISSPROT Homolog: CP52E_CANMA Cytochrome P450 52A5 (EC 1.14.14.-) (CYPLIIA5) (Alkane-inducible P450-ALK2-A) (CYP52A3-B) with e-value of 3.5e-41 and BLAST sequence identity of 27.9
  misc_feature 347064:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Serrate Margins Useful for making plants with increased biomass and foliage
  misc_feature (1)..(550): Functional Homolog of  Ceres CLONE ID no. 534397 at SEQ ID NO. 3156 with e-value of 1.80E-114 and BLAST sequence identity of 52.3
MSITELLASISLLLLPIFFYLTKSSKSKASSISYPNAPKSYPLIGSSLAIFANKSRRIQWISDLIQNSPSATVVLHRFFLDDSHILTGNPANVQHMLKTQFHNYEKGSKTRRILFDFLGNGIFNINGDSWKFQRKVSSNEFNAKSLRKFVETVVDAELSQRLIPILSTAAANNAVLDLQDILQRFAFDNICKIAFGYDPAYLLPDLPEAEFAKTFDDAVNISSQRFNSVFPYLWKIKKFLNIGSEKRLKEASSQLRQFAKNIIKEKKQELSNKSSLESVDLLSRFLSSGHSDEDFVTDIVISFILAGRDTTSAALTWYFWLLSQNQEVEKEVLREIKEKSESPVYEEVKDMVYTHASLCESMRLYPPVPIDSKVAKHDDVLPDGTVVKKGSRVCYHPYAMGRLEVLWGSDWEKFKPERWLESAADGANKNGKWSFVGRDPYTYPVFQAGPRICLGKDMAFLQMKRVVAGILRRFKVVPVADDGFEPVFIADLTSKMKGGMIIDFEFGTSSIPHKTHKITEHATTCIPCPEDLSLHPRWTPCLPPYNQTEV

SEQ ID NO: 3120 - DNA, 1530 bp, Populus balsamifera subsp. trichocarpa
  misc_feature (1)..(1530): Ceres ANNOT ID no. 1468612
  misc_feature 347216:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Serrate Margins Useful for making plants with increased biomass and foliage
atgttcatctttctcattatcttttgcaatctagggttttaccttctctctttcttcttctcagtccttcaagaattctacgcctctcaaacaaaaccacccaccactcatggccctccttcttatccaattataggctgcctaatctctttctacaagaatcgccgctgccttttagactggtacaccaatcttttgtcggtgtcaccaacacaaaccattgtggtgaagcggttaggtgcccgccgcattattgtcacggccaatccggaaaatgttgagtacgtcctcaagaccaacttcattaacttccctaaaggaaaatcctttactgaaatccttggggaccttctagggtgcggcatattcaatgctgatggtgaattatggagcactcaacgtaagttggctagccatgagttcagcaccaagtctttgagagaattcgttgttatgacactacaagaagaggtggaaaatcgtctaataccgttgttagaagaggccgtggaagctaagagtgtattggatttgcaagatttgttgaggagattttcatttgatattgtttgtcgagtttctctggggactgatccttcttgcttggatctttcacggcccatcccgccgcttgttaaagcatttgatgctgcttcagaaataagcgctatgcgtggaatggcgccagtttatgctgtgtggaaggccaagaaactcttcaatttaggggctgagaaaaaactgaaagaagcaatcaagcttgttcatgattcagtctcagaaattgttaagaccaagaagagggttcttgaaaatgatagagaaggaaaattggaaagtgatcttctgtcaagattattactagcagggcacggcgaggaagttgtaagagatatggtgataagcttcatcatggcagggagagatacaacatcagcagcaatgacttggctattttggttgctttcaaagcatcgaaactctgagaaaatgatcgtgaaagaagtaaaatcattgcttgacgatcgtgaaaaggcaattgattatgaagttttaaaaggcatgaatttcttgaaggcaagtttatgtgagtccatgaggctgtaccctccagttccatgggactcaaagcatgctattattgatgatgtcttgccggacggaacttctgtcagaaagggagatagagtgacctattttccctacggaatgggcagaatggaaaaattgtggggtaaggaccggtttgaatttagaccagaccggtggtttcaagaaatcggtaatgatcagacattgaaatcggtgagtccatatacgtttcctgtctttcaagccggtccaagggtgtgcctagggaaggagatggctatgatacagatgaaatatgtgatggcttccgtattgaggcggttcgagatcaaaccggtttttgataacgaaccggtttttgctcctctattgacagctcacatggttggtgggttgaaggttatggtcaagagaaggaatggaaatggtgatatttga

SEQ ID NO: 3121 - protein, 509 aa, Populus balsamifera subsp. trichocarpa
  misc_feature (1)..(509): Ceres ANNOT ID no. 1468612
  misc_feature (37)..(502): Pfam Name: p450 Pfam Description: Cytochrome P450
  misc_feature: SWISSPROT Homolog: C94A1_VICSA Cytochrome P450 94A1 (EC 1.14.-.-) (P450-dependent fatty acid omega-hydroxylase) with e-value of 1.2e-116 and BLAST sequence identity of 48.8
  misc_feature: SWISSPROT Homolog: C94A2_VICSA Cytochrome P450 94A2 (EC 1.14.-.-) (P450-dependent fatty acid omega-hydroxylase) with e-value of 1.1e-106 and BLAST sequence identity of 45.0
  misc_feature: SWISSPROT Homolog: C86A1_ARATH Cytochrome P450 86A1 (EC 1.14.-.-) (CYPLXXXVI) (P450-dependent fatty acid omega-hydroxylase) with e-value of 4.1e-86 and BLAST sequence identity of 41.3
  misc_feature: SWISSPROT Homolog: C86A2_ARATH Cytochrome P450 86A2 (EC 1.14.-.-) with e-value of 9.3e-80 and BLAST sequence identity of 42.6
  misc_feature: SWISSPROT Homolog: CP52E_CANMA Cytochrome P450 52A5 (EC 1.14.14.-) (CYPLIIA5) (Alkane-inducible P450-ALK2-A) (CYP52A3-B) with e-value of 3.5e-41 and BLAST sequence identity of 27.9
  misc_feature 347353:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Serrate Margins Useful for making plants with increased biomass and foliage
  misc_feature (1)..(509): Functional Homolog of  Ceres CLONE ID no. 534397 at SEQ ID NO. 3156 with e-value of 8.19E-110 and BLAST sequence identity of 49.3
MFIFLIIFCNLGFYLLSFFFSVLQEFYASQTKPPTTHGPPSYPIIGCLISFYKNRRCLLDWYTNLLSVSPTQTIVVKRLGARRIIVTANPENVEYVLKTNFINFPKGKSFTEILGDLLGCGIFNADGELWSTQRKLASHEFSTKSLREFVVMTLQEEVENRLIPLLEEAVEAKSVLDLQDLLRRFSFDIVCRVSLGTDPSCLDLSRPIPPLVKAFDAASEISAMRGMAPVYAVWKAKKLFNLGAEKKLKEAIKLVHDSVSEIVKTKKRVLENDREGKLESDLLSRLLLAGHGEEVVRDMVISFIMAGRDTTSAAMTWLFWLLSKHRNSEKMIVKEVKSLLDDREKAIDYEVLKGMNFLKASLCESMRLYPPVPWDSKHAIIDDVLPDGTSVRKGDRVTYFPYGMGRMEKLWGKDRFEFRPDRWFQEIGNDQTLKSVSPYTFPVFQAGPRVCLGKEMAMIQMKYVMASVLRRFEIKPVFDNEPVFAPLLTAHMVGGLKVMVKRRNGNGDI

SEQ ID NO: 3122 - DNA, 1473 bp, Populus balsamifera subsp. trichocarpa
  misc_feature (1)..(1473): Ceres ANNOT ID no. 1460503
  misc_feature 347496:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Serrate Margins Useful for making plants with increased biomass and foliage
atggatcttgtagctgctcttagttttcttttctttggttttaccatcttgttctctttgttttctttcttgatctatgttttgaggctgaaaccatggtgtaattgtgatgtttgcaagacctatctttcttcaagctggaccaaagattttgctaatctttgtgattggtacactcaccttcttagaaaatcaaaaactggtactattcatgtccatgttcttggcaacatcatcactgctaatcctgaaaatgttgagcacatgctcaagacgaaatttgagaactacccaaaagggaaacctttctctgcactcttgggtgatcttttgggtagaggtatttttaatgttgatggtaatcattggaagtttcagaggaaaatggcaagcttggaattagggagtgtttccataagaatgcatgcttttgatctcataatgtctgagattcgtagcaggctacttcctctcttgtcatcagttgctgatgaacaacgagttttggatttgcaagatgtgttcagaagattttcttttgataacatttgcaaattctcatttgggttagaccccggatgcctcgagttatctttgcctgcttgtaaatttgctgcagcttttgataccgcatcaaagttatctgctgagcgagccctagcgccatcaccaatagtctggaagatcaagaggctactgagcataggctcagaaaaggaacttaaagaagcaatcaagaaggtgaatgagttagctgagggagtgataaatgaaaggcgaaaagcaggcttctctaagaacaatgatttgctatcaagattcatgacgtccataactgatgagaagtatctccgagacattgttgtaagctttctcttagctggtcgcgacactgttgcttcaggcctaaccagtttcttctggttattatcacaacgtccagaagtagagtcagcaattcgagcggagacagaaaaggtcatggggttgaatcaagaccttcctagctttcaagaaatgcgtgaaatgcattgcctaaatgctgcagttcatgaaagtttgagactgtaccccccagtacaattcgattctaagttttctcaagaggatgatatacttcctgacggtacatttgtgcctaaagggactagagtaacatatcatcaatatgcaatgggtcgaatggagcagatttggggaccagattgtctcgaattcaagcctgaaagatggttaaagaatggagtttttgtgcccgcaaacccgtttaagtatactgttttccatgctggggttaggatttgcttaggcaaggaaatggccctagtggagatgaaggctgttgctcttgctataatccgagggtttaacacccgggttgtggatccgaatcaagtaccaaggttcagcccgggtcttacagccaccgttagaggtggcttaccggttgtgattcaagaaagggaagcctga

SEQ ID NO: 3123 - protein, 490 aa, Populus balsamifera subsp. trichocarpa
  misc_feature (1)..(490): Ceres ANNOT ID no. 1460503
  misc_feature (43)..(483): Pfam Name: p450 Pfam Description: Cytochrome P450
  misc_feature: SWISSPROT Homolog: C94A1_VICSA Cytochrome P450 94A1 (EC 1.14.-.-) (P450-dependent fatty acid omega-hydroxylase) with e-value of 1.2e-116 and BLAST sequence identity of 48.8
  misc_feature: SWISSPROT Homolog: C94A2_VICSA Cytochrome P450 94A2 (EC 1.14.-.-) (P450-dependent fatty acid omega-hydroxylase) with e-value of 1.1e-106 and BLAST sequence identity of 45.0
  misc_feature: SWISSPROT Homolog: C86A1_ARATH Cytochrome P450 86A1 (EC 1.14.-.-) (CYPLXXXVI) (P450-dependent fatty acid omega-hydroxylase) with e-value of 4.1e-86 and BLAST sequence identity of 41.3
  misc_feature: SWISSPROT Homolog: C86A2_ARATH Cytochrome P450 86A2 (EC 1.14.-.-) with e-value of 9.3e-80 and BLAST sequence identity of 42.6
  misc_feature: SWISSPROT Homolog: CP52E_CANMA Cytochrome P450 52A5 (EC 1.14.14.-) (CYPLIIA5) (Alkane-inducible P450-ALK2-A) (CYP52A3-B) with e-value of 3.5e-41 and BLAST sequence identity of 27.9
  misc_feature 347631:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Serrate Margins Useful for making plants with increased biomass and foliage
  misc_feature (1)..(490): Functional Homolog of  Ceres CLONE ID no. 534397 at SEQ ID NO. 3156 with e-value of 8.49E-108 and BLAST sequence identity of 49.3
MDLVAALSFLFFGFTILFSLFSFLIYVLRLKPWCNCDVCKTYLSSSWTKDFANLCDWYTHLLRKSKTGTIHVHVLGNIITANPENVEHMLKTKFENYPKGKPFSALLGDLLGRGIFNVDGNHWKFQRKMASLELGSVSIRMHAFDLIMSEIRSRLLPLLSSVADEQRVLDLQDVFRRFSFDNICKFSFGLDPGCLELSLPACKFAAAFDTASKLSAERALAPSPIVWKIKRLLSIGSEKELKEAIKKVNELAEGVINERRKAGFSKNNDLLSRFMTSITDEKYLRDIVVSFLLAGRDTVASGLTSFFWLLSQRPEVESAIRAETEKVMGLNQDLPSFQEMREMHCLNAAVHESLRLYPPVQFDSKFSQEDDILPDGTFVPKGTRVTYHQYAMGRMEQIWGPDCLEFKPERWLKNGVFVPANPFKYTVFHAGVRICLGKEMALVEMKAVALAIIRGFNTRVVDPNQVPRFSPGLTATVRGGLPVVIQEREA

SEQ ID NO: 3124 - DNA, 1473 bp, Populus balsamifera subsp. trichocarpa
  misc_feature (1)..(1473): Ceres ANNOT ID no. 1488307
  misc_feature 347771:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Serrate Margins Useful for making plants with increased biomass and foliage
atggattttgtagctgcttttagttttcttttctttggttttaccatattgttctctatgttttctttcttgatctatgtttggaggttgaaaccatggtgtaactgtgatgtttgcaaggcctatctttctgcaagctggaccaaagactttactaatctttgtgattggtatactcaccttcttcgcaattcaaaaactggtactattcatttgcatgttctcggcaacatcatcactgctaatcctgagaatgttgagcacatggtcaagacaaagtttgataactacccgaaagggaaacctttctctgatctcttgggggatcttttgggcagaggtatttttaatgttgatggtgattcctggaagtttcagaggaaaatggcaagccttgaattagggagtgtttcgataagaatgtatgcttttgatctcataatcactgagattcgcaagaggctgcttccgctcttgtcatcagctgctgctaaacaagaagttttggatttgcaagatgtgtttagaagattttctttcgataacatttgcaaattctcatttgggttagaccccggatgcctcgagttatctttgcctgtttgtgaatttgctttagcttttgatgccgcatcaaagttatctgccgagcgagccatagcggcatcaccaatggtctggaagatcaagaggctactgaacataggctcagagagggaactcaaagaagcaatcaagaaggtggatgagttagctgagagaatgataaatcaaaagcgaaaagaaggtttctctaatatcagtgatttgctatcaagattcatgacatccatcagtgatgacaggtaccttcgagacattgttataagctttctcttggccggtcgcgacacagttgcttcaggcctaaccagtttcttctggatattatcacaacatccagaagtagtgtcagcaattcgagaggagatagaaaaagtcacggggccgaatcaagaacttcctaactttcaagaaatgcttcaaatgcattacctaaatgctgcaatttatgaaagtttgagattgtacccaccagtacaatttgattctaagtttgctcaagaggatgatatacttcctgatggtacatttatgcctaaagggaccagggcaacataccatcaatatgcaatgggtcgaatggaggagatttggggaccagattgtctcgctttcaaacctgaaagatggttaaagaaaggagtttttgagcccgcaaacccttttaagtatactgtttttcatgctgggcatagaatttgtataggcaaggaacttgcccttgtggagatgaaaactgttgctcttgcaataatccgagggtttaatactgtggttgaggatccgaatcaagtaccaaggttcatcccgggttttacagccaccgttcgaggtggcttaccggttttgattcaagaaagggaagcctga

SEQ ID NO: 3125 - protein, 490 aa, Populus balsamifera subsp. trichocarpa
  misc_feature (1)..(490): Ceres ANNOT ID no. 1488307
  misc_feature (89)..(484): Pfam Name: p450 Pfam Description: Cytochrome P450
  misc_feature: SWISSPROT Homolog: C94A1_VICSA Cytochrome P450 94A1 (EC 1.14.-.-) (P450-dependent fatty acid omega-hydroxylase) with e-value of 1.2e-116 and BLAST sequence identity of 48.8
  misc_feature: SWISSPROT Homolog: C94A2_VICSA Cytochrome P450 94A2 (EC 1.14.-.-) (P450-dependent fatty acid omega-hydroxylase) with e-value of 1.1e-106 and BLAST sequence identity of 45.0
  misc_feature: SWISSPROT Homolog: C86A1_ARATH Cytochrome P450 86A1 (EC 1.14.-.-) (CYPLXXXVI) (P450-dependent fatty acid omega-hydroxylase) with e-value of 4.1e-86 and BLAST sequence identity of 41.3
  misc_feature: SWISSPROT Homolog: C86A2_ARATH Cytochrome P450 86A2 (EC 1.14.-.-) with e-value of 9.3e-80 and BLAST sequence identity of 42.6
  misc_feature: SWISSPROT Homolog: CP52E_CANMA Cytochrome P450 52A5 (EC 1.14.14.-) (CYPLIIA5) (Alkane-inducible P450-ALK2-A) (CYP52A3-B) with e-value of 3.5e-41 and BLAST sequence identity of 27.9
  misc_feature 347906:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Serrate Margins Useful for making plants with increased biomass and foliage
  misc_feature (1)..(490): Functional Homolog of  Ceres CLONE ID no. 534397 at SEQ ID NO. 3156 with e-value of 1.39E-105 and BLAST sequence identity of 49.5
MDFVAAFSFLFFGFTILFSMFSFLIYVWRLKPWCNCDVCKAYLSASWTKDFTNLCDWYTHLLRNSKTGTIHLHVLGNIITANPENVEHMVKTKFDNYPKGKPFSDLLGDLLGRGIFNVDGDSWKFQRKMASLELGSVSIRMYAFDLIITEIRKRLLPLLSSAAAKQEVLDLQDVFRRFSFDNICKFSFGLDPGCLELSLPVCEFALAFDAASKLSAERAIAASPMVWKIKRLLNIGSERELKEAIKKVDELAERMINQKRKEGFSNISDLLSRFMTSISDDRYLRDIVISFLLAGRDTVASGLTSFFWILSQHPEVVSAIREEIEKVTGPNQELPNFQEMLQMHYLNAAIYESLRLYPPVQFDSKFAQEDDILPDGTFMPKGTRATYHQYAMGRMEEIWGPDCLAFKPERWLKKGVFEPANPFKYTVFHAGHRICIGKELALVEMKTVALAIIRGFNTVVEDPNQVPRFIPGFTATVRGGLPVLIQEREA

SEQ ID NO: 3126 - DNA, 1395 bp, Populus balsamifera subsp. trichocarpa
  misc_feature (1)..(1395): Ceres ANNOT ID no. 1440343
  misc_feature 348046:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Serrate Margins Useful for making plants with increased biomass and foliage
atgttggaactctcctttcttatcttgtttctcacttccatttcagtcctcatcttcatttgcttcttccgctccacttctcaccctccaagcaaaaccccatgtccagaatcttaccctataataggaatcctccccggcctcctccgcaaccgccaccgcttccacgactgggtcgctgacatgctctccaaaaccccatcatcgactctccaagtcaacaactttctcaacctctcccatatcatctgcactgccaaccctgtcaatgtagagcacctccttgtcaccaacttctctaactatatcaaaggttgtcgttatcttgactatctccaagaactccttggccatggaatctttaacgttgatggtcacctctggactgtacaacgtaagattgctagccatgaattcaacactaaatctctcaaacacttcgtatcagatatagtcaaatctgaactgtccaaaagtctcatgccagacttattcaaagcatgtgatcacaacttgatcatcgatatgcaagaggtgttgcaaaagttcactttcactaacttatgcaaagttgcttttggggttgaccctgaatccatgtcaaatttaacttttgttgaggcttttgatgatgctgtggaaattgggttttcaagatttatggctccacttcctgcgttatggaagcttcaaagatccttgaatataggatcagagaagagacttaaagaagctgttaaagtgattaatgagtttgcttgggaggactcaacttcaacagctttaacatggttttttcggttaattgctggcaaccctcattgtgggtctttgatttacaaagaaatatcatcggccgccccgctgcccgcggcagattcaagggcaaggatttttagctacgaagagttgaagaattttcactatttgcacgctgctctatcagaatcaatgaggttgtttccacctgtaccaatcaattcaagatcaacggtggaggatgatatattaccagatgggacctatgttaggaaagggtggtttgctgattactctgcttatgcaatgggtaggatggagaaagtgtggggtccggattgcagggagtttaagcctgagaggtggttagatagtgatggagtgtatcaaccgtttgatcaatttagatatcctgtgtttcattgcggtcccaggatgtgtttggggaagcaaatggcttatatccaaatgaaggcaatagctgcagctgtgatgcatgagtttgagatcttgcctgttgatggaggcgccaccgcaaagaaaatgatgaacccaccttacagattaaccatggttctcaagatgagagggggcttgcctgttaggctgaagaggagagtgacatctcaacaatga

SEQ ID NO: 3127 - protein, 464 aa, Populus balsamifera subsp. trichocarpa
  misc_feature (1)..(464): Ceres ANNOT ID no. 1440343
  misc_feature (116)..(253): Pfam Name: p450 Pfam Description: Cytochrome P450
  misc_feature: SWISSPROT Homolog: C94A1_VICSA Cytochrome P450 94A1 (EC 1.14.-.-) (P450-dependent fatty acid omega-hydroxylase) with e-value of 1.2e-116 and BLAST sequence identity of 48.8
  misc_feature: SWISSPROT Homolog: C94A2_VICSA Cytochrome P450 94A2 (EC 1.14.-.-) (P450-dependent fatty acid omega-hydroxylase) with e-value of 1.1e-106 and BLAST sequence identity of 45.0
  misc_feature: SWISSPROT Homolog: C86A1_ARATH Cytochrome P450 86A1 (EC 1.14.-.-) (CYPLXXXVI) (P450-dependent fatty acid omega-hydroxylase) with e-value of 4.1e-86 and BLAST sequence identity of 41.3
  misc_feature: SWISSPROT Homolog: C86A2_ARATH Cytochrome P450 86A2 (EC 1.14.-.-) with e-value of 9.3e-80 and BLAST sequence identity of 42.6
  misc_feature: SWISSPROT Homolog: CP52E_CANMA Cytochrome P450 52A5 (EC 1.14.14.-) (CYPLIIA5) (Alkane-inducible P450-ALK2-A) (CYP52A3-B) with e-value of 3.5e-41 and BLAST sequence identity of 27.9
  misc_feature 348179:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Serrate Margins Useful for making plants with increased biomass and foliage
  misc_feature (1)..(464): Functional Homolog of  Ceres CLONE ID no. 534397 at SEQ ID NO. 3156 with e-value of 5.10E-94 and BLAST sequence identity of 50.2
MLELSFLILFLTSISVLIFICFFRSTSHPPSKTPCPESYPIIGILPGLLRNRHRFHDWVADMLSKTPSSTLQVNNFLNLSHIICTANPVNVEHLLVTNFSNYIKGCRYLDYLQELLGHGIFNVDGHLWTVQRKIASHEFNTKSLKHFVSDIVKSELSKSLMPDLFKACDHNLIIDMQEVLQKFTFTNLCKVAFGVDPESMSNLTFVEAFDDAVEIGFSRFMAPLPALWKLQRSLNIGSEKRLKEAVKVINEFAWEDSTSTALTWFFRLIAGNPHCGSLIYKEISSAAPLPAADSRARIFSYEELKNFHYLHAALSESMRLFPPVPINSRSTVEDDILPDGTYVRKGWFADYSAYAMGRMEKVWGPDCREFKPERWLDSDGVYQPFDQFRYPVFHCGPRMCLGKQMAYIQMKAIAAAVMHEFEILPVDGGATAKKMMNPPYRLTMVLKMRGGLPVRLKRRVTSQQ

SEQ ID NO: 3128 - DNA, 1398 bp, Populus balsamifera subsp. trichocarpa
  misc_feature (1)..(1398): Ceres ANNOT ID no. 1493212
  misc_feature 348316:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Serrate Margins Useful for making plants with increased biomass and foliage
atgatgttggaactctcctttcttatcttgtttctcacttccatttcagtcctcatcttcatttgcttcttccgctccacttctcaccctccaagcaaaaccccatgtccagaatcttaccctataataggaatcctccccggcctcctccgcaaccgccaccgcttccacgactgggtcgctgacatgctctccaaaaccccatcatcgactctccaagtcaacaactttctcaacctctcccatatcatctgcactgccaaccctgtcaatgtagagcacctccttgtcaccaacttctctaactatatcaaaggttgtcgttatcttgactatctccaagaactccttggccatggaatctttaacgttgatggtcacctctggactgtacaacgtaagattgctagccatgaattcaacactaaatctctcaaacacttcgtatcagatatagtcaaatctgaactgtccaaaagtctcatgccagacttattcaaagcatgtgatcacaacttgatcatcgatatgcaagaggtgttgcaaaagttcactttcactaacttatgcaaagttgcttttggggttgaccctgaatccatgtcaaatttaacttttgttgaggcttttgatgatgctgtggaaattgggttttcaagatttatggctccacttcctgcgttatggaagcttcaaagatccttgaatataggatcagagaagagacttaaagaagctgttaaagtgattaatgagtttgcttgggaggactcaacttcaacagctttaacatggttttttcggttaattgctggcaaccctcattgtgggtctttgatttacaaagaaatatcatcggccgccccgctgcccgcggcagattcaagggcaaggatttttagctacgaagagttgaagaattttcactatttgcacgctgctctatcagaatcaatgaggttgtttccacctgtaccaatcaattcaagatcaacggtggaggatgatatattaccagatgggacctatgttaggaaagggtggtttgctgattactctgcttatgcaatgggtaggatggagaaagtgtggggtccggattgcagggagtttaagcctgagaggtggttagatagtgatggagtgtatcaaccgtttgatcaatttagatatcctgtgtttcattgcggtcccaggatgtgtttggggaagcaaatggcttatatccaaatgaaggcaatagctgcagctgtgatgcatgagtttgagatcttgcctgttgatggaggcgccaccgcaaagaaaatgatgaacccaccttacagattaaccatggttctcaagatgagagggggcttgcctgttaggctgaagaggagagtgacatctcaacaatga

SEQ ID NO: 3129 - protein, 465 aa, Populus balsamifera subsp. trichocarpa
  misc_feature (1)..(465): Ceres ANNOT ID no. 1493212
  misc_feature (117)..(254): Pfam Name: p450 Pfam Description: Cytochrome P450
  misc_feature: SWISSPROT Homolog: C94A1_VICSA Cytochrome P450 94A1 (EC 1.14.-.-) (P450-dependent fatty acid omega-hydroxylase) with e-value of 1.2e-116 and BLAST sequence identity of 48.8
  misc_feature: SWISSPROT Homolog: C94A2_VICSA Cytochrome P450 94A2 (EC 1.14.-.-) (P450-dependent fatty acid omega-hydroxylase) with e-value of 1.1e-106 and BLAST sequence identity of 45.0
  misc_feature: SWISSPROT Homolog: C86A1_ARATH Cytochrome P450 86A1 (EC 1.14.-.-) (CYPLXXXVI) (P450-dependent fatty acid omega-hydroxylase) with e-value of 4.1e-86 and BLAST sequence identity of 41.3
  misc_feature: SWISSPROT Homolog: C86A2_ARATH Cytochrome P450 86A2 (EC 1.14.-.-) with e-value of 9.3e-80 and BLAST sequence identity of 42.6
  misc_feature: SWISSPROT Homolog: CP52E_CANMA Cytochrome P450 52A5 (EC 1.14.14.-) (CYPLIIA5) (Alkane-inducible P450-ALK2-A) (CYP52A3-B) with e-value of 3.5e-41 and BLAST sequence identity of 27.9
  misc_feature 348449:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Serrate Margins Useful for making plants with increased biomass and foliage
  misc_feature (1)..(465): Functional Homolog of  Ceres CLONE ID no. 534397 at SEQ ID NO. 3156 with e-value of 5.10E-94 and BLAST sequence identity of 50.2
MMLELSFLILFLTSISVLIFICFFRSTSHPPSKTPCPESYPIIGILPGLLRNRHRFHDWVADMLSKTPSSTLQVNNFLNLSHIICTANPVNVEHLLVTNFSNYIKGCRYLDYLQELLGHGIFNVDGHLWTVQRKIASHEFNTKSLKHFVSDIVKSELSKSLMPDLFKACDHNLIIDMQEVLQKFTFTNLCKVAFGVDPESMSNLTFVEAFDDAVEIGFSRFMAPLPALWKLQRSLNIGSEKRLKEAVKVINEFAWEDSTSTALTWFFRLIAGNPHCGSLIYKEISSAAPLPAADSRARIFSYEELKNFHYLHAALSESMRLFPPVPINSRSTVEDDILPDGTYVRKGWFADYSAYAMGRMEKVWGPDCREFKPERWLDSDGVYQPFDQFRYPVFHCGPRMCLGKQMAYIQMKAIAAAVMHEFEILPVDGGATAKKMMNPPYRLTMVLKMRGGLPVRLKRRVTSQQ

SEQ ID NO: 3130 - protein, 143 aa, Glycine max
  misc_feature (1)..(143): Ceres CLONE ID no. 536457
  misc_feature (38)..(109): Pfam Name: RRM_1 Pfam Description: RNA recognition motif. (a.k.a. RRM RBD, or RNP domain)
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
MAFCNKVGNVLRQGAARSTHAPVASMLNYIRCMSSSKLFIGGLSYGVDDQSLKDAFSGFGDVVDAKVITDRDSGRSRGFGFVNFSNDESASSALSAMDGKDLNGRSIRVSYANDKPSAPRPGGGGGYRGGDYDGDFASRSGGW

SEQ ID NO: 3131 - DNA, 396 bp, Populus balsamifera subsp. trichocarpa; identical to SEQ ID NO: 733
  misc_feature (1)..(396): Ceres ANNOT ID no. 1490030
  misc_feature 348656:<222: Transcription Factor
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size

SEQ ID NO: 3132 - protein, 131 aa, Populus balsamifera subsp. trichocarpa; identical to SEQ ID NO: 734
  misc_feature (1)..(131): Ceres ANNOT ID no. 1490030
  misc_feature (38)..(109): Pfam Name: RRM_1 Pfam Description: RNA recognition motif. (a.k.a. RRM RBD, or RNP domain)
  misc_feature: SWISSPROT Homolog: GRP2_ARATH Glycine-rich RNA-binding protein 2, (AtGRP2) with e-value of 2.6e-43 and BLAST sequence identity of 62.5
  misc_feature: SWISSPROT Homolog: RT19_ARATH 40S ribosomal protein S19, with e-value of 2.3e-28 and BLAST sequence identity of 54.6
  misc_feature: SWISSPROT Homolog: GRP7_ARATH Glycine-rich RNA-binding protein 7 with e-value of 1.9e-24 and BLAST sequence identity of 47.8
  misc_feature: SWISSPROT Homolog: GRP2_SINAL Glycine-rich RNA-binding protein GRP2A with e-value of 4.0e-24 and BLAST sequence identity of 49.1
  misc_feature: SWISSPROT Homolog: GRP2_SORBI Glycine-rich RNA-binding protein 2 with e-value of 1.1e-23 and BLAST sequence identity of 48.1
  misc_feature 348752:<222: Transcription Factor
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature (1)..(131): Functional Homolog of  Ceres CLONE ID no. 536457 at SEQ ID NO. 3177 with e-value of 9.10E-40 and BLAST sequence identity of 65.3

SEQ ID NO: 3133 - DNA, 438 bp, Populus balsamifera subsp. trichocarpa; identical to SEQ ID NO: 318
  misc_feature (1)..(438): Ceres ANNOT ID no. 1493787
  misc_feature 348826:<222: Transcription Factor
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size

SEQ ID NO: 3134 - protein, 145 aa, Populus balsamifera subsp. trichocarpa; identical to SEQ ID NO: 319
  misc_feature (1)..(145): Ceres ANNOT ID no. 1493787
  misc_feature (38)..(109): Pfam Name: RRM_1 Pfam Description: RNA recognition motif. (a.k.a. RRM RBD, or RNP domain)
  misc_feature: SWISSPROT Homolog: GRP2_ARATH Glycine-rich RNA-binding protein 2, (AtGRP2) with e-value of 2.6e-43 and BLAST sequence identity of 62.5
  misc_feature: SWISSPROT Homolog: RT19_ARATH 40S ribosomal protein S19, with e-value of 2.3e-28 and BLAST sequence identity of 54.6
  misc_feature: SWISSPROT Homolog: GRP7_ARATH Glycine-rich RNA-binding protein 7 with e-value of 1.9e-24 and BLAST sequence identity of 47.8
  misc_feature: SWISSPROT Homolog: GRP2_SINAL Glycine-rich RNA-binding protein GRP2A with e-value of 4.0e-24 and BLAST sequence identity of 49.1
  misc_feature: SWISSPROT Homolog: GRP2_SORBI Glycine-rich RNA-binding protein 2 with e-value of 1.1e-23 and BLAST sequence identity of 48.1
  misc_feature 348924:<222: Transcription Factor
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature (1)..(145): Functional Homolog of  Ceres CLONE ID no. 536457 at SEQ ID NO. 3177 with e-value of 2.59E-35 and BLAST sequence identity of 61.7

SEQ ID NO: 3135 - protein, 120 aa, Glycine max
  misc_feature (1)..(120): Ceres CLONE ID no. 536726
  misc_feature (14)..(117): Pfam Name: MAP1_LC3 Pfam Description: Microtubule associated protein 1A/1B light chain 3
  misc_feature: Phenotype: INFLORESCENCE - Early Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
MAKSSFKMEHPLERRQAEASRIREKYPERIPVIVERAEKSDVPEIDKKKYLVPADLTVGQFVYVVRKRIKLSPEKAIFIFVKNILPPTAAMMSAIYEENKDEDGFLYMTYSGENTFGLVF

SEQ ID NO: 3136 - DNA, 360 bp, Populus balsamifera subsp. trichocarpa
  misc_feature (1)..(360): Ceres ANNOT ID no. 1498226
  misc_feature 349110:<222: Transcription Factor
  misc_feature: Phenotype: INFLORESCENCE - Early Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
atggctaaaagctcctttaagatggaacaccctctcgaaaggaggcaggcagaagctggtcgcatcagagacaaatatcctgatagaattcctgtgattgtggaaagggctgagaagagtgatgtccctgacattgacaagaaaaagtacttggttcctgctgatctcactgttggccaatttgtgtacgtggttcggaaaaggatcaagctcagtccagagaaggctattttcatcttcgtgaagaatattctaccacctactgctgccatgatgtcagcaatatacgaggaaaacaaggatgaagatggatttctttacatgacatacagcggtgaaaacacatttggggtctattga

SEQ ID NO: 3137 - protein, 119 aa, Populus balsamifera subsp. trichocarpa
  misc_feature (1)..(119): Ceres ANNOT ID no. 1498226
  misc_feature (14)..(117): Pfam Name: MAP1_LC3 Pfam Description: Microtubule associated protein 1A/1B light chain 3
  misc_feature: SWISSPROT Homolog: ATG8_PHYIN Autophagy-related protein 8 precursor (Autophagy-related ubiquitin-like modifier ATG8) with e-value of 2.2e-48 and BLAST sequence identity of 81.6
  misc_feature: SWISSPROT Homolog: ATG8_ASPFU Autophagy-related protein 8 precursor (Autophagy-related ubiquitin-like modifier atg8) with e-value of 1.7e-46 and BLAST sequence identity of 79.1
  misc_feature: SWISSPROT Homolog: ATG8_NEUCR Autophagy-related protein 8 precursor (Autophagy-related ubiquitin-like modifier atg-8) with e-value of 1.7e-46 and BLAST sequence identity of 79.1
  misc_feature: SWISSPROT Homolog: ATG8_PODAN Autophagy-related protein 8 precursor with e-value of 1.7e-46 and BLAST sequence identity of 79.1
  misc_feature: SWISSPROT Homolog: ATG8_PODAN Autophagy-related ubiquitin-like modifier ATG8 Induced during the incompatibility reaction protein 7
  misc_feature: SWISSPROT Homolog: ATG8_LACBI Autophagy-related protein 8 precursor (Autophagy-related ubiquitin-like modifier ATG8) with e-value of 2.8e-46 and BLAST sequence identity of 76.5
  misc_feature 349259:<222: Transcription Factor
  misc_feature: Phenotype: INFLORESCENCE - Early Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
  misc_feature (1)..(119): Functional Homolog of  Ceres CLONE ID no. 536726 at SEQ ID NO. 3182 with e-value of 7.89E-57 and BLAST sequence identity of 95.7
MAKSSFKMEHPLERRQAEAGRIRDKYPDRIPVIVERAEKSDVPDIDKKKYLVPADLTVGQFVYVVRKRIKLSPEKAIFIFVKNILPPTAAMMSAIYEENKDEDGFLYMTYSGENTFGVY

SEQ ID NO: 3138 - DNA, 366 bp, Populus balsamifera subsp. trichocarpa
  misc_feature (1)..(366): Ceres ANNOT ID no. 1445243
  misc_feature 349372:<222: Transcription Factor
  misc_feature: Phenotype: INFLORESCENCE - Early Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
atggcgatggctaaaagctcctttaagatggaacaccctctcgaaaggaggcaggcagaagctggtcgcatcagagacaaatatcctgatagaattcctgtgattgtggaaagggctgagaagagtgatgtccctgacattgacaagaaaaagtacttggttcctgctgatctcactgttggccaatttgtgtacgtggttcggaaaaggatcaagctcagtccagagaaggctattttcatcttcgtgaagaatattctaccacctactgctgccatgatgtcagcaatatacgaggaaaacaaggatgaagatggatttctttacatgacatacagcggtgaaaacacatttggggtctattga

SEQ ID NO: 3139 - protein, 121 aa, Populus balsamifera subsp. trichocarpa
  misc_feature (1)..(121): Ceres ANNOT ID no. 1445243
  misc_feature (16)..(119): Pfam Name: MAP1_LC3 Pfam Description: Microtubule associated protein 1A/1B light chain 3
  misc_feature: SWISSPROT Homolog: ATG8_PHYIN Autophagy-related protein 8 precursor (Autophagy-related ubiquitin-like modifier ATG8) with e-value of 2.2e-48 and BLAST sequence identity of 81.6
  misc_feature: SWISSPROT Homolog: ATG8_ASPFU Autophagy-related protein 8 precursor (Autophagy-related ubiquitin-like modifier atg8) with e-value of 1.7e-46 and BLAST sequence identity of 79.1
  misc_feature: SWISSPROT Homolog: ATG8_NEUCR Autophagy-related protein 8 precursor (Autophagy-related ubiquitin-like modifier atg-8) with e-value of 1.7e-46 and BLAST sequence identity of 79.1
  misc_feature: SWISSPROT Homolog: ATG8_PODAN Autophagy-related protein 8 precursor with e-value of 1.7e-46 and BLAST sequence identity of 79.1
  misc_feature: SWISSPROT Homolog: ATG8_PODAN Autophagy-related ubiquitin-like modifier ATG8 Induced during the incompatibility reaction protein 7
  misc_feature: SWISSPROT Homolog: ATG8_LACBI Autophagy-related protein 8 precursor (Autophagy-related ubiquitin-like modifier ATG8) with e-value of 2.8e-46 and BLAST sequence identity of 76.5
  misc_feature 349521:<222: Transcription Factor
  misc_feature: Phenotype: INFLORESCENCE - Early Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
  misc_feature (1)..(121): Functional Homolog of  Ceres CLONE ID no. 536726 at SEQ ID NO. 3182 with e-value of 7.89E-57 and BLAST sequence identity of 95.7
MAMAKSSFKMEHPLERRQAEAGRIRDKYPDRIPVIVERAEKSDVPDIDKKKYLVPADLTVGQFVYVVRKRIKLSPEKAIFIFVKNILPPTAAMMSAIYEENKDEDGFLYMTYSGENTFGVY

SEQ ID NO: 3140 - DNA, 363 bp, Populus balsamifera subsp. trichocarpa
  misc_feature (1)..(363): Ceres ANNOT ID no. 1525386
  misc_feature 349634:<222: Transcription Factor
  misc_feature: Phenotype: INFLORESCENCE - Early Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
atggctaaaagctcgttcaagatggaacatcctctcgaaaggaggcaggcagaagctgctcgcatcagagaaaaatatcctgatagaattcctgtgattgtggaaagggctgagaagagtgatgtccctgacattgacaagaaaaatagatatttggttcctgctgatctcactgttggccaattcgtgtacgtggtccgaaaaaggatcaagctcagtccagagaaggctattttcatcttcgtgaagaacattctaccaccaactgctgccatgatgtcagcaatatatgaggaaaacaaggatgaagatgggttcctttacatgagctacagtggtgagaacacatttggggtctattga

SEQ ID NO: 3141 - protein, 120 aa, Populus balsamifera subsp. trichocarpa
  misc_feature (1)..(120): Ceres ANNOT ID no. 1525386
  misc_feature (14)..(118): Pfam Name: MAP1_LC3 Pfam Description: Microtubule associated protein 1A/1B light chain 3
  misc_feature: SWISSPROT Homolog: ATG8_PHYIN Autophagy-related protein 8 precursor (Autophagy-related ubiquitin-like modifier ATG8) with e-value of 2.2e-48 and BLAST sequence identity of 81.6
  misc_feature: SWISSPROT Homolog: ATG8_ASPFU Autophagy-related protein 8 precursor (Autophagy-related ubiquitin-like modifier atg8) with e-value of 1.7e-46 and BLAST sequence identity of 79.1
  misc_feature: SWISSPROT Homolog: ATG8_NEUCR Autophagy-related protein 8 precursor (Autophagy-related ubiquitin-like modifier atg-8) with e-value of 1.7e-46 and BLAST sequence identity of 79.1
  misc_feature: SWISSPROT Homolog: ATG8_PODAN Autophagy-related protein 8 precursor with e-value of 1.7e-46 and BLAST sequence identity of 79.1
  misc_feature: SWISSPROT Homolog: ATG8_PODAN Autophagy-related ubiquitin-like modifier ATG8 Induced during the incompatibility reaction protein 7
  misc_feature: SWISSPROT Homolog: ATG8_LACBI Autophagy-related protein 8 precursor (Autophagy-related ubiquitin-like modifier ATG8) with e-value of 2.8e-46 and BLAST sequence identity of 76.5
  misc_feature 349783:<222: Transcription Factor
  misc_feature: Phenotype: INFLORESCENCE - Early Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
  misc_feature (1)..(120): Functional Homolog of  Ceres CLONE ID no. 536726 at SEQ ID NO. 3182 with e-value of 1.50E-55 and BLAST sequence identity of 94.9
MAKSSFKMEHPLERRQAEAARIREKYPDRIPVIVERAEKSDVPDIDKKNRYLVPADLTVGQFVYVVRKRIKLSPEKAIFIFVKNILPPTAAMMSAIYEENKDEDGFLYMSYSGENTFGVY

SEQ ID NO: 3142 - DNA, 360 bp, Populus balsamifera subsp. trichocarpa
  misc_feature (1)..(360): Ceres ANNOT ID no. 1448522
  misc_feature 349896:<222: Transcription Factor
  misc_feature: Phenotype: INFLORESCENCE - Early Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
atggatagaagttcattcaagcttgatcatactttggagaggaggcaagcagaagcttctcgcatcagagagaaatatcctgatagagtacctgtgattgtggaaagggctgaaaggagtgatatccctgacattgataagaagaaatatctcgtgccagccgatttgactgtgggtcagtttgtttatgttgtccggaaaaggatcaagctcggtcctgagaaggctatatttgtctttgtaaaaaacactctgccttctaccgcttcattgatgtctgcaatctatgaggaaaacaaggatgaagatggttttctttacatgacatacagtggggagaatacctttggattgcactag

SEQ ID NO: 3143 - protein, 119 aa, Populus balsamifera subsp. trichocarpa
  misc_feature (1)..(119): Ceres ANNOT ID no. 1448522
  misc_feature (14)..(117): Pfam Name: MAP1_LC3 Pfam Description: Microtubule associated protein 1A/1B light chain 3
  misc_feature: SWISSPROT Homolog: ATG8_PHYIN Autophagy-related protein 8 precursor (Autophagy-related ubiquitin-like modifier ATG8) with e-value of 2.2e-48 and BLAST sequence identity of 81.6
  misc_feature: SWISSPROT Homolog: ATG8_ASPFU Autophagy-related protein 8 precursor (Autophagy-related ubiquitin-like modifier atg8) with e-value of 1.7e-46 and BLAST sequence identity of 79.1
  misc_feature: SWISSPROT Homolog: ATG8_NEUCR Autophagy-related protein 8 precursor (Autophagy-related ubiquitin-like modifier atg-8) with e-value of 1.7e-46 and BLAST sequence identity of 79.1
  misc_feature: SWISSPROT Homolog: ATG8_PODAN Autophagy-related protein 8 precursor with e-value of 1.7e-46 and BLAST sequence identity of 79.1
  misc_feature: SWISSPROT Homolog: ATG8_PODAN Autophagy-related ubiquitin-like modifier ATG8 Induced during the incompatibility reaction protein 7
  misc_feature: SWISSPROT Homolog: ATG8_LACBI Autophagy-related protein 8 precursor (Autophagy-related ubiquitin-like modifier ATG8) with e-value of 2.8e-46 and BLAST sequence identity of 76.5
  misc_feature 350045:<222: Transcription Factor
  misc_feature: Phenotype: INFLORESCENCE - Early Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
  misc_feature (1)..(119): Functional Homolog of  Ceres CLONE ID no. 536726 at SEQ ID NO. 3182 with e-value of 2.20E-52 and BLAST sequence identity of 86.4
MDRSSFKLDHTLERRQAEASRIREKYPDRVPVIVERAERSDIPDIDKKKYLVPADLTVGQFVYVVRKRIKLGPEKAIFVFVKNTLPSTASLMSAIYEENKDEDGFLYMTYSGENTFGLH

SEQ ID NO: 3144 - DNA, 360 bp, Populus balsamifera subsp. trichocarpa
  misc_feature (1)..(360): Ceres ANNOT ID no. 1465506
  misc_feature 350158:<222: Transcription Factor
  misc_feature: Phenotype: INFLORESCENCE - Early Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
atgtctaaaagttcattcaagcttgatcatgctttggagaggaggcaagcagaagcttctcgcatcagagagaaacatcctgatagagtacccgtgattgtggaaaaggctggaaggagtgatgtccctgacattgataagaagaaatatctggtgccagctgatttaactgtgggtcagtttgtttatgttgtccgaaaaaggatcaagctcagtcctgaaaaggctatatttgtctttgtaaagaacactctgcctcccactgctacattgatgtctgtactctacgaggaaaacaaggatgaagatggttttctttacatgacatacagcggggagaatacctttggatttcactag

SEQ ID NO: 3145 - protein, 119 aa, Populus balsamifera subsp. trichocarpa
  misc_feature (1)..(119): Ceres ANNOT ID no. 1465506
  misc_feature (14)..(117): Pfam Name: MAP1_LC3 Pfam Description: Microtubule associated protein 1A/1B light chain 3
  misc_feature: SWISSPROT Homolog: ATG8_PHYIN Autophagy-related protein 8 precursor (Autophagy-related ubiquitin-like modifier ATG8) with e-value of 2.2e-48 and BLAST sequence identity of 81.6
  misc_feature: SWISSPROT Homolog: ATG8_ASPFU Autophagy-related protein 8 precursor (Autophagy-related ubiquitin-like modifier atg8) with e-value of 1.7e-46 and BLAST sequence identity of 79.1
  misc_feature: SWISSPROT Homolog: ATG8_NEUCR Autophagy-related protein 8 precursor (Autophagy-related ubiquitin-like modifier atg-8) with e-value of 1.7e-46 and BLAST sequence identity of 79.1
  misc_feature: SWISSPROT Homolog: ATG8_PODAN Autophagy-related protein 8 precursor with e-value of 1.7e-46 and BLAST sequence identity of 79.1
  misc_feature: SWISSPROT Homolog: ATG8_PODAN Autophagy-related ubiquitin-like modifier ATG8 Induced during the incompatibility reaction protein 7
  misc_feature: SWISSPROT Homolog: ATG8_LACBI Autophagy-related protein 8 precursor (Autophagy-related ubiquitin-like modifier ATG8) with e-value of 2.8e-46 and BLAST sequence identity of 76.5
  misc_feature 350307:<222: Transcription Factor
  misc_feature: Phenotype: INFLORESCENCE - Early Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
  misc_feature (1)..(119): Functional Homolog of  Ceres CLONE ID no. 536726 at SEQ ID NO. 3182 with e-value of 1.20E-51 and BLAST sequence identity of 85.4
MSKSSFKLDHALERRQAEASRIREKHPDRVPVIVEKAGRSDVPDIDKKKYLVPADLTVGQFVYVVRKRIKLSPEKAIFVFVKNTLPPTATLMSVLYEENKDEDGFLYMTYSGENTFGFH

SEQ ID NO: 3146 - DNA, 369 bp, Populus balsamifera subsp. trichocarpa
  misc_feature (1)..(369): Ceres ANNOT ID no. 1497017
  misc_feature 350420:<222: Transcription Factor
  misc_feature: Phenotype: INFLORESCENCE - Early Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
atgactaagagcagcttcaagcaagagcatgattttgagaagaggagagctgaagctgcgagaatcagggagaaatacccagacagaattccggtaattgtggagaaggctgagagaagtgatattcccaatattgacaagaaaaaatatctagttcctgctgacctgactgtgggtcaatttgtttatgtgatccggaagagaattaaactgagtgcagaaaaggcaatttttatatttgtggacaatgttctcccaccaaccggagcaataatgtccacaatctatgatgaaaacaaggatgaagatggatttctctatgttacatacagtggggaaaacacatttgggtgtcatgagttgccatag

SEQ ID NO: 3147 - protein, 122 aa, Populus balsamifera subsp. trichocarpa
  misc_feature (1)..(122): Ceres ANNOT ID no. 1497017
  misc_feature (14)..(117): Pfam Name: MAP1_LC3 Pfam Description: Microtubule associated protein 1A/1B light chain 3
  misc_feature: SWISSPROT Homolog: ATG8_PHYIN Autophagy-related protein 8 precursor (Autophagy-related ubiquitin-like modifier ATG8) with e-value of 2.2e-48 and BLAST sequence identity of 81.6
  misc_feature: SWISSPROT Homolog: ATG8_ASPFU Autophagy-related protein 8 precursor (Autophagy-related ubiquitin-like modifier atg8) with e-value of 1.7e-46 and BLAST sequence identity of 79.1
  misc_feature: SWISSPROT Homolog: ATG8_NEUCR Autophagy-related protein 8 precursor (Autophagy-related ubiquitin-like modifier atg-8) with e-value of 1.7e-46 and BLAST sequence identity of 79.1
  misc_feature: SWISSPROT Homolog: ATG8_PODAN Autophagy-related protein 8 precursor with e-value of 1.7e-46 and BLAST sequence identity of 79.1
  misc_feature: SWISSPROT Homolog: ATG8_PODAN Autophagy-related ubiquitin-like modifier ATG8 Induced during the incompatibility reaction protein 7
  misc_feature: SWISSPROT Homolog: ATG8_LACBI Autophagy-related protein 8 precursor (Autophagy-related ubiquitin-like modifier ATG8) with e-value of 2.8e-46 and BLAST sequence identity of 76.5
  misc_feature 350569:<222: Transcription Factor
  misc_feature: Phenotype: INFLORESCENCE - Early Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
  misc_feature (1)..(122): Functional Homolog of  Ceres CLONE ID no. 536726 at SEQ ID NO. 3182 with e-value of 1.59E-49 and BLAST sequence identity of 82.0
MTKSSFKQEHDFEKRRAEAARIREKYPDRIPVIVEKAERSDIPNIDKKKYLVPADLTVGQFVYVIRKRIKLSAEKAIFIFVDNVLPPTGAIMSTIYDENKDEDGFLYVTYSGENTFGCHELP

SEQ ID NO: 3148 - DNA, 369 bp, Populus balsamifera subsp. trichocarpa
  misc_feature (1)..(369): Ceres ANNOT ID no. 1447240
  misc_feature 350682:<222: Transcription Factor
  misc_feature: Phenotype: INFLORESCENCE - Early Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
atggcaaagagttatttcaagcaagagcatgatcttgagaagaggagggcagaggctgctaggatcagggagaagtacccagataggattccggtgattgtggagaaggcagaaagaagtgatataccaaacatagacaagaaaaagtaccttgttccggctgacctgactgtggggcagtttgtctatgtcatccgcaaaaggatcaagttgagcgcagaaaaggcaatctttatatttgtggataatgtcctcccaccaacaggtgctatcatgtcttccatatatgaagagaaaaaggatgaagatgggtttctctatgttacctacagcggagagaacactttcggaactcagattccactgtag

SEQ ID NO: 3149 - protein, 122 aa, Populus balsamifera subsp. trichocarpa
  misc_feature (1)..(122): Ceres ANNOT ID no. 1447240
  misc_feature (14)..(117): Pfam Name: MAP1_LC3 Pfam Description: Microtubule associated protein 1A/1B light chain 3
  misc_feature: SWISSPROT Homolog: ATG8_PHYIN Autophagy-related protein 8 precursor (Autophagy-related ubiquitin-like modifier ATG8) with e-value of 2.2e-48 and BLAST sequence identity of 81.6
  misc_feature: SWISSPROT Homolog: ATG8_ASPFU Autophagy-related protein 8 precursor (Autophagy-related ubiquitin-like modifier atg8) with e-value of 1.7e-46 and BLAST sequence identity of 79.1
  misc_feature: SWISSPROT Homolog: ATG8_NEUCR Autophagy-related protein 8 precursor (Autophagy-related ubiquitin-like modifier atg-8) with e-value of 1.7e-46 and BLAST sequence identity of 79.1
  misc_feature: SWISSPROT Homolog: ATG8_PODAN Autophagy-related protein 8 precursor with e-value of 1.7e-46 and BLAST sequence identity of 79.1
  misc_feature: SWISSPROT Homolog: ATG8_PODAN Autophagy-related ubiquitin-like modifier ATG8 Induced during the incompatibility reaction protein 7
  misc_feature: SWISSPROT Homolog: ATG8_LACBI Autophagy-related protein 8 precursor (Autophagy-related ubiquitin-like modifier ATG8) with e-value of 2.8e-46 and BLAST sequence identity of 76.5
  misc_feature 350831:<222: Transcription Factor
  misc_feature: Phenotype: INFLORESCENCE - Early Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
  misc_feature (1)..(122): Functional Homolog of  Ceres CLONE ID no. 536726 at SEQ ID NO. 3182 with e-value of 1.59E-49 and BLAST sequence identity of 82.9
MAKSYFKQEHDLEKRRAEAARIREKYPDRIPVIVEKAERSDIPNIDKKKYLVPADLTVGQFVYVIRKRIKLSAEKAIFIFVDNVLPPTGAIMSSIYEEKKDEDGFLYVTYSGENTFGTQIPL

SEQ ID NO: 3150 - DNA, 369 bp, Populus balsamifera subsp. trichocarpa
  misc_feature (1)..(369): Ceres ANNOT ID no. 1539566
  misc_feature 350944:<222: Transcription Factor
  misc_feature: Phenotype: INFLORESCENCE - Early Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
atgactaagagccgtttcaagcaagagcatgatttcgagaagaggagggctgaaactgcaagaatcagggagaaatacccggacaggattccggtcattgtggagaaggctgagagaagcgatattcccaacattgacaagataaagtacctagtcccggctgacctgacagtcggtcaatttgtttatgtgatccggaagagaattaaactgagtgcagaaaaggcaatttttatatttgtggacaatgtcctcccaccaactggagcaataatgtcgtcaatctatgatgaaaagaaggatgaggatgcatttctctatgtcacatacagtggggaaaacacatttgggtgccagatgttgccatag

SEQ ID NO: 3151 - protein, 122 aa, Populus balsamifera subsp. trichocarpa
  misc_feature (1)..(122): Ceres ANNOT ID no. 1539566
  misc_feature (14)..(117): Pfam Name: MAP1_LC3 Pfam Description: Microtubule associated protein 1A/1B light chain 3
  misc_feature: SWISSPROT Homolog: ATG8_PHYIN Autophagy-related protein 8 precursor (Autophagy-related ubiquitin-like modifier ATG8) with e-value of 2.2e-48 and BLAST sequence identity of 81.6
  misc_feature: SWISSPROT Homolog: ATG8_ASPFU Autophagy-related protein 8 precursor (Autophagy-related ubiquitin-like modifier atg8) with e-value of 1.7e-46 and BLAST sequence identity of 79.1
  misc_feature: SWISSPROT Homolog: ATG8_NEUCR Autophagy-related protein 8 precursor (Autophagy-related ubiquitin-like modifier atg-8) with e-value of 1.7e-46 and BLAST sequence identity of 79.1
  misc_feature: SWISSPROT Homolog: ATG8_PODAN Autophagy-related protein 8 precursor with e-value of 1.7e-46 and BLAST sequence identity of 79.1
  misc_feature: SWISSPROT Homolog: ATG8_PODAN Autophagy-related ubiquitin-like modifier ATG8 Induced during the incompatibility reaction protein 7
  misc_feature: SWISSPROT Homolog: ATG8_LACBI Autophagy-related protein 8 precursor (Autophagy-related ubiquitin-like modifier ATG8) with e-value of 2.8e-46 and BLAST sequence identity of 76.5
  misc_feature 351093:<222: Transcription Factor
  misc_feature: Phenotype: INFLORESCENCE - Early Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
  misc_feature (1)..(122): Functional Homolog of  Ceres CLONE ID no. 536726 at SEQ ID NO. 3182 with e-value of 1.49E-46 and BLAST sequence identity of 77.7
MTKSRFKQEHDFEKRRAETARIREKYPDRIPVIVEKAERSDIPNIDKIKYLVPADLTVGQFVYVIRKRIKLSAEKAIFIFVDNVLPPTGAIMSSIYDEKKDEDAFLYVTYSGENTFGCQMLP

SEQ ID NO: 3152 - DNA, 405 bp, Populus balsamifera subsp. trichocarpa
  misc_feature (1)..(405): Ceres ANNOT ID no. 1444070
  misc_feature 351206:<222: Transcription Factor
  misc_feature: Phenotype: INFLORESCENCE - Early Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
atgactaagagcagcttcaagcaagagcatgattttgagaagaggagagctgaagctgcgagaatcagggagaaatacccagacagaattccggtaattgtggagaaggctgagagaagtgatattcccaatattgacaagaaaaaatatctagttcctgctgacctgactgtgggtcaatttgtttatgtgatccggaagagaattaaactgagtgcagaaaaggcaatttttatatttgtggacaatgttctcccaccaaccgtggggaaaacacatttgggtgtcatgagttgccatagccaagttctttcagtgtcgttacaaattgacaagatgaagctaccacctctcatgtttcctaggacttcaaacagtcctggcattatgccctatgatttatga

SEQ ID NO: 3153 - protein, 134 aa, Populus balsamifera subsp. trichocarpa
  misc_feature (1)..(134): Ceres ANNOT ID no. 1444070
  misc_feature (14)..(95): Pfam Name: MAP1_LC3 Pfam Description: Microtubule associated protein 1A/1B light chain 3
  misc_feature: SWISSPROT Homolog: ATG8_PHYIN Autophagy-related protein 8 precursor (Autophagy-related ubiquitin-like modifier ATG8) with e-value of 2.2e-48 and BLAST sequence identity of 81.6
  misc_feature: SWISSPROT Homolog: ATG8_ASPFU Autophagy-related protein 8 precursor (Autophagy-related ubiquitin-like modifier atg8) with e-value of 1.7e-46 and BLAST sequence identity of 79.1
  misc_feature: SWISSPROT Homolog: ATG8_NEUCR Autophagy-related protein 8 precursor (Autophagy-related ubiquitin-like modifier atg-8) with e-value of 1.7e-46 and BLAST sequence identity of 79.1
  misc_feature: SWISSPROT Homolog: ATG8_PODAN Autophagy-related protein 8 precursor with e-value of 1.7e-46 and BLAST sequence identity of 79.1
  misc_feature: SWISSPROT Homolog: ATG8_PODAN Autophagy-related ubiquitin-like modifier ATG8 Induced during the incompatibility reaction protein 7
  misc_feature: SWISSPROT Homolog: ATG8_LACBI Autophagy-related protein 8 precursor (Autophagy-related ubiquitin-like modifier ATG8) with e-value of 2.8e-46 and BLAST sequence identity of 76.5
  misc_feature 351355:<222: Transcription Factor
  misc_feature: Phenotype: INFLORESCENCE - Early Flowering Useful for modulating flowering time
  misc_feature: Phenotype: FLOWER - Reduced fertility Useful for sterility, genetic confinement systems
  misc_feature: Phenotype: INFLORESCENCE - Short Internode Useful for making modulating plant height and plants with modified flowers
  misc_feature: Phenotype: WHOLE PLANT - Small Useful for modulating plant size
  misc_feature: Phenotype: INFLORESCENCE - Reduced Apical Dominance Useful for modifying plant structure, ie increased branching
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: INFLORESCENCE - Other Useful for making ornamental plants with modified flowers
  misc_feature: Phenotype: ROSETTE LEAVES - Serrate Margins Useful for making plants with increased biomass and foliage
  misc_feature (1)..(134): Functional Homolog of  Ceres CLONE ID no. 536726 at SEQ ID NO. 3182 with e-value of 2.59E-35 and BLAST sequence identity of 81.8
MTKSSFKQEHDFEKRRAEAARIREKYPDRIPVIVEKAERSDIPNIDKKKYLVPADLTVGQFVYVIRKRIKLSAEKAIFIFVDNVLPPTVGKTHLGVMSCHSQVLSVSLQIDKMKLPPLMFPRTSNSPGIMPYDL

SEQ ID NO: 3154 - protein, 177 aa, Glycine max
  misc_feature (1)..(177): Ceres CLONE ID no. 536796
  misc_feature (17)..(80): Pfam Name: AP2 Pfam Description: AP2 domain
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
MMVKPSSEKPEEHRDSKYYKGVRKRKWGKWVSEIRLPNSRQRIWLGSFDTPEKAARAFDAAMFCLRGRNAKFNFPDNPPDIAGGESMTPSQIQVAAAQFANAGPHEGHSGRPEHSPMQSLSPSVSEGTVLTDSDVTTLNGSLTDLFTPVGSSGYASDYGIFPGVDDFSGGFYVPEML

SEQ ID NO: 3155 - DNA, 606 bp, Populus balsamifera subsp. trichocarpa
  misc_feature (1)..(606): Ceres ANNOT ID no. 1484779
  misc_feature 351570:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atggtgaagttcaatacagagaagccagttgcagagagaagtgactcaaaatacaagggtgttagaaaaagaaaatggggccggtgggtgtctgaaatcaggctaccgaatagccgggaaagaatttggttaggatcatatgattcggctgaaaaagcagcacacgctttcgacgcagcccttttctgcttgcgcggcaacacaatgaagtttaatttttcggagaaccctccaaacatagcaggtggcggctcactttctccctctgagattcaagaagctgccgcgaggtttgccaattcggagccccaaagaggccaatccggtaagctcgaggcggatcaatccacatctgtgtccgaatctcgaccggaatcaccttgtctttcggcagcatcagatggtactgtccgagacatgccattttttgatatggcaatgagtacaagttcgagtaatcaccccacagagtatgggatatttccgggttttgacgatcttcacagtggtttttttgcgccatcatttttacccaatcttgatcatggagaggggttcaatctcgatggtgttttggaagaagattcgtttctttggaatttctaa

SEQ ID NO: 3156 - protein, 201 aa, Populus balsamifera subsp. trichocarpa
  misc_feature (1)..(201): Ceres ANNOT ID no. 1484779
  misc_feature (16)..(79): Pfam Name: AP2 Pfam Description: AP2 domain
  misc_feature: SWISSPROT Homolog: TINY_ARATH Transcriptional factor TINY with e-value of 3.7e-21 and BLAST sequence identity of 40.5
  misc_feature: SWISSPROT Homolog: DRE1B_ARATH Dehydration-responsive element-binding protein 1B with e-value of 1.0e-18 and BLAST sequence identity of 40.3
  misc_feature: SWISSPROT Homolog: DRE1B_ARATH DREB1B protein (C-repeat-binding factor 1) C-repeat/dehydration-responsive element-binding factor 1 (CRT/DRE-binding factor 1)
  misc_feature: SWISSPROT Homolog: DRE1A_ARATH Dehydration-responsive element-binding protein 1A with e-value of 7.1e-18 and BLAST sequence identity of 44.1
  misc_feature: SWISSPROT Homolog: DRE1A_ARATH DREB1A protein (C-repeat-binding factor 3) C-repeat/dehydration-responsive element-binding factor 3) (CRT/DRE-binding factor 3)
  misc_feature: SWISSPROT Homolog: DRE1C_ARATH Dehydration-responsive element-binding protein 1C with e-value of 1.5e-17 and BLAST sequence identity of 47.4
  misc_feature: SWISSPROT Homolog: DRE1C_ARATH DREB1C protein (C-repeat-binding factor 2) (C-repeat/dehydration-responsive element-binding factor 2) (CRT/DRE-binding factor 2)
  misc_feature: SWISSPROT Homolog: DRE1D_ARATH Dehydration-responsive element-binding protein 1D with e-value of 1.5e-17 and BLAST sequence identity of 45.9
  misc_feature: SWISSPROT Homolog: DRE1D_ARATH DREB1D protein (C-repeat-binding factor 4) C-repeat/dehydration-responsive element-binding factor 4) (CRT/DRE-binding factor 4)
  misc_feature 351729:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(201): Functional Homolog of  Ceres CLONE ID no. 536796 at SEQ ID NO. 3201 with e-value of 1.09E-48 and BLAST sequence identity of 56.25
MVKFNTEKPVAERSDSKYKGVRKRKWGRWVSEIRLPNSRERIWLGSYDSAEKAAHAFDAALFCLRGNTMKFNFSENPPNIAGGGSLSPSEIQEAAARFANSEPQRGQSGKLEADQSTSVSESRPESPCLSAASDGTVRDMPFFDMAMSTSSSNHPTEYGIFPGFDDLHSGFFAPSFLPNLDHGEGFNLDGVLEEDSFLWNF

SEQ ID NO: 3157 - DNA, 630 bp, Populus balsamifera subsp. trichocarpa
  misc_feature (1)..(630): Ceres ANNOT ID no. 1538185
  misc_feature 351836:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atggtgaagcacagcgtcgagaagccagttgcagagagaagcgactcaaaattcaagggtgttaggaaaagaaaatggggtaagtgggtgtcagaaatcaggctaccgaatagccgggaaagaatttggttagggtcgtatgattctgcagaaaaggccgcacgagccttcgatgccgcccttttctgcttacgcggtcgagttgcgaaatttaattttccggagaaccctccaaacatagcgggtggcaggtcactttctccagctgagattcaagaagctgcagcaaggtttgccaattcggagcctcagagaagccaaccggaccggtttgaaacagatcaatccgtatctgtatccgaatctcgagcagaatctccctgtccttcggttgtatctgatgggactgtccagatggaaggtggtgaattgatgtgggatgggccgtttttggatatgttaatgaatacgggttcgtgtaatcactccacggaatatgggatatttcagggttttgatgatctttacaatgattttttcccaccatcattaattcctaatcttgattatggagaggagaccaatcttgatggtgtcttagaacaaggttcgtttctttggaatttctaa

SEQ ID NO: 3158 - protein, 209 aa, Populus balsamifera subsp. trichocarpa
  misc_feature (1)..(209): Ceres ANNOT ID no. 1538185
  misc_feature (16)..(79): Pfam Name: AP2 Pfam Description: AP2 domain
  misc_feature: SWISSPROT Homolog: TINY_ARATH Transcriptional factor TINY with e-value of 3.7e-21 and BLAST sequence identity of 40.5
  misc_feature: SWISSPROT Homolog: DRE1B_ARATH Dehydration-responsive element-binding protein 1B with e-value of 1.0e-18 and BLAST sequence identity of 40.3
  misc_feature: SWISSPROT Homolog: DRE1B_ARATH DREB1B protein (C-repeat-binding factor 1) C-repeat/dehydration-responsive element-binding factor 1 (CRT/DRE-binding factor 1)
  misc_feature: SWISSPROT Homolog: DRE1A_ARATH Dehydration-responsive element-binding protein 1A with e-value of 7.1e-18 and BLAST sequence identity of 44.1
  misc_feature: SWISSPROT Homolog: DRE1A_ARATH DREB1A protein (C-repeat-binding factor 3) C-repeat/dehydration-responsive element-binding factor 3) (CRT/DRE-binding factor 3)
  misc_feature: SWISSPROT Homolog: DRE1C_ARATH Dehydration-responsive element-binding protein 1C with e-value of 1.5e-17 and BLAST sequence identity of 47.4
  misc_feature: SWISSPROT Homolog: DRE1C_ARATH DREB1C protein (C-repeat-binding factor 2) (C-repeat/dehydration-responsive element-binding factor 2) (CRT/DRE-binding factor 2)
  misc_feature: SWISSPROT Homolog: DRE1D_ARATH Dehydration-responsive element-binding protein 1D with e-value of 1.5e-17 and BLAST sequence identity of 45.9
  misc_feature: SWISSPROT Homolog: DRE1D_ARATH DREB1D protein (C-repeat-binding factor 4) C-repeat/dehydration-responsive element-binding factor 4) (CRT/DRE-binding factor 4)
  misc_feature 351995:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(209): Functional Homolog of  Ceres CLONE ID no. 536796 at SEQ ID NO. 3201 with e-value of 1.69E-47 and BLAST sequence identity of 56.8
MVKHSVEKPVAERSDSKFKGVRKRKWGKWVSEIRLPNSRERIWLGSYDSAEKAARAFDAALFCLRGRVAKFNFPENPPNIAGGRSLSPAEIQEAAARFANSEPQRSQPDRFETDQSVSVSESRAESPCPSVVSDGTVQMEGGELMWDGPFLDMLMNTGSCNHSTEYGIFQGFDDLYNDFFPPSLIPNLDYGEETNLDGVLEQGSFLWNF

SEQ ID NO: 3159 - DNA, 897 bp, Populus balsamifera subsp. trichocarpa
  misc_feature (1)..(897): Ceres ANNOT ID no. 1455109
  misc_feature 352105:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atgaatggcaagctacagggtttcaaagccatcacggaaagtgagagagaggtccaccacctaaccccactccgttcctttcatcccaatttgcatgcacatgtaattatcacaagttcaacaaaatactatcaaacacctgacctgcggctgatcaatgctcccgcgtcgtaccttcgtttttggccctaccgcgtcccaagtgtccgcgctccctcgcactctccccctctgactcccctcagtccgatcaacacgtttgattgtcctgaaacaatggtgagacctggaacgtcatcttcgtcagtgtcatctgagcaacagtctgatagaacacatgagcccaagtacaagggtgttcgaaagagaaaatggggtaagtgggtgtctgaaattaggctgcctaatagccgggagagaatatggttaggatcctatgacacgcccgaaaaggcggcgcgtgcatttgacgctgccctgtattgcctacgtggtagtggtgccaagttcaatttccctgacaacccaccggacattgtcggcgggcggtcacttaccccgcaagaggtgcaagaagttgctgccaggtttgctaatgaagagccaacatcgtccactgctatgggaggtgaatcatcgtcacatgtggagaattacacatcatcatcgtccgactgtggggctggacaaatggatagtgatactatagactggtcgtttttgaatttgttggattctaatgagggtgcatccgatttcggactctatcacgggctggaccatatgggtggtgattattatccccctcctactccgccgccgcctcctgattataacggggatgataacaacggagacgaaactttctctcaccagtcatttctttggaacttttga

SEQ ID NO: 3160 - protein, 206 aa, Populus balsamifera subsp. trichocarpa
  misc_feature (1)..(206): Ceres ANNOT ID no. 1455109
  misc_feature (23)..(86): Pfam Name: AP2 Pfam Description: AP2 domain
  misc_feature: SWISSPROT Homolog: TINY_ARATH Transcriptional factor TINY with e-value of 3.7e-21 and BLAST sequence identity of 40.5
  misc_feature: SWISSPROT Homolog: DRE1B_ARATH Dehydration-responsive element-binding protein 1B with e-value of 1.0e-18 and BLAST sequence identity of 40.3
  misc_feature: SWISSPROT Homolog: DRE1B_ARATH DREB1B protein (C-repeat-binding factor 1) C-repeat/dehydration-responsive element-binding factor 1 (CRT/DRE-binding factor 1)
  misc_feature: SWISSPROT Homolog: DRE1A_ARATH Dehydration-responsive element-binding protein 1A with e-value of 7.1e-18 and BLAST sequence identity of 44.1
  misc_feature: SWISSPROT Homolog: DRE1A_ARATH DREB1A protein (C-repeat-binding factor 3) C-repeat/dehydration-responsive element-binding factor 3) (CRT/DRE-binding factor 3)
  misc_feature: SWISSPROT Homolog: DRE1C_ARATH Dehydration-responsive element-binding protein 1C with e-value of 1.5e-17 and BLAST sequence identity of 47.4
  misc_feature: SWISSPROT Homolog: DRE1C_ARATH DREB1C protein (C-repeat-binding factor 2) (C-repeat/dehydration-responsive element-binding factor 2) (CRT/DRE-binding factor 2)
  misc_feature: SWISSPROT Homolog: DRE1D_ARATH Dehydration-responsive element-binding protein 1D with e-value of 1.5e-17 and BLAST sequence identity of 45.9
  misc_feature: SWISSPROT Homolog: DRE1D_ARATH DREB1D protein (C-repeat-binding factor 4) C-repeat/dehydration-responsive element-binding factor 4) (CRT/DRE-binding factor 4)
  misc_feature 352272:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(206): Functional Homolog of  Ceres CLONE ID no. 536796 at SEQ ID NO. 3201 with e-value of 6.69E-44 and BLAST sequence identity of 56.7
MVRPGTSSSSVSSEQQSDRTHEPKYKGVRKRKWGKWVSEIRLPNSRERIWLGSYDTPEKAARAFDAALYCLRGSGAKFNFPDNPPDIVGGRSLTPQEVQEVAARFANEEPTSSTAMGGESSSHVENYTSSSSDCGAGQMDSDTIDWSFLNLLDSNEGASDFGLYHGLDHMGGDYYPPPTPPPPPDYNGDDNNGDETFSHQSFLWNF

SEQ ID NO: 3161 - DNA, 597 bp, Populus balsamifera subsp. trichocarpa
  misc_feature (1)..(597): Ceres ANNOT ID no. 1477384
  misc_feature 352379:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atggtaaaaccatcatcgtcatcagggcaacagtctgatagaaatcatgagcccaagtacaagggtgttagaaagagaaagtgggggaagtgggtgtccgaaatcagactacccaatagtcgggagagaatatggttaggatcttatgacacgcccctaaaagcggcgcgtgcattcgacgcagccttgtattgtttacgtggtagcggtgccaagtttaatttccccgacaatccaccggacattgttggtgggcagtcacttagttcgcaagaaatacaagaagttgctgccaggtttgctaatgaggagccaacatcgtcgtcgactgctacgagaggtgaatcatcagaacatgtggagaatgacacatcatcgtcgtctgatggtggagctggagatactatagattggtcgtttttgaacttgttggattctagcgagggtgcttcagattttggactctatcatgggctggaccatatgggtggtgattattatccaccaccaccgcctccgtctgaatatagcatcggtggggatgatcacaatggagatgaagcttactctcaacagtcatttctttggaacttttaa

SEQ ID NO: 3162 - protein, 198 aa, Populus balsamifera subsp. trichocarpa
  misc_feature (1)..(198): Ceres ANNOT ID no. 1477384
  misc_feature (18)..(81): Pfam Name: AP2 Pfam Description: AP2 domain
  misc_feature: SWISSPROT Homolog: TINY_ARATH Transcriptional factor TINY with e-value of 3.7e-21 and BLAST sequence identity of 40.5
  misc_feature: SWISSPROT Homolog: DRE1B_ARATH Dehydration-responsive element-binding protein 1B with e-value of 1.0e-18 and BLAST sequence identity of 40.3
  misc_feature: SWISSPROT Homolog: DRE1B_ARATH DREB1B protein (C-repeat-binding factor 1) C-repeat/dehydration-responsive element-binding factor 1 (CRT/DRE-binding factor 1)
  misc_feature: SWISSPROT Homolog: DRE1A_ARATH Dehydration-responsive element-binding protein 1A with e-value of 7.1e-18 and BLAST sequence identity of 44.1
  misc_feature: SWISSPROT Homolog: DRE1A_ARATH DREB1A protein (C-repeat-binding factor 3) C-repeat/dehydration-responsive element-binding factor 3) (CRT/DRE-binding factor 3)
  misc_feature: SWISSPROT Homolog: DRE1C_ARATH Dehydration-responsive element-binding protein 1C with e-value of 1.5e-17 and BLAST sequence identity of 47.4
  misc_feature: SWISSPROT Homolog: DRE1C_ARATH DREB1C protein (C-repeat-binding factor 2) (C-repeat/dehydration-responsive element-binding factor 2) (CRT/DRE-binding factor 2)
  misc_feature: SWISSPROT Homolog: DRE1D_ARATH Dehydration-responsive element-binding protein 1D with e-value of 1.5e-17 and BLAST sequence identity of 45.9
  misc_feature: SWISSPROT Homolog: DRE1D_ARATH DREB1D protein (C-repeat-binding factor 4) C-repeat/dehydration-responsive element-binding factor 4) (CRT/DRE-binding factor 4)
  misc_feature 352536:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: WHOLE PLANT - Other Useful for making bigger plants
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(198): Functional Homolog of  Ceres CLONE ID no. 536796 at SEQ ID NO. 3201 with e-value of 1.09E-41 and BLAST sequence identity of 58.5
MVKPSSSSGQQSDRNHEPKYKGVRKRKWGKWVSEIRLPNSRERIWLGSYDTPLKAARAFDAALYCLRGSGAKFNFPDNPPDIVGGQSLSSQEIQEVAARFANEEPTSSSTATRGESSEHVENDTSSSSDGGAGDTIDWSFLNLLDSSEGASDFGLYHGLDHMGGDYYPPPPPPSEYSIGGDDHNGDEAYSQQSFLWNF

SEQ ID NO: 3163 - protein, 316 aa, Glycine max
  misc_feature (1)..(316): Ceres CLONE ID no. 537272
  misc_feature (119)..(170): Pfam Name: KNOX2 Pfam Description: KNOX2 domain
  misc_feature (200)..(221): Pfam Name: ELK Pfam Description: ELK domain
  misc_feature (231)..(282): Pfam Name: Homeobox Pfam Description: Homeobox domain
  misc_feature (66)..(110): Pfam Name: KNOX1 Pfam Description: KNOX1 domain
  misc_feature: Phenotype: ROSETTE LEAVES - Curled 3 Useful for making ornamental plants with altered leaf shape
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Lobed Shaped Useful for making plants with increased biomass and foliage
MIGFGGNSCSELSEMDMTNMETNRKFLSLPLSNNNNSGDNRRVPVTSNSIAQEHHYSHHHNPTDTCSVRDKIMAHPLFPRLLSSYLNCLKVGAPPEVVASLEESYAKYESFNASSGRIGGGSIGEDPALDQFMEAYCEMLIKYEQELTKPFKEAMLFFSRIECQLKALAVSSDFGQSETSSKNEVDVHENNLDSQAEDRELKVQLLRKYSGYLGSLKKEFLKKKKNGKLPKEARQQLLDWWNRHYKWPYPSESQKQALAESTGLDMKQINNWFINQRKRHWKPSEDMQFAVMDATNYYMENVMCKPFPMDSMPMLL

SEQ ID NO: 3164 - DNA, 1122 bp, Populus balsamifera subsp. trichocarpa; identical to SEQ ID NO: 112
  misc_feature (1)..(1122): Ceres ANNOT ID no. 1518918
  misc_feature 352770:<222: Transcription Factor
  misc_feature: Phenotype: ROSETTE LEAVES - Curled 3 Useful for making ornamental plants with altered leaf shape
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Lobed Shaped Useful for making plants with increased biomass and foliage

SEQ ID NO: 3165 - protein, 357 aa, Populus balsamifera subsp. trichocarpa; identical to SEQ ID NO: 113
  misc_feature (1)..(357): Ceres ANNOT ID no. 1518918
  misc_feature (103)..(147): Pfam Name: KNOX1 Pfam Description: KNOX1 domain
  misc_feature (152)..(203): Pfam Name: KNOX2 Pfam Description: KNOX2 domain
  misc_feature (239)..(260): Pfam Name: ELK Pfam Description: ELK domain
  misc_feature (287)..(321): Pfam Name: Homeobox Pfam Description: Homeobox domain
  misc_feature: SWISSPROT Homolog: HSBH1_SOYBN Homeobox protein SBH1 with e-value of 2.1e-101 and BLAST sequence identity of 63.4
  misc_feature: SWISSPROT Homolog: LET6_LYCES Homeobox protein knotted-1-like LET6 with e-value of 4.0e-95 and BLAST sequence identity of 63.8
  misc_feature: SWISSPROT Homolog: STM_ARATH Homeobox protein SHOOT MERISTEMLESS with e-value of 3.3e-91 and BLAST sequence identity of 68.3
  misc_feature: SWISSPROT Homolog: STM_BRAOL Homeobox protein Shootmeristemless with e-value of 1.5e-88 and BLAST sequence identity of 68.0
  misc_feature: SWISSPROT Homolog: KNAT1_ARATH Homeobox protein knotted-1-like 1 (KNAT1) with e-value of 4.5e-72 and BLAST sequence identity of 54.4
  misc_feature 352914:<222: Transcription Factor
  misc_feature: Phenotype: ROSETTE LEAVES - Curled 3 Useful for making ornamental plants with altered leaf shape
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Lobed Shaped Useful for making plants with increased biomass and foliage
  misc_feature (1)..(357): Functional Homolog of  Ceres CLONE ID no. 537272 at SEQ ID NO. 3210 with e-value of 1.00E-95 and BLAST sequence identity of 69.9

SEQ ID NO: 3166 - DNA, 1110 bp, Populus balsamifera subsp. trichocarpa; identical to SEQ ID NO: 114
  misc_feature (1)..(1110): Ceres ANNOT ID no. 1535677
  misc_feature 353037:<222: Transcription Factor
  misc_feature: Phenotype: ROSETTE LEAVES - Curled 3 Useful for making ornamental plants with altered leaf shape
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Lobed Shaped Useful for making plants with increased biomass and foliage

SEQ ID NO: 3167 - protein, 354 aa, Populus balsamifera subsp. trichocarpa; identical to SEQ ID NO: 115
  misc_feature (1)..(354): Ceres ANNOT ID no. 1535677
  misc_feature (100)..(144): Pfam Name: KNOX1 Pfam Description: KNOX1 domain
  misc_feature (149)..(200): Pfam Name: KNOX2 Pfam Description: KNOX2 domain
  misc_feature (236)..(257): Pfam Name: ELK Pfam Description: ELK domain
  misc_feature (284)..(318): Pfam Name: Homeobox Pfam Description: Homeobox domain
  misc_feature: SWISSPROT Homolog: HSBH1_SOYBN Homeobox protein SBH1 with e-value of 2.1e-101 and BLAST sequence identity of 63.4
  misc_feature: SWISSPROT Homolog: LET6_LYCES Homeobox protein knotted-1-like LET6 with e-value of 4.0e-95 and BLAST sequence identity of 63.8
  misc_feature: SWISSPROT Homolog: STM_ARATH Homeobox protein SHOOT MERISTEMLESS with e-value of 3.3e-91 and BLAST sequence identity of 68.3
  misc_feature: SWISSPROT Homolog: STM_BRAOL Homeobox protein Shootmeristemless with e-value of 1.5e-88 and BLAST sequence identity of 68.0
  misc_feature: SWISSPROT Homolog: KNAT1_ARATH Homeobox protein knotted-1-like 1 (KNAT1) with e-value of 4.5e-72 and BLAST sequence identity of 54.4
  misc_feature 353181:<222: Transcription Factor
  misc_feature: Phenotype: ROSETTE LEAVES - Curled 3 Useful for making ornamental plants with altered leaf shape
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Lobed Shaped Useful for making plants with increased biomass and foliage
  misc_feature (1)..(354): Functional Homolog of  Ceres CLONE ID no. 537272 at SEQ ID NO. 3210 with e-value of 3.69E-91 and BLAST sequence identity of 65.9

SEQ ID NO: 3168 - protein, 385 aa, Glycine max
  misc_feature (1)..(385): Ceres CLONE ID no. 538933
  misc_feature (50)..(137): Pfam Name: C2 Pfam Description: C2 domain
  misc_feature: Phenotype: WHOLE PLANT - Small Useful for modulating plant size
  misc_feature: Phenotype: INFLORESCENCE - Short Useful for modulating plant height
MESPQSVVSPFKRSVLGDAEKYRSDVLSKDIEVNGKEGAVCNVEEFIGVVDVYIHQARDIHNICIYHKQDVYAKICLTSNPENTVSTKTINGGGRNPVFNENLSLSVRTVDSVVKCEIWMLSRVKNYLEDQLLGFALVPLSEVLVKKDGKLEKEFSLSSTDLFHSPAGYVQLSLAYTGASPDVMAISSMPTTEKDSESCESLVRDLDKIEFPDPKIVNEDHLMVSEYFGIPCEESQCSDSLTTTDTENLSSEAGVQLVESFSACSVSSVSTNGVSSPSVAASSDSSPNEETKEKNVDVKDGETDSSFPKPLVTVNIEPEPNVVQQDFVDMYMKSMQQFTESLAKMKLPVDFESGPTSSGNSSSEHKLQTPKSTNSRVFYGSRAFF

SEQ ID NO: 3169 - DNA, 1299 bp, Populus balsamifera subsp. trichocarpa
  misc_feature (1)..(1299): Ceres ANNOT ID no. 1466193
  misc_feature 353414:<222: Transcription Factor
  misc_feature: Phenotype: WHOLE PLANT - Small Useful for modulating plant size
  misc_feature: Phenotype: INFLORESCENCE - Short Useful for modulating plant height
atggattcccctcaatctgttgtgtcaccattcaagacctctgttggctttgagacagagaagcaaaagtatgattatccagttcagagcactggcagcttctccaagggaattgagatccacagaaacgatgctgtggttggcaatctcgaagattttgttggtgtagttgaggtttacatacaccaggctagggacatccaaaacatatgcatttaccacaagcaagatgtttatgcaaagttttgcctgactagcgatcccgagcacactgtctccaccaaaatcatcaatggtggtgggaggaatccagtcttcaatgacagtctgcggctcaatgttaagactgttgattcctcccttaaatgtgaggtattcatgatgagcagggtgaggaattatctggaggatcagctgttaggtttcgctctggtgcctttgtccgaagtactaatcaataatgggaatttggacaaagagttctctctttcttcaactgatttgttctactctcccgcggggtttgttcaactatctctatcatacagtggagcttcaccagaggtaatggcgattccagcaatacccactgctttagctgcaaatggaactattcaggattcagagatacaggaatcacttccttgtgaattcgataagattgagttcccggatccaaaggttgtgaatgaaaaccagatgatggtctctgagtattttggaattccatgttccagtctggattctgaagcctctgagagcttggccacctctgatactgaaaattatctcagttcagaaaatggagttcatgtcgtggaaagcttctcagctgccacttccgattcaattcaagttccgaagcttggctctcctccaagcagtgtgtcaactaacggtgtttcttctccttctgttgatgcaagttcagaaacctctgacagcccagcagcttctaaaacaccgaatctggaccatgtctcagaccgtaaagagagagagagtacaaatgtcagagatggtgagactgattcctctggtggagcatcaaatgagaaaattgccaaacctgttattacagtaaacattgagccggaaacaaatatggttcagcaggacatagtagacatgtacatgaaaagcatgcaacaattcacagagtcactggccaagatgaagcttcctttggacattgaaagtggaccaactagttcaggaagttcgagctctgataagaatgtgcaggcatcaaagaacactggttcccgtgtgttttatgggagtagagctttcttctga

SEQ ID NO: 3170 - protein, 432 aa, Populus balsamifera subsp. trichocarpa
  misc_feature (1)..(432): Ceres ANNOT ID no. 1466193
  misc_feature (57)..(144): Pfam Name: C2 Pfam Description: C2 domain
  misc_feature 353496:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature (1)..(432): Functional Homolog of  Ceres CLONE ID no. 538933 at SEQ ID NO. 3215 with e-value of 1.79E-130 and BLAST sequence identity of 72.3
MDSPQSVVSPFKTSVGFETEKQKYDYPVQSTGSFSKGIEIHRNDAVVGNLEDFVGVVEVYIHQARDIQNICIYHKQDVYAKFCLTSDPEHTVSTKIINGGGRNPVFNDSLRLNVKTVDSSLKCEVFMMSRVRNYLEDQLLGFALVPLSEVLINNGNLDKEFSLSSTDLFYSPAGFVQLSLSYSGASPEVMAIPAIPTALAANGTIQDSEIQESLPCEFDKIEFPDPKVVNENQMMVSEYFGIPCSSLDSEASESLATSDTENYLSSENGVHVVESFSAATSDSIQVPKLGSPPSSVSTNGVSSPSVDASSETSDSPAASKTPNLDHVSDRKERESTNVRDGETDSSGGASNEKIAKPVITVNIEPETNMVQQDIVDMYMKSMQQFTESLAKMKLPLDIESGPTSSGSSSSDKNVQASKNTGSRVFYGSRAFF

SEQ ID NO: 3171 - DNA, 1299 bp, Populus balsamifera subsp. trichocarpa
  misc_feature (1)..(1299): Ceres ANNOT ID no. 1494416
  misc_feature 353620:<222: Transcription Factor
  misc_feature: Phenotype: WHOLE PLANT - Small Useful for modulating plant size
  misc_feature: Phenotype: INFLORESCENCE - Short Useful for modulating plant height
atggattcccctcaatctgttgtgtcaccattcaagacctctgttgtctttgagccagagaagcagaaatctgattgttctgttcagagtactggcaacttatccaagggaattgagttccccagacatgaggctgtggctggccatccagaagacttcattggtatagttgaggtttacgtgcaccaggctagggacatccaaaacatatgcatttaccacaagcaagatgtttatgctaagttttgcttgactagtgatcctgagtacacattctccaccaaaatcatcaatggtggtgggaggaatcctgtcttcaacgaccgtctgcagctcaatgttaagactattgattcctcccttaaatgtgagatattcatgatgagtagggtgaagaattatctggaggatcagctgttagggtttgctctggttccgttgtctgaagttctaatcaataacgggaatttggagaaagagttctctctttcttcaactgatttgttccactctccagcagggtttgttcaattgtctctatcatacgttggagcttcaccagaggtaatggaaattccagcaatgcccaccgctttagctacaaatggaaccatccaggattctgagatacaggaatcactcccttgcgaacttgataagattgagttcccggatccaaaggttgtgaatgaaaaccagatgatgatctcagagtattttggaatttcatgttctagcctggattctgaagcctctgagagcttggccatttctaatgctgaaaataatctcggttcagaaatcggagttcatgttatggaaagcatttcagccgccacttctgatccaactcaagttccaaagcttgattctcctccaagcagtgtgtcaactaatggtgtttcttcaccttccgctgctgcaagttcagaaacctctgatagcccagcagcttcaaaaacaccaaatcaggagcatgtctcggtccataaagagagagagagtgcaaatgccggagatggtgagactgattgctctggtggagcatcaaatgagaaaaatgcaaaacctgttattacagtcaacattgagccggagtccaaagtggttcagcaagacatagtagacatgtacatgaaaagcatgcagcaattcacagagtcactggccaagatgaagcttcctttggacattgatagtggaccaaccagttcaggaagttcaagctccgatcagaaaatgcaggcatcaaagaacacaagttcccgtgtgttttatgggagtcgggctttcttctga

SEQ ID NO: 3172 - protein, 432 aa, Populus balsamifera subsp. trichocarpa
  misc_feature (1)..(432): Ceres ANNOT ID no. 1494416
  misc_feature (57)..(144): Pfam Name: C2 Pfam Description: C2 domain
  misc_feature 353702:<222: Transcription Factor
  misc_feature: Phenotype: WHOLE PLANT - Small Useful for modulating plant size
  misc_feature: Phenotype: INFLORESCENCE - Short Useful for modulating plant height
  misc_feature (1)..(432): Functional Homolog of  Ceres CLONE ID no. 538933 at SEQ ID NO. 3215 with e-value of 8.19E-126 and BLAST sequence identity of 70.5
MDSPQSVVSPFKTSVVFEPEKQKSDCSVQSTGNLSKGIEFPRHEAVAGHPEDFIGIVEVYVHQARDIQNICIYHKQDVYAKFCLTSDPEYTFSTKIINGGGRNPVFNDRLQLNVKTIDSSLKCEIFMMSRVKNYLEDQLLGFALVPLSEVLINNGNLEKEFSLSSTDLFHSPAGFVQLSLSYVGASPEVMEIPAMPTALATNGTIQDSEIQESLPCELDKIEFPDPKVVNENQMMISEYFGISCSSLDSEASESLAISNAENNLGSEIGVHVMESISAATSDPTQVPKLDSPPSSVSTNGVSSPSAAASSETSDSPAASKTPNQEHVSVHKERESANAGDGETDCSGGASNEKNAKPVITVNIEPESKVVQQDIVDMYMKSMQQFTESLAKMKLPLDIDSGPTSSGSSSSDQKMQASKNTSSRVFYGSRAFF

SEQ ID NO: 3173 - protein, 375 aa, Glycine max
  misc_feature (1)..(375): Ceres CLONE ID no. 541719
  misc_feature (117)..(161): Pfam Name: KNOX1 Pfam Description: KNOX1 domain
  misc_feature (171)..(222): Pfam Name: KNOX2 Pfam Description: KNOX2 domain
  misc_feature (257)..(278): Pfam Name: ELK Pfam Description: ELK domain
  misc_feature (288)..(339): Pfam Name: Homeobox Pfam Description: Homeobox domain
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature: Phenotype: ROSETTE LEAVES - Undulate Shaped Useful for making plants with increased biomass and foliage
MEGSSCSNDTSYLLAFGENSGGLCPMTMMPLVTSHHATNPSNPSNNTNNNENTNCLFIPNCSNSSGTPSIMLHNNNNTDDDNNKTSTNTGLGYYFMESDHHHRNNNNNGSSSSSSSSAVKAKIMAHPHYHRLLAAYVNCQKVGAPPEVVARLEEACASAATMAGDAAAAAGSSCIGEDPALDQFMEAYCEMLTKYEQELSKPLKEAMLFLQRIECQFKNLTISSTDFACNEGAERNGSSEEDVDLHNMIDPQAEDRELKGQLLRKYSGYLGSLKQEFMKKRKKGKLPKEARQQLLEWWSRHYKWPYPSESQKLALAESTGLDQKQINNWFINQRKRHWKPSEDMQFVVMDPSHPHYYMDNVLGNPFPMDLSHPML

SEQ ID NO: 3174 - DNA, 1122 bp, Populus balsamifera subsp. trichocarpa; identical to SEQ ID NO: 112
  misc_feature (1)..(1122): Ceres ANNOT ID no. 1518918
  misc_feature 353958:<222: Transcription Factor
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature: Phenotype: ROSETTE LEAVES - Undulate Shaped Useful for making plants with increased biomass and foliage

SEQ ID NO: 3175 - protein, 373 aa, Populus balsamifera subsp. trichocarpa
  misc_feature (1)..(373): Ceres ANNOT ID no. 1518918
  misc_feature (119)..(163): Pfam Name: KNOX1 Pfam Description: KNOX1 domain
  misc_feature (168)..(219): Pfam Name: KNOX2 Pfam Description: KNOX2 domain
  misc_feature (255)..(276): Pfam Name: ELK Pfam Description: ELK domain
  misc_feature (303)..(337): Pfam Name: Homeobox Pfam Description: Homeobox domain
  misc_feature: SWISSPROT Homolog: HSBH1_SOYBN Homeobox protein SBH1 with e-value of 1.1e-186 and BLAST sequence identity of 91.1
  misc_feature: SWISSPROT Homolog: LET6_LYCES Homeobox protein knotted-1-like LET6 with e-value of 1.8e-122 and BLAST sequence identity of 65.6
  misc_feature: SWISSPROT Homolog: STM_ARATH Homeobox protein SHOOT MERISTEMLESS with e-value of 3.0e-122 and BLAST sequence identity of 65.0
  misc_feature: SWISSPROT Homolog: STM_BRAOL Homeobox protein Shootmeristemless with e-value of 2.2e-117 and BLAST sequence identity of 63.2
  misc_feature: SWISSPROT Homolog: KNAT1_ARATH Homeobox protein knotted-1-like 1 (KNAT1) with e-value of 1.3e-82 and BLAST sequence identity of 49.3
  misc_feature 354095:<222: Transcription Factor
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature: Phenotype: ROSETTE LEAVES - Undulate Shaped Useful for making plants with increased biomass and foliage
  misc_feature (1)..(373): Functional Homolog of  Ceres CLONE ID no. 541719 at SEQ ID NO. 3220 with e-value of 7.29E-134 and BLAST sequence identity of 76.6
MEGGGGDGGSSTTSCMMAFGDNSNGLCPMMMMTPLMSSSSSAHHQHPHHHHRANEGDSSISNTLFLPLPPTNNQGHNRIHSNASGSSSMIIDDHNRNHNNNTVTATGCYFMDNNDGSSSSVKAKIMAHPHYHRLLAAYANCQKVGAPPEVVARLEEACASAASIAPANTGCIGEDPALDQFMEAYCEMLTKYEQELSKPLKEAMLFLQRVECQFKALTLSSPISGCGDGNDRNVSSEEEVDVNNNFIDPQAEDQELKGQLLRRYSGYLGSLKQEFMKKRKKGKLPKEARQQLLDWWSRHYKWPYPSESQKLALAESTGLDQKQINNWFINQRKRHWKPSEDMQFVVMDAGHPHYYMDNVLGNPFPMDISPTLL

SEQ ID NO: 3176 - DNA, 1110 bp, Populus balsamifera subsp. trichocarpa; identical to SEQ ID NO: 114
  misc_feature (1)..(1110): Ceres ANNOT ID no. 1535677
  misc_feature 354214:<222: Transcription Factor
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature: Phenotype: ROSETTE LEAVES - Undulate Shaped Useful for making plants with increased biomass and foliage

SEQ ID NO: 3177 - protein, 369 aa, Populus balsamifera subsp. trichocarpa
  misc_feature (1)..(369): Ceres ANNOT ID no. 1535677
  misc_feature (115)..(159): Pfam Name: KNOX1 Pfam Description: KNOX1 domain
  misc_feature (164)..(215): Pfam Name: KNOX2 Pfam Description: KNOX2 domain
  misc_feature (251)..(272): Pfam Name: ELK Pfam Description: ELK domain
  misc_feature (299)..(333): Pfam Name: Homeobox Pfam Description: Homeobox domain
  misc_feature: SWISSPROT Homolog: HSBH1_SOYBN Homeobox protein SBH1 with e-value of 1.1e-186 and BLAST sequence identity of 91.1
  misc_feature: SWISSPROT Homolog: LET6_LYCES Homeobox protein knotted-1-like LET6 with e-value of 1.8e-122 and BLAST sequence identity of 65.6
  misc_feature: SWISSPROT Homolog: STM_ARATH Homeobox protein SHOOT MERISTEMLESS with e-value of 3.0e-122 and BLAST sequence identity of 65.0
  misc_feature: SWISSPROT Homolog: STM_BRAOL Homeobox protein Shootmeristemless with e-value of 2.2e-117 and BLAST sequence identity of 63.2
  misc_feature: SWISSPROT Homolog: KNAT1_ARATH Homeobox protein knotted-1-like 1 (KNAT1) with e-value of 1.3e-82 and BLAST sequence identity of 49.3
  misc_feature 354351:<222: Transcription Factor
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature: Phenotype: ROSETTE LEAVES - Undulate Shaped Useful for making plants with increased biomass and foliage
  misc_feature (1)..(369): Functional Homolog of  Ceres CLONE ID no. 541719 at SEQ ID NO. 3220 with e-value of 3.09E-133 and BLAST sequence identity of 74.7
MEGGGAGCSSTPSLMMAFGDSSNGLCPMMMMPLMSSSSSAHQHHHQQQHVNAGDSSISNTLFLPLPPTNYQSQNRINNSASGSSMILDDHNHNNNTVTATGCYFMENNDGGSSSTSVKAKIMAHPHYHRLLAAYANCQKVGAPPEVVARLEEACASAASMGPANTDGIGEDPALDQFMEAYCEMLTKYEQELSKPLKEAMVFLQRVECQFRALTLSSPNSAWGEGNDRNASSEEELDVNNKFIDPQAEDQELKGQLLRKYSGYLGSLKKEFMKKRKKGKLPKEARQQLLDWWSRHHKWPYPSESQKLALAESTGLDQKQINNWFINQRKRHWKPSEDMQFVVMDAGHPHYYMDNVLGNPFPMDISHTLL

SEQ ID NO: 3178 - protein, 141 aa, Glycine max
  misc_feature (1)..(141): Ceres CLONE ID no. 543549
  misc_feature (7)..(81): Pfam Name: Cyt-b5 Pfam Description: Cytochrome b5-like Heme/Steroid binding domain
  misc_feature: Utility: PEG Useful for making plants with increased tolerance to drought
  misc_feature: Phenotype: WHOLE PLANT - PEG Useful for making plants with increased tolerance to drought
MASNPKTLTFEEVAKHNNKKDCWIIINGKVYDITPFLDEHPGGDEVLLTSTGKDATIDFEDVGHSDSAIEMMEKYFIGKVDTSTLPPKVSHSLPQPTQTHGAGNQSSGFVVKILQFLLPLLILGLAFALQYYGQKKHASTS

SEQ ID NO: 3179 - DNA, 405 bp, Populus balsamifera subsp. trichocarpa
  misc_feature (1)..(405): Ceres ANNOT ID no. 1529916
  misc_feature: Utility: PEG Useful for making plants with increased tolerance to drought
  misc_feature 354537:<222: Transcription Factor
  misc_feature: Phenotype: WHOLE PLANT - PEG Useful for making plants with increased tolerance to drought
atgggtggcgatggcaaagttttcacttttgaagaagtgactgtgcacaacaatcataaagactgttggcttattatcaatggcaaggtttatgatgtgacaaagttcatggaagaccaccctggtggagatgaggttttgttgtcttctacagggcaggatgcaactgatgattttgaagatgtgggtcatagtgatagtgccagagaaatgatgggcgaatactgcattggagatatcgatgcttcgactgtccctcagaaaacaaagtacaggactccaaagcagcctcactacaatcaagataagacctccgagttcattatcaagctcctccagttcctagttcctcttgccatattgggtttggcctttggactccgcctttacaccaaatcaacctaa

SEQ ID NO: 3180 - protein, 134 aa, Populus balsamifera subsp. trichocarpa
  misc_feature (1)..(134): Ceres ANNOT ID no. 1529916
  misc_feature (7)..(81): Pfam Name: Cyt-b5 Pfam Description: Cytochrome b5-like Heme/Steroid binding domain
  misc_feature: SWISSPROT Homolog: CYB51_ARATH Cytochrome b5 isoform 1 with e-value of 4.9e-42 and BLAST sequence identity of 60.0
  misc_feature: SWISSPROT Homolog: CYB5_BRAOB Cytochrome b5 with e-value of 1.3e-41 and BLAST sequence identity of 59.9
  misc_feature: SWISSPROT Homolog: CYB5_TOBAC Cytochrome b5 with e-value of 2.4e-40 and BLAST sequence identity of 55.1
  misc_feature: SWISSPROT Homolog: CYB52_ARATH Probable cytochrome b5 isoform 2 with e-value of 5.8e-39 and BLAST sequence identity of 56.8
  misc_feature: SWISSPROT Homolog: CYB5_ORYSA Cytochrome b5 with e-value of 9.5e-39 and BLAST sequence identity of 56.3
  misc_feature: Utility: PEG Useful for making plants with increased tolerance to drought
  misc_feature 354623:<222: Transcription Factor
  misc_feature: Phenotype: WHOLE PLANT - PEG Useful for making plants with increased tolerance to drought
  misc_feature (1)..(134): Functional Homolog of  Ceres CLONE ID no. 543549 at SEQ ID NO. 3225 with e-value of 4.89E-41 and BLAST sequence identity of 62.3
MGGDGKVFTFEEVTVHNNHKDCWLIINGKVYDVTKFMEDHPGGDEVLLSSTGQDATDDFEDVGHSDSAREMMGEYCIGDIDASTVPQKTKYRTPKQPHYNQDKTSEFIIKLLQFLVPLAILGLAFGLRLYTKST

SEQ ID NO: 3181 - DNA, 405 bp, Populus balsamifera subsp. trichocarpa
  misc_feature (1)..(405): Ceres ANNOT ID no. 1440973
  misc_feature: Utility: PEG Useful for making plants with increased tolerance to drought
  misc_feature 354689:<222: Transcription Factor
  misc_feature: Phenotype: WHOLE PLANT - PEG Useful for making plants with increased tolerance to drought
atgggtggtgatgccaaagtttttacctttgaagatgtgactgtgcacaacaaacccaaggactgttggctaattatcaatggcaaggtttatgatgtcacaaagttcatggaagatcaccccggtggtgatgaggttttgttgtcttctacaggccaggacgcaactgatgattttgaagatgtgggtcatagtgatagtgccagagaaatgatggccgaatactgcattggagatattgatgcctcgactgtccccaagaaaacaaagtacaagactccacagcagcctcactacaatcaagataagacctccgagttcattatcaagatccttcagttcctagttcctcttgctatattgggtgtggcctttggaatccgcctctacaccaaatcaacttag

SEQ ID NO: 3182 - protein, 134 aa, Populus balsamifera subsp. trichocarpa
  misc_feature (1)..(134): Ceres ANNOT ID no. 1440973
  misc_feature (7)..(81): Pfam Name: Cyt-b5 Pfam Description: Cytochrome b5-like Heme/Steroid binding domain
  misc_feature: SWISSPROT Homolog: CYB51_ARATH Cytochrome b5 isoform 1 with e-value of 4.9e-42 and BLAST sequence identity of 60.0
  misc_feature: SWISSPROT Homolog: CYB5_BRAOB Cytochrome b5 with e-value of 1.3e-41 and BLAST sequence identity of 59.9
  misc_feature: SWISSPROT Homolog: CYB5_TOBAC Cytochrome b5 with e-value of 2.4e-40 and BLAST sequence identity of 55.1
  misc_feature: SWISSPROT Homolog: CYB52_ARATH Probable cytochrome b5 isoform 2 with e-value of 5.8e-39 and BLAST sequence identity of 56.8
  misc_feature: SWISSPROT Homolog: CYB5_ORYSA Cytochrome b5 with e-value of 9.5e-39 and BLAST sequence identity of 56.3
  misc_feature: Utility: PEG Useful for making plants with increased tolerance to drought
  misc_feature 354775:<222: Transcription Factor
  misc_feature: Phenotype: WHOLE PLANT - PEG Useful for making plants with increased tolerance to drought
  misc_feature (1)..(134): Functional Homolog of  Ceres CLONE ID no. 543549 at SEQ ID NO. 3225 with e-value of 1.69E-40 and BLAST sequence identity of 60.7
MGGDAKVFTFEDVTVHNKPKDCWLIINGKVYDVTKFMEDHPGGDEVLLSSTGQDATDDFEDVGHSDSAREMMAEYCIGDIDASTVPKKTKYKTPQQPHYNQDKTSEFIIKILQFLVPLAILGVAFGIRLYTKST

SEQ ID NO: 3183 - DNA, 405 bp, Populus balsamifera subsp. trichocarpa
  misc_feature (1)..(405): Ceres ANNOT ID no. 1520978
  misc_feature: Utility: PEG Useful for making plants with increased tolerance to drought
  misc_feature 354841:<222: Transcription Factor
  misc_feature: Phenotype: WHOLE PLANT - PEG Useful for making plants with increased tolerance to drought
atggcttcttcaaaggtttacttatttgatgagatttccaagcacaacaaaaccaaggattgctggcttattatctctggcaaggtgtatgatgtcacctcgttcatggatgatcaccccggaggcgatgaggttttgctgtcatcaacagggaaagatgcaacaaacgattttgaagatgtgggtcacagcgatgatgccagagagatgatggaaaagtatgtcattggtgaggtagatgtaacaacagtcccaacaaaacgcctttacgtagcaccaggtttgggaggaacaaaccctaaagatgataagcctgggtttctgattaagatcttgcagctactcgtgccactcctaatcttgggcttggctcttgccgtccgaacctacaccaaaaaagaatag

SEQ ID NO: 3184 - protein, 134 aa, Populus balsamifera subsp. trichocarpa
  misc_feature (1)..(134): Ceres ANNOT ID no. 1520978
  misc_feature (6)..(80): Pfam Name: Cyt-b5 Pfam Description: Cytochrome b5-like Heme/Steroid binding domain
  misc_feature: SWISSPROT Homolog: CYB51_ARATH Cytochrome b5 isoform 1 with e-value of 4.9e-42 and BLAST sequence identity of 60.0
  misc_feature: SWISSPROT Homolog: CYB5_BRAOB Cytochrome b5 with e-value of 1.3e-41 and BLAST sequence identity of 59.9
  misc_feature: SWISSPROT Homolog: CYB5_TOBAC Cytochrome b5 with e-value of 2.4e-40 and BLAST sequence identity of 55.1
  misc_feature: SWISSPROT Homolog: CYB52_ARATH Probable cytochrome b5 isoform 2 with e-value of 5.8e-39 and BLAST sequence identity of 56.8
  misc_feature: SWISSPROT Homolog: CYB5_ORYSA Cytochrome b5 with e-value of 9.5e-39 and BLAST sequence identity of 56.3
  misc_feature: Utility: PEG Useful for making plants with increased tolerance to drought
  misc_feature 354927:<222: Transcription Factor
  misc_feature: Phenotype: WHOLE PLANT - PEG Useful for making plants with increased tolerance to drought
  misc_feature (1)..(134): Functional Homolog of  Ceres CLONE ID no. 543549 at SEQ ID NO. 3225 with e-value of 1.50E-39 and BLAST sequence identity of 61.1
MASSKVYLFDEISKHNKTKDCWLIISGKVYDVTSFMDDHPGGDEVLLSSTGKDATNDFEDVGHSDDAREMMEKYVIGEVDVTTVPTKRLYVAPGLGGTNPKDDKPGFLIKILQLLVPLLILGLALAVRTYTKKE

SEQ ID NO: 3185 - DNA, 405 bp, Populus balsamifera subsp. trichocarpa
  misc_feature (1)..(405): Ceres ANNOT ID no. 1472957
  misc_feature: Utility: PEG Useful for making plants with increased tolerance to drought
  misc_feature 354993:<222: Transcription Factor
  misc_feature: Phenotype: WHOLE PLANT - PEG Useful for making plants with increased tolerance to drought
atggcttcttcaaaggtttacttgttcgatgagatcgccaagcacaacaaaaccgaggattgttggcttattatctctggcaaggtgtatgatgtcacctcgtttatggatgatcatcctggaggcggagaagttttgctgtcatcaacagggaaagatgcaacgaatgattttgaagatgttggtcacagcgatgatgctagagggatgatgggaaagtatgtcattggtgaggtagatgtaacaactgttccaacgaaacgtctttacgtagcagcaggtttgggaggaacaagctccaaagatgacaagtctgaatttctgattaagatcctgcagctactcgtgccactcttaatcttgggcttagctcttgctgcccgaacctacaccaagaaagagtag

SEQ ID NO: 3186 - protein, 134 aa, Populus balsamifera subsp. trichocarpa
  misc_feature (1)..(134): Ceres ANNOT ID no. 1472957
  misc_feature (6)..(80): Pfam Name: Cyt-b5 Pfam Description: Cytochrome b5-like Heme/Steroid binding domain
  misc_feature: SWISSPROT Homolog: CYB51_ARATH Cytochrome b5 isoform 1 with e-value of 4.9e-42 and BLAST sequence identity of 60.0
  misc_feature: SWISSPROT Homolog: CYB5_BRAOB Cytochrome b5 with e-value of 1.3e-41 and BLAST sequence identity of 59.9
  misc_feature: SWISSPROT Homolog: CYB5_TOBAC Cytochrome b5 with e-value of 2.4e-40 and BLAST sequence identity of 55.1
  misc_feature: SWISSPROT Homolog: CYB52_ARATH Probable cytochrome b5 isoform 2 with e-value of 5.8e-39 and BLAST sequence identity of 56.8
  misc_feature: SWISSPROT Homolog: CYB5_ORYSA Cytochrome b5 with e-value of 9.5e-39 and BLAST sequence identity of 56.3
  misc_feature: Utility: PEG Useful for making plants with increased tolerance to drought
  misc_feature 355079:<222: Transcription Factor
  misc_feature: Phenotype: WHOLE PLANT - PEG Useful for making plants with increased tolerance to drought
  misc_feature (1)..(134): Functional Homolog of  Ceres CLONE ID no. 543549 at SEQ ID NO. 3225 with e-value of 4.70E-36 and BLAST sequence identity of 58.2
MASSKVYLFDEIAKHNKTEDCWLIISGKVYDVTSFMDDHPGGGEVLLSSTGKDATNDFEDVGHSDDARGMMGKYVIGEVDVTTVPTKRLYVAAGLGGTSSKDDKSEFLIKILQLLVPLLILGLALAARTYTKKE

SEQ ID NO: 3187 - DNA, 444 bp, Populus balsamifera subsp. trichocarpa
  misc_feature (1)..(444): Ceres ANNOT ID no. 1476456
  misc_feature: Utility: PEG Useful for making plants with increased tolerance to drought
  misc_feature 355145:<222: Transcription Factor
  misc_feature: Phenotype: WHOLE PLANT - PEG Useful for making plants with increased tolerance to drought
atggaatttgcatataaaagcagaataagacatgcaactgcgctctttctgttttgtgttagcttttaccaaataaaggttatgatagagattagtatatacagcaaaataaaggctgaaacaaaggtttatgatgtgacaaagttcatggaagaccaccctggtggagatgaggttttgttgtcttctacagggcaggatgcaactgatgattttgaagatgtgggtcatagtgatagtgccagagaaatgatgggcgaatactgcattggagatatcgatgcttcgactgtccctcagaaaacaaagtacaggactccaaagcagcctcactacaatcaagataagacctccgagttcattatcaagctcctccagttcctagttcctcttgccatattgggtttggcctttggactccgcctttacaccaaatcaacctaa

SEQ ID NO: 3188 - protein, 147 aa, Populus balsamifera subsp. trichocarpa
  misc_feature (1)..(147): Ceres ANNOT ID no. 1476456
  misc_feature (42)..(94): Pfam Name: Cyt-b5 Pfam Description: Cytochrome b5-like Heme/Steroid binding domain
  misc_feature: SWISSPROT Homolog: CYB51_ARATH Cytochrome b5 isoform 1 with e-value of 4.9e-42 and BLAST sequence identity of 60.0
  misc_feature: SWISSPROT Homolog: CYB5_BRAOB Cytochrome b5 with e-value of 1.3e-41 and BLAST sequence identity of 59.9
  misc_feature: SWISSPROT Homolog: CYB5_TOBAC Cytochrome b5 with e-value of 2.4e-40 and BLAST sequence identity of 55.1
  misc_feature: SWISSPROT Homolog: CYB52_ARATH Probable cytochrome b5 isoform 2 with e-value of 5.8e-39 and BLAST sequence identity of 56.8
  misc_feature: SWISSPROT Homolog: CYB5_ORYSA Cytochrome b5 with e-value of 9.5e-39 and BLAST sequence identity of 56.3
  misc_feature: Utility: PEG Useful for making plants with increased tolerance to drought
  misc_feature 355233:<222: Transcription Factor
  misc_feature: Phenotype: WHOLE PLANT - PEG Useful for making plants with increased tolerance to drought
  misc_feature (1)..(147): Functional Homolog of  Ceres CLONE ID no. 543549 at SEQ ID NO. 3225 with e-value of 5.09E-30 and BLAST sequence identity of 61.7
MEFAYKSRIRHATALFLFCVSFYQIKVMIEISIYSKIKAETKVYDVTKFMEDHPGGDEVLLSSTGQDATDDFEDVGHSDSAREMMGEYCIGDIDASTVPQKTKYRTPKQPHYNQDKTSEFIIKLLQFLVPLAILGLAFGLRLYTKST

SEQ ID NO: 3189 - protein, 191 aa, Glycine max
  misc_feature (1)..(191): Ceres CLONE ID no. 545208
  misc_feature (1)..(50): Pfam Name: HLH Pfam Description: Helix-loop-helix DNA-binding domain
  misc_feature: Phenotype: FLOWER - Reduced fertility Useful for sterility, genetic confinement systems
MSHIAVERNRRRQMNEHLKVLRSLTPCFYIKRGDQASIIGGVIEFIKELHQVLQALESQKRRKSLSPSPGPSPRTLQPMFHQLDSPSMIGTNSFKELGASCNSPVADVEVKISGSYVILKVICHRIPGQVAKIITVLESLSFEVLHLNISSMEETVLYQFVVKIELGCQLSLEELAMEVQQSFCLDAIIAL

SEQ ID NO: 3190 - DNA, 621 bp, Populus balsamifera subsp. trichocarpa
  misc_feature (1)..(621): Ceres ANNOT ID no. 1459998
  misc_feature 355360:<222: Transcription Factor
  misc_feature: Phenotype: FLOWER - Reduced fertility Useful for sterility, genetic confinement systems
atgtctcacatagctgtggaaagaaacagaagaagacagatgaatgagcatctcaaagtcttacgttccttgaccccttgtttctatatcaaaaggggggaccaagcttctataatagggggtgcaatagagttcataaaggagttgcaccaagttctacaagctttggagtccaagaaacaaaggaagagtagtttgagccctagccctggtccttgccttagccctagccctagggcgccactgcaactaataacctctagtcttcatcctgatcaccataacccctttccctttgggaatattgaaaatgatctcaaggaactaggcgctgcatgctgcaactctccaattgcagatgttgaagcaaagatatcaggatcaaacgttatcttgaaagtaatatcgcggcgaataccaggtcaaattgtgaggataatcagtgtgttggaaaacctttcctttgagatccttcacttgaacatcagtagcatggaagatactgtcctttactcctttgtcattaagatagggctagaatgtcaggtgagtgtggaggaactagcagttgaagtgcaacaaagcttctttcaagacacaatttatacatatgagttatag

SEQ ID NO: 3191 - protein, 206 aa, Populus balsamifera subsp. trichocarpa
  misc_feature (1)..(206): Ceres ANNOT ID no. 1459998
  misc_feature (1)..(50): Pfam Name: HLH Pfam Description: Helix-loop-helix DNA-binding domain
  misc_feature: SWISSPROT Homolog: ICE1_ARATH Transcription factor ICE1 (Inducer of CBF expression 1) (Basic helix-loop-helix protein 116) (bHLH116) (AtbHLH116) with e-value of 3.1e-11 and BLAST sequence identity of 31.5
  misc_feature: SWISSPROT Homolog: RAP1_ARATH Transcription factor AtMYC2 (R-homologous Arabidopsis protein 1) with e-value of 8.9e-10 and BLAST sequence identity of 26.0
  misc_feature: SWISSPROT Homolog: RAP1_ARATH RAP-1 (Basic helix-loop-helix protein 6) bHLH6 (AtbHLH006) (rd22BP1)
  misc_feature: SWISSPROT Homolog: TT8_ARATH TRANSPARENT TESTA 8 protein (Basic helix-loop-helix protein 42) (bHLH42) (AtbHLH042) with e-value of 5.9e-06 and BLAST sequence identity of 34.5
  misc_feature 355444:<222: Transcription Factor
  misc_feature: Phenotype: FLOWER - Reduced fertility Useful for sterility, genetic confinement systems
  misc_feature (1)..(206): Functional Homolog of  Ceres CLONE ID no. 545208 at SEQ ID NO. 3236 with e-value of 8.69E-67 and BLAST sequence identity of 78.7
MSHIAVERNRRRQMNEHLKVLRSLTPCFYIKRGDQASIIGGAIEFIKELHQVLQALESKKQRKSSLSPSPGPCLSPSPRAPLQLITSSLHPDHHNPFPFGNIENDLKELGAACCNSPIADVEAKISGSNVILKVISRRIPGQIVRIISVLENLSFEILHLNISSMEDTVLYSFVIKIGLECQVSVEELAVEVQQSFFQDTIYTYEL

SEQ ID NO: 3192 - DNA, 603 bp, Populus balsamifera subsp. trichocarpa
  misc_feature (1)..(603): Ceres ANNOT ID no. 1513263
  misc_feature 355516:<222: Transcription Factor
  misc_feature: Phenotype: FLOWER - Reduced fertility Useful for sterility, genetic confinement systems
atgtctcacatagctgtggaaagaaacagaagaagacagatgaatgagcatctcaaagtcttacgttccttgaccccttgtttctatatcaaaaggggggaccaagcttctataatagggggtgcaatagagttcataaaggagttgcaccaagttctacaagctttggagtccaagaaacaaaggaagagtagtttgagccctagccctggtccttgccttagccctagccctagggcgccactgcaactaataacctctagtcttcatcctgatcaccataacccctttccctttgggaatattgaaaatgatctcaaggaactaggcgctgcatgctgcaactctccaattgcagatgttgaagcaaagatatcaggatcaaacgttatcttgaaagtaatatcgcggcgaataccaggtcaaattgtgaggataatcagtgtgttggaaaacctttcctttgagatccttcacttgaacatcagtagcatggaagatactgtcctttactcctttgtcattaaggtgagtgtggaggaactagcagttgaagtgcaacaaagcttctttcaagacacaatttatacatatgagttatag

SEQ ID NO: 3193 - protein, 200 aa, Populus balsamifera subsp. trichocarpa
  misc_feature (1)..(200): Ceres ANNOT ID no. 1513263
  misc_feature (1)..(50): Pfam Name: HLH Pfam Description: Helix-loop-helix DNA-binding domain
  misc_feature: SWISSPROT Homolog: ICE1_ARATH Transcription factor ICE1 (Inducer of CBF expression 1) (Basic helix-loop-helix protein 116) (bHLH116) (AtbHLH116) with e-value of 3.1e-11 and BLAST sequence identity of 31.5
  misc_feature: SWISSPROT Homolog: RAP1_ARATH Transcription factor AtMYC2 (R-homologous Arabidopsis protein 1) with e-value of 8.9e-10 and BLAST sequence identity of 26.0
  misc_feature: SWISSPROT Homolog: RAP1_ARATH RAP-1 (Basic helix-loop-helix protein 6) bHLH6 (AtbHLH006) (rd22BP1)
  misc_feature: SWISSPROT Homolog: TT8_ARATH TRANSPARENT TESTA 8 protein (Basic helix-loop-helix protein 42) (bHLH42) (AtbHLH042) with e-value of 5.9e-06 and BLAST sequence identity of 34.5
  misc_feature 355600:<222: Transcription Factor
  misc_feature: Phenotype: FLOWER - Reduced fertility Useful for sterility, genetic confinement systems
  misc_feature (1)..(200): Functional Homolog of  Ceres CLONE ID no. 545208 at SEQ ID NO. 3236 with e-value of 4.39E-63 and BLAST sequence identity of 79.1
MSHIAVERNRRRQMNEHLKVLRSLTPCFYIKRGDQASIIGGAIEFIKELHQVLQALESKKQRKSSLSPSPGPCLSPSPRAPLQLITSSLHPDHHNPFPFGNIENDLKELGAACCNSPIADVEAKISGSNVILKVISRRIPGQIVRIISVLENLSFEILHLNISSMEDTVLYSFVIKVSVEELAVEVQQSFFQDTIYTYEL

SEQ ID NO: 3194 - DNA, 1044 bp, Populus balsamifera subsp. trichocarpa
  misc_feature (1)..(1044): Ceres ANNOT ID no. 1467410
  misc_feature 355672:<222: Transcription Factor
  misc_feature: Phenotype: FLOWER - Reduced fertility Useful for sterility, genetic confinement systems
atgactgagagtttgtctgattttcttgaagaagtacaacctgaatttggcgacactgcctttgatgcagatgatttgtttgctatttttgagagtttagacagtgtaacagatttccctccggtaacaccattagacgaagctgttgttagctcaaaagaaagcgaagaaacaaggcagttggtgtcacaaaagtcttcatcttctaacgctttgcatgattttgatgagaccaataatgagcttgaaacttctccaaaaagcaagagacaaaagatttcagcgtcagcagcagccacagcttcttcagatcaggaagtaaatccagatgggcagcaacgtatgtctcatattacagtggaacgcaaccggcgaaagcagatgaatgagcacttgtctgttttaaggtccctcatgccttgcttctatgtcaaaagaggagaccaagcatcaataataggaggagttgttgattacatcaatgagttgcagcaagttctacaatcacttgaagccaagaagaaaaggaaagtttatagtgaagttcttagccctaggattgtttcaagtccaagaccttcaccacttagccctagaaaaccaccactaagtcctagacttaatttgcccattagcccaagaactccacaaccatgtagtccttacaagccaagaatattgcaacaaggttacctttctcctaccatggctaattcacttgaatcatctccatctccatcttcttcctcctccattaatgacaacattaacgaactcgtcgcgaattccaagtcagcaattgctgatgttgaggttaaattctcaggcccaaatgttctattgaagactgtatctcctcagattcctggtcaggctgtgaaaataatttctgcccttgaagaccttgccctcgagattctacatgtgagcattagcatagtagatcatgaaactatgctcaactccttcacaatcaagattggaatcgaatgccaactaagcgctgaggaacttgctcaacaaattcagctaacattctgctaa

SEQ ID NO: 3195 - protein, 233 aa, Populus balsamifera subsp. trichocarpa
  misc_feature (1)..(233): Ceres ANNOT ID no. 1467410
  misc_feature (1)..(50): Pfam Name: HLH Pfam Description: Helix-loop-helix DNA-binding domain
  misc_feature: SWISSPROT Homolog: ICE1_ARATH Transcription factor ICE1 (Inducer of CBF expression 1) (Basic helix-loop-helix protein 116) (bHLH116) (AtbHLH116) with e-value of 3.1e-11 and BLAST sequence identity of 31.5
  misc_feature: SWISSPROT Homolog: RAP1_ARATH Transcription factor AtMYC2 (R-homologous Arabidopsis protein 1) with e-value of 8.9e-10 and BLAST sequence identity of 26.0
  misc_feature: SWISSPROT Homolog: RAP1_ARATH RAP-1 (Basic helix-loop-helix protein 6) bHLH6 (AtbHLH006) (rd22BP1)
  misc_feature: SWISSPROT Homolog: TT8_ARATH TRANSPARENT TESTA 8 protein (Basic helix-loop-helix protein 42) (bHLH42) (AtbHLH042) with e-value of 5.9e-06 and BLAST sequence identity of 34.5
  misc_feature 355770:<222: Transcription Factor
  misc_feature: Phenotype: FLOWER - Reduced fertility Useful for sterility, genetic confinement systems
  misc_feature (1)..(233): Functional Homolog of  Ceres CLONE ID no. 545208 at SEQ ID NO. 3236 with e-value of 3.29E-42 and BLAST sequence identity of 61.9
MSHITVERNRRKQMNEHLSVLRSLMPCFYVKRGDQASIIGGVVDYINELQQVLQSLEAKKKRKVYSEVLSPRIVSSPRPSPLSPRKPPLSPRLNLPISPRTPQPCSPYKPRILQQGYLSPTMANSLESSPSPSSSSSINDNINELVANSKSAIADVEVKFSGPNVLLKTVSPQIPGQAVKIISALEDLALEILHVSISIVDHETMLNSFTIKIGIECQLSAEELAQQIQLTFC

SEQ ID NO: 3196 - protein, 39 aa, Glycine max
  misc_feature (1)..(39): Ceres CLONE ID no. 545780
  misc_feature: Utility: MSX Useful for making plants tolerant to low nitrogen
  misc_feature: Phenotype: WHOLE PLANT - MSX Useful for making plants tolerant to low nitrogen
MTEEEALAEQQRMFAEARARMNGGAITSKQPDAHQSLES

SEQ ID NO: 3197 - protein, 353 aa, Glycine max
  misc_feature (1)..(353): Ceres CLONE ID no. 548543
  misc_feature (1)..(353): Also Known As Ceres CDNA ID no. 23698996
  misc_feature (1)..(353): Also Known As Ceres GEMINI ID 540H6
  misc_feature (131)..(202): Pfam Name: RRM_1 Pfam Description: RNA recognition motif. (a.k.a. RRM RBD, or RNP domain)
  misc_feature 355906:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
MDYYYVSQHSQLESEADAYNVDVNDEHVKPSFNRRDSFSGKLFVGGISWETSQESFFNYFSKYGEVTDSVIMTNKLSGRPRGFGFVTFANSAVADEVLAQEHTIDHRVVEVKRTVPREDVDVTGVFKTKKIFVGGIAQFFTDDELREYFSPYGNVIECQIMLDHNTGRSRGFGFVTFDDEDSVEKVFSVGKIHEIGGKQVEIKRAEPKRSGVDYCNTSRKSYGGFGNEMDGHGGNSSRNRNHGKRGGQYTGSGMNGAYGHFDGSFGGSAATVYGGYCGYGYEFGYGGPMYCFGGYGLNSYGNPGGYGSGITSYGDVNAYGRAGSFNGSGGYDSSKVAEKGDGPTTGRYHPYWK

SEQ ID NO: 3198 - DNA, 1377 bp, Populus balsamifera subsp. trichocarpa
  misc_feature (1)..(1377): Ceres ANNOT ID no. 1487252
  misc_feature 356001:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
atggattatgattatccaccgcaagagaggcaatatggagataacgtccttgcctttaaccgccatagtgacgaagagcatcagcagcagcagcagcagcagcagcagcaagaaggtttttatgaggaagaacagcaacagcaggagggggacataggtagtggaggaattgaaagaaacctatcaatgaatcatcatcatcatcatcacaatcgtgactcttcttctgcaggaaaactctttgttggtggtgtctcctgggaaactactgaagaaacgttcactaattactttagcaagtatggagaagtcatggactctgtaataatgactgatagacattctggaaggccacgagggtttgggtttgtaacatttgctgaccctgcagttgctgatagggttttggaggaagaccatgttatagatggcagagcggtggaagtgaagaggacagttccaagggaagatatggacgttaaaggagtaacaagaacaaagaaaatttttgttggtggaataccaccttctttgactgaagatgagttaaaggaatacttctctgtttatggtagcattgtagaccaccagattatgctagatcataagactggaaggtctaggggatttgggtttgtcacatttgacattgaagatgctgtagaacaaatcttttcagagggcagaacacatgagcttggtggtaaacaggtggaaataaagaaggctgaaccaaagagaactggtggtgattatggcagtacagcaaagtcttatactggattcagcaatggtgcaggtggctttggtgctggcaatggtgcgagtggctttggtgctggcaatagttctgtaggtcgttatggtcgaaaaatgggcagaggatatgatgggtatagtggctatgatggttatgggagttatgggagttatggaggaaactaccctgcaggcactgctggtttttatggtggttatggtgcatatggttatggtttcgggtttggtgggccaatgatgtatggaactggtgtctatggaggaagtggttatggcattccaagtagttacaataatgctgccgagtatggtggtggtaaagcatatgggagaactggtgatgatgatggttttggcagcggtaaaaggtatgacaatggcgatgctcttggtggtggctatggtagtaataaggggtatgctggcggtgcaaatggtggtgctgctgttactggaaggtatcatccttacctaaaaattcagcatgaatacattgacgaaaacattgctggaaagacaatggacaatgacagtccagggaacaatgtcagattcagaagtagtggcagaatcggtagcattgacctatgcgagtag

SEQ ID NO: 3199 - protein, 458 aa, Populus balsamifera subsp. trichocarpa
  misc_feature (1)..(458): Ceres ANNOT ID no. 1487252
  misc_feature (169)..(240): Pfam Name: RRM_1 Pfam Description: RNA recognition motif. (a.k.a. RRM RBD, or RNP domain)
  misc_feature: SWISSPROT Homolog: RO22_XENLA Heterogeneous nuclear ribonucleoprotein A2 homolog 2 (hnRNP A2 (B)) with e-value of 2.6e-52 and BLAST sequence identity of 42.3
  misc_feature: SWISSPROT Homolog: ROA1_HUMAN Heterogeneous nuclear ribonucleoprotein A1 with e-value of 3.3e-52 and BLAST sequence identity of 43.1
  misc_feature: SWISSPROT Homolog: ROA1_HUMAN Helix-destabilizing protein Single-strand RNA-binding protein hnRNP core protein A1
  misc_feature: SWISSPROT Homolog: ROA2_MOUSE Heterogeneous nuclear ribonucleoproteins A2/B1 (hnRNP A2 / hnRNP B1) with e-value of 5.4e-52 and BLAST sequence identity of 42.8
  misc_feature: SWISSPROT Homolog: ROA2_HUMAN Heterogeneous nuclear ribonucleoproteins A2/B1 (hnRNP A2 / hnRNP B1) with e-value of 5.4e-52 and BLAST sequence identity of 42.8
  misc_feature: SWISSPROT Homolog: ROA3_HUMAN Heterogeneous nuclear ribonucleoprotein A3 (hnRNP A3) with e-value of 6.9e-52 and BLAST sequence identity of 40.9
  misc_feature 356128:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (1)..(458): Functional Homolog of  Ceres CLONE ID no. 548543 at SEQ ID NO. 3244 with e-value of 2.10E-98 and BLAST sequence identity of 59.4
MDYDYPPQERQYGDNVLAFNRHSDEEHQQQQQQQQQQEGFYEEEQQQQEGDIGSGGIERNLSMNHHHHHHNRDSSSAGKLFVGGVSWETTEETFTNYFSKYGEVMDSVIMTDRHSGRPRGFGFVTFADPAVADRVLEEDHVIDGRAVEVKRTVPREDMDVKGVTRTKKIFVGGIPPSLTEDELKEYFSVYGSIVDHQIMLDHKTGRSRGFGFVTFDIEDAVEQIFSEGRTHELGGKQVEIKKAEPKRTGGDYGSTAKSYTGFSNGAGGFGAGNGASGFGAGNSSVGRYGRKMGRGYDGYSGYDGYGSYGSYGGNYPAGTAGFYGGYGAYGYGFGFGGPMMYGTGVYGGSGYGIPSSYNNAAEYGGGKAYGRTGDDDGFGSGKRYDNGDALGGGYGSNKGYAGGANGGAAVTGRYHPYLKIQHEYIDENIAGKTMDNDSPGNNVRFRSSGRIGSIDLCE

SEQ ID NO: 3200 - protein, 246 aa, Glycine max
  misc_feature (1)..(246): Ceres CLONE ID no. 556734
  misc_feature (1)..(246): Also Known As Ceres CDNA ID no. 23693238
  misc_feature (1)..(246): Also Known As Ceres GEMINI ID 553A4
  misc_feature (1)..(238): Pfam Name: AUX_IAA Pfam Description: AUX/IAA family
  misc_feature 356269:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
MVFEETELRLGLGLCLPGNGTTATTEAAAAELGVRKRGFSETETDETATVDLMLNLSPKEAAAADGADPREKPKTSPKEKTLLLPDPAKPPAKAQVVGWPPVRSFRKNMFAAQKSSGGEESEKSSPNASFVKVSMDGAPYLRKVDLKMYKSYPELSDALGKMFSSFTIGNCESQGFKDFMNESKLMDLLNSSDYVPTYEDRDGDWMLVGDVPWEMFVESCKRLRIMKGKEAIGLAPRAVEKCKNRS

SEQ ID NO: 3201 - DNA, 714 bp, Populus balsamifera subsp. trichocarpa; identical to SEQ ID NO: 1726
  misc_feature (1)..(714): Ceres ANNOT ID no. 1495750
  misc_feature 356343:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis

SEQ ID NO: 3202 - protein, 229 aa, Populus balsamifera subsp. trichocarpa
  misc_feature (1)..(229): Ceres ANNOT ID no. 1495750
  misc_feature (1)..(219): Pfam Name: AUX_IAA Pfam Description: AUX/IAA family
  misc_feature: SWISSPROT Homolog: AUX28_SOYBN Auxin-induced protein AUX28 with e-value of 8.1e-97 and BLAST sequence identity of 80.8
  misc_feature: SWISSPROT Homolog: IAA7_ARATH Auxin-responsive protein IAA7 Indoleacetic acid-induced protein 7 (Auxin resistant 2) with e-value of 2.1e-73 and BLAST sequence identity of 64.8
  misc_feature: SWISSPROT Homolog: IAA14_ARATH Auxin-responsive protein IAA14 Indoleacetic acid-induced protein 14 (SOLITARY-ROOT protein) with e-value of 3.6e-71 and BLAST sequence identity of 66.0
  misc_feature: SWISSPROT Homolog: IAA16_ARATH Auxin-responsive protein IAA16 (Indoleacetic acid-induced protein 16) with e-value of 1.1e-67 and BLAST sequence identity of 61.0
  misc_feature: SWISSPROT Homolog: IAA17_ARATH Auxin-responsive protein IAA17 Indoleacetic acid-induced protein 17 (Auxin response 3) with e-value of 2.7e-66 and BLAST sequence identity of 65.3
  misc_feature 356438:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature (1)..(229): Functional Homolog of  Ceres CLONE ID no. 556734 at SEQ ID NO. 3247 with e-value of 3.20E-85 and BLAST sequence identity of 80.4
MGFEETELRLGLPGNGGGAEGEMVRKRGFSETVDLKLKLSSKESGADPNHEKTSSLQREKNLLATDPAKPPAKAQVVGWPPVRSFRKNMLAVQKSSTDQECEKVPGGNATFVKVSMDGAPYLRKVDLKMYKTYQELSDALGKMFSSFTIGNCGSHGLKDFLNESKLIDLLNGTDYVPTYEDKDGDWMLVGDVPWDMFVESCKRLRIMKGTEATGLAPRAMEKCKNRSYK

SEQ ID NO: 3203 - DNA, 729 bp, Populus balsamifera subsp. trichocarpa
  misc_feature (1)..(729): Ceres ANNOT ID no. 1522920
  misc_feature 356517:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
atgggagcagaacctgaaaagtatagcatgattaacttcgaagagactgaattacgtctagggttacctggaggaattggtaacggaaatgatggtgaggttgcaaagagtaatgggaagagagggttttctgagactgttgatttgaagcttaacctctctacaaaggaatcaggaaagggaggcgacgaggagaaagtaatgaaggagaagaccgttgctcctccggcctctactgatcctgcaaagccaccggccaaggcacaagttgtgggttggccacccattagatcattccgtaagaatgtcatggctgtacagaagaacagcaatgacaacggtgaaaaatccggtagcagtggcaccggtgtggcttttgttaaggttagcatggatggtgctccgtatttacgaaaagtggacttgaaattatacaagagctaccaagaactctctgacgctctaggcaaaatgttcagctccttcaccattggtaactgtggctcacaaggaatgaaagatttcatgaatgaaagcaaattgatagatcttttgaatggttccgattatgtgccaacttatgaagacaaggatggagattggatgcttgtaggagatgttccatgggaaatgtttgtggattcatgcaagcgcttgaggattatgaaagggtctgaggctattggacttgccccgagagccgtagagaagtgcaagaacagaatttga

SEQ ID NO: 3204 - protein, 233 aa, Populus balsamifera subsp. trichocarpa
  misc_feature (1)..(233): Ceres ANNOT ID no. 1522920
  misc_feature (2)..(225): Pfam Name: AUX_IAA Pfam Description: AUX/IAA family
  misc_feature: SWISSPROT Homolog: AUX28_SOYBN Auxin-induced protein AUX28 with e-value of 8.1e-97 and BLAST sequence identity of 80.8
  misc_feature: SWISSPROT Homolog: IAA7_ARATH Auxin-responsive protein IAA7 Indoleacetic acid-induced protein 7 (Auxin resistant 2) with e-value of 2.1e-73 and BLAST sequence identity of 64.8
  misc_feature: SWISSPROT Homolog: IAA14_ARATH Auxin-responsive protein IAA14 Indoleacetic acid-induced protein 14 (SOLITARY-ROOT protein) with e-value of 3.6e-71 and BLAST sequence identity of 66.0
  misc_feature: SWISSPROT Homolog: IAA16_ARATH Auxin-responsive protein IAA16 (Indoleacetic acid-induced protein 16) with e-value of 1.1e-67 and BLAST sequence identity of 61.0
  misc_feature: SWISSPROT Homolog: IAA17_ARATH Auxin-responsive protein IAA17 Indoleacetic acid-induced protein 17 (Auxin response 3) with e-value of 2.7e-66 and BLAST sequence identity of 65.3
  misc_feature 356614:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature (1)..(233): Functional Homolog of  Ceres CLONE ID no. 556734 at SEQ ID NO. 3247 with e-value of 2.60E-81 and BLAST sequence identity of 79.4
MINFEETELRLGLPGGIGNGNDGEVAKSNGKRGFSETVDLKLNLSTKESGKGGDEEKVMKEKTVAPPASTDPAKPPAKAQVVGWPPIRSFRKNVMAVQKNSNDNGEKSGSSGTGVAFVKVSMDGAPYLRKVDLKLYKSYQELSDALGKMFSSFTIGNCGSQGMKDFMNESKLIDLLNGSDYVPTYEDKDGDWMLVGDVPWEMFVDSCKRLRIMKGSEAIGLAPRAVEKCKNRI

SEQ ID NO: 3205 - DNA, 741 bp, Populus balsamifera subsp. trichocarpa
  misc_feature (1)..(741): Ceres ANNOT ID no. 1469532
  misc_feature 356693:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
atgactagcataatgggagcagaacctgaaaagtatagcatgattaacttcgaagagactgaattacgtctagggttacctggaggaattggtaacggaaatgatggtgaggttgcaaagagtaatgggaagagagggttttctgagactgttgatttgaagcttaacctctctacaaaggaatcaggaaagggaggcgacgaggagaaagtaatgaaggagaagaccgttgctcctccggcctctactgatcctgcaaagccaccggccaaggcacaagttgtgggttggccacccattagatcattccgtaagaatgtcatggctgtacagaagaacagcaatgacaacggtgaaaaatccggtagcagtggcaccggtgtggcttttgttaaggttagcatggatggtgctccgtatttacgaaaagtggacttgaaattatacaagagctaccaagaactctctgacgctctaggcaaaatgttcagctccttcaccattggtaactgtggctcacaaggaatgaaagatttcatgaatgaaagcaaattgatagatcttttgaatggttccgattatgtgccaacttatgaagacaaggatggagattggatgcttgtaggagatgttccatgggaaatgtttgtggattcatgcaagcgcttgaggattatgaaagggtctgaggctattggacttgccccgagagccgtagagaagtgcaagaacagaatttga

SEQ ID NO: 3206 - protein, 246 aa, Populus balsamifera subsp. trichocarpa
  misc_feature (1)..(246): Ceres ANNOT ID no. 1469532
  misc_feature (15)..(238): Pfam Name: AUX_IAA Pfam Description: AUX/IAA family
  misc_feature: SWISSPROT Homolog: AUX28_SOYBN Auxin-induced protein AUX28 with e-value of 8.1e-97 and BLAST sequence identity of 80.8
  misc_feature: SWISSPROT Homolog: IAA7_ARATH Auxin-responsive protein IAA7 Indoleacetic acid-induced protein 7 (Auxin resistant 2) with e-value of 2.1e-73 and BLAST sequence identity of 64.8
  misc_feature: SWISSPROT Homolog: IAA14_ARATH Auxin-responsive protein IAA14 Indoleacetic acid-induced protein 14 (SOLITARY-ROOT protein) with e-value of 3.6e-71 and BLAST sequence identity of 66.0
  misc_feature: SWISSPROT Homolog: IAA16_ARATH Auxin-responsive protein IAA16 (Indoleacetic acid-induced protein 16) with e-value of 1.1e-67 and BLAST sequence identity of 61.0
  misc_feature: SWISSPROT Homolog: IAA17_ARATH Auxin-responsive protein IAA17 Indoleacetic acid-induced protein 17 (Auxin response 3) with e-value of 2.7e-66 and BLAST sequence identity of 65.3
  misc_feature 356790:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature (1)..(246): Functional Homolog of  Ceres CLONE ID no. 556734 at SEQ ID NO. 3247 with e-value of 2.60E-81 and BLAST sequence identity of 79.4
MTSIMGAEPEKYSMINFEETELRLGLPGGIGNGNDGEVAKSNGKRGFSETVDLKLNLSTKESGKGGDEEKVMKEKTVAPPASTDPAKPPAKAQVVGWPPIRSFRKNVMAVQKNSNDNGEKSGSSGTGVAFVKVSMDGAPYLRKVDLKLYKSYQELSDALGKMFSSFTIGNCGSQGMKDFMNESKLIDLLNGSDYVPTYEDKDGDWMLVGDVPWEMFVDSCKRLRIMKGSEAIGLAPRAVEKCKNRI

SEQ ID NO: 3207 - DNA, 741 bp, Populus balsamifera subsp. trichocarpa; identical to SEQ ID NO: 1722
  misc_feature (1)..(741): Ceres ANNOT ID no. 1488767
  misc_feature 356872:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis

SEQ ID NO: 3208 - protein, 236 aa, Populus balsamifera subsp. trichocarpa; identical to SEQ ID NO: 1723
  misc_feature (1)..(236): Ceres ANNOT ID no. 1488767
  misc_feature (2)..(228): Pfam Name: AUX_IAA Pfam Description: AUX/IAA family
  misc_feature: SWISSPROT Homolog: AUX28_SOYBN Auxin-induced protein AUX28 with e-value of 8.1e-97 and BLAST sequence identity of 80.8
  misc_feature: SWISSPROT Homolog: IAA7_ARATH Auxin-responsive protein IAA7 Indoleacetic acid-induced protein 7 (Auxin resistant 2) with e-value of 2.1e-73 and BLAST sequence identity of 64.8
  misc_feature: SWISSPROT Homolog: IAA14_ARATH Auxin-responsive protein IAA14 Indoleacetic acid-induced protein 14 (SOLITARY-ROOT protein) with e-value of 3.6e-71 and BLAST sequence identity of 66.0
  misc_feature: SWISSPROT Homolog: IAA16_ARATH Auxin-responsive protein IAA16 (Indoleacetic acid-induced protein 16) with e-value of 1.1e-67 and BLAST sequence identity of 61.0
  misc_feature: SWISSPROT Homolog: IAA17_ARATH Auxin-responsive protein IAA17 Indoleacetic acid-induced protein 17 (Auxin response 3) with e-value of 2.7e-66 and BLAST sequence identity of 65.3
  misc_feature 356969:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature (1)..(236): Functional Homolog of  Ceres CLONE ID no. 556734 at SEQ ID NO. 3247 with e-value of 4.30E-81 and BLAST sequence identity of 78.3

SEQ ID NO: 3209 - DNA, 753 bp, Populus balsamifera subsp. trichocarpa
  misc_feature (1)..(753): Ceres ANNOT ID no. 1542198
  misc_feature 357048:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
atgaccagcataatgggagcagaaacagctgacacctacagcatgattaattatgaagagactgaattacgcctagggttacctggaggtgctagtaatggaaatgatggtgaggctgcaaagggtaatgggaagagagggttttcagagacggttgacttgaagcttaacctttcaactaaagaaactggaaaggatggatcagatcaggagaaagtagtaatgaaggagaaaactgttgctcctcgccccaatgatcctgcaaagccaccgtccaaggcacaagttgtgggttggccacccattagatcattccgtaaaaatgtcatggccgtccagaagaacagcaacgatgagggtgaaaaggccagtagcagtggcactactggtactgcagctttcgttaaggttagcatggatggtgccccatacttgcgaaaagtggacttgaaattatacaagagctaccgagaactctctgatgctctaggcaaaatgttcagctccttcaccatcggtaactgtggctcacaaggaacgaaagatttcatgaatgaaagcaaattgatagatcttttgaatagttctgagtatgtgccaacttatgaagacaaggatggagattggatgcttgtaggagatgttccatggggaatgtttgtcgattcatgcaagcgcttgaggatcatgaaagggtctgaggccattggacttgccccaagagctgtggagaagtgcaagaacagaagttga

SEQ ID NO: 3210 - protein, 236 aa, Populus balsamifera subsp. trichocarpa; identical to SEQ ID NO: 1723
  misc_feature (1)..(236): Ceres ANNOT ID no. 1542198
  misc_feature (2)..(228): Pfam Name: AUX_IAA Pfam Description: AUX/IAA family
  misc_feature: SWISSPROT Homolog: AUX28_SOYBN Auxin-induced protein AUX28 with e-value of 8.1e-97 and BLAST sequence identity of 80.8
  misc_feature: SWISSPROT Homolog: IAA7_ARATH Auxin-responsive protein IAA7 Indoleacetic acid-induced protein 7 (Auxin resistant 2) with e-value of 2.1e-73 and BLAST sequence identity of 64.8
  misc_feature: SWISSPROT Homolog: IAA14_ARATH Auxin-responsive protein IAA14 Indoleacetic acid-induced protein 14 (SOLITARY-ROOT protein) with e-value of 3.6e-71 and BLAST sequence identity of 66.0
  misc_feature: SWISSPROT Homolog: IAA16_ARATH Auxin-responsive protein IAA16 (Indoleacetic acid-induced protein 16) with e-value of 1.1e-67 and BLAST sequence identity of 61.0
  misc_feature: SWISSPROT Homolog: IAA17_ARATH Auxin-responsive protein IAA17 Indoleacetic acid-induced protein 17 (Auxin response 3) with e-value of 2.7e-66 and BLAST sequence identity of 65.3
  misc_feature 357145:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature (1)..(236): Functional Homolog of  Ceres CLONE ID no. 556734 at SEQ ID NO. 3247 with e-value of 4.30E-81 and BLAST sequence identity of 78.3

SEQ ID NO: 3211 - DNA, 690 bp, Populus balsamifera subsp. trichocarpa; identical to SEQ ID NO: 1728
  misc_feature (1)..(690): Ceres ANNOT ID no. 1452612
  misc_feature 357224:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis

SEQ ID NO: 3212 - protein, 221 aa, Populus balsamifera subsp. trichocarpa
  misc_feature (1)..(221): Ceres ANNOT ID no. 1452612
  misc_feature (1)..(218): Pfam Name: AUX_IAA Pfam Description: AUX/IAA family
  misc_feature: SWISSPROT Homolog: AUX28_SOYBN Auxin-induced protein AUX28 with e-value of 8.1e-97 and BLAST sequence identity of 80.8
  misc_feature: SWISSPROT Homolog: IAA7_ARATH Auxin-responsive protein IAA7 Indoleacetic acid-induced protein 7 (Auxin resistant 2) with e-value of 2.1e-73 and BLAST sequence identity of 64.8
  misc_feature: SWISSPROT Homolog: IAA14_ARATH Auxin-responsive protein IAA14 Indoleacetic acid-induced protein 14 (SOLITARY-ROOT protein) with e-value of 3.6e-71 and BLAST sequence identity of 66.0
  misc_feature: SWISSPROT Homolog: IAA16_ARATH Auxin-responsive protein IAA16 (Indoleacetic acid-induced protein 16) with e-value of 1.1e-67 and BLAST sequence identity of 61.0
  misc_feature: SWISSPROT Homolog: IAA17_ARATH Auxin-responsive protein IAA17 Indoleacetic acid-induced protein 17 (Auxin response 3) with e-value of 2.7e-66 and BLAST sequence identity of 65.3
  misc_feature 357319:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature (1)..(221): Functional Homolog of  Ceres CLONE ID no. 556734 at SEQ ID NO. 3247 with e-value of 6.49E-78 and BLAST sequence identity of 79.3
MRFEETELRLGLPGNGGGGTEGGEFARKRGFSETVDLKLNLSSKEGGIDPNHEKTQREKNLLATDPAKPPAKAQVVGWPPVRSFRKNMLAVQKSSTDQESTDKVPGGNATFVKVSMDGAPYLRKVDLKMYKTYHELSDALGKMFSSFTIGNCGSHGMKDFLNESKLIDLLNGTDYVPTYEDKDGDWMLVGDVPWDMFVESCKRLRIMKGTEATGLGNEYTA

SEQ ID NO: 3213 - DNA, 747 bp, Populus balsamifera subsp. trichocarpa; identical to SEQ ID NO: 1718
  misc_feature (1)..(747): Ceres ANNOT ID no. 1459467
  misc_feature 357395:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis

SEQ ID NO: 3214 - protein, 248 aa, Populus balsamifera subsp. trichocarpa; identical to SEQ ID NO: 1719
  misc_feature (1)..(248): Ceres ANNOT ID no. 1459467
  misc_feature (13)..(240): Pfam Name: AUX_IAA Pfam Description: AUX/IAA family
  misc_feature: SWISSPROT Homolog: AUX28_SOYBN Auxin-induced protein AUX28 with e-value of 8.1e-97 and BLAST sequence identity of 80.8
  misc_feature: SWISSPROT Homolog: IAA7_ARATH Auxin-responsive protein IAA7 Indoleacetic acid-induced protein 7 (Auxin resistant 2) with e-value of 2.1e-73 and BLAST sequence identity of 64.8
  misc_feature: SWISSPROT Homolog: IAA14_ARATH Auxin-responsive protein IAA14 Indoleacetic acid-induced protein 14 (SOLITARY-ROOT protein) with e-value of 3.6e-71 and BLAST sequence identity of 66.0
  misc_feature: SWISSPROT Homolog: IAA16_ARATH Auxin-responsive protein IAA16 (Indoleacetic acid-induced protein 16) with e-value of 1.1e-67 and BLAST sequence identity of 61.0
  misc_feature: SWISSPROT Homolog: IAA17_ARATH Auxin-responsive protein IAA17 Indoleacetic acid-induced protein 17 (Auxin response 3) with e-value of 2.7e-66 and BLAST sequence identity of 65.3
  misc_feature 357492:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature (1)..(248): Functional Homolog of  Ceres CLONE ID no. 556734 at SEQ ID NO. 3247 with e-value of 7.10E-72 and BLAST sequence identity of 68.8

SEQ ID NO: 3215 - DNA, 759 bp, Populus balsamifera subsp. trichocarpa; identical to SEQ ID NO: 1730
  misc_feature (1)..(759): Ceres ANNOT ID no. 1442831
  misc_feature 357574:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis

SEQ ID NO: 3216 - protein, 244 aa, Populus balsamifera subsp. trichocarpa
  misc_feature (1)..(244): Ceres ANNOT ID no. 1442831
  misc_feature (1)..(195): Pfam Name: AUX_IAA Pfam Description: AUX/IAA family
  misc_feature: SWISSPROT Homolog: AUX28_SOYBN Auxin-induced protein AUX28 with e-value of 8.1e-97 and BLAST sequence identity of 80.8
  misc_feature: SWISSPROT Homolog: IAA7_ARATH Auxin-responsive protein IAA7 Indoleacetic acid-induced protein 7 (Auxin resistant 2) with e-value of 2.1e-73 and BLAST sequence identity of 64.8
  misc_feature: SWISSPROT Homolog: IAA14_ARATH Auxin-responsive protein IAA14 Indoleacetic acid-induced protein 14 (SOLITARY-ROOT protein) with e-value of 3.6e-71 and BLAST sequence identity of 66.0
  misc_feature: SWISSPROT Homolog: IAA16_ARATH Auxin-responsive protein IAA16 (Indoleacetic acid-induced protein 16) with e-value of 1.1e-67 and BLAST sequence identity of 61.0
  misc_feature: SWISSPROT Homolog: IAA17_ARATH Auxin-responsive protein IAA17 Indoleacetic acid-induced protein 17 (Auxin response 3) with e-value of 2.7e-66 and BLAST sequence identity of 65.3
  misc_feature 357671:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature (1)..(244): Functional Homolog of  Ceres CLONE ID no. 556734 at SEQ ID NO. 3247 with e-value of 1.89E-69 and BLAST sequence identity of 78.7
MGFEETELRLGLPGNGGGAEGEMVRKRGFSETVDLKLKLSSKESGADPNHEKTSSLQREKNLLATDPAKPPAKAQVVGWPPVRSFRKNMLAVQKSSTDQECEKVPGGNATFVKVSMDGAPYLRKVDLKMYKTYQELSDALGKMFSSFTIGNCGSHGLKDFLNESKLIDLLNGTDYVPTYEDKDGDWMLVGDVPWDTKSHGEVQEQKLQVVRATACSFDLVGRRNQKDDKTRRWIEQVVLVELFL

SEQ ID NO: 3217 - DNA, 834 bp, Populus balsamifera subsp. trichocarpa; identical to SEQ ID NO: 1720
  misc_feature (1)..(834): Ceres ANNOT ID no. 1516688
  misc_feature 357753:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis

SEQ ID NO: 3218 - protein, 267 aa, Populus balsamifera subsp. trichocarpa; identical to SEQ ID NO: 1721
  misc_feature (1)..(267): Ceres ANNOT ID no. 1516688
  misc_feature (114)..(259): Pfam Name: AUX_IAA Pfam Description: AUX/IAA family
  misc_feature: SWISSPROT Homolog: AUX28_SOYBN Auxin-induced protein AUX28 with e-value of 8.1e-97 and BLAST sequence identity of 80.8
  misc_feature: SWISSPROT Homolog: IAA7_ARATH Auxin-responsive protein IAA7 Indoleacetic acid-induced protein 7 (Auxin resistant 2) with e-value of 2.1e-73 and BLAST sequence identity of 64.8
  misc_feature: SWISSPROT Homolog: IAA14_ARATH Auxin-responsive protein IAA14 Indoleacetic acid-induced protein 14 (SOLITARY-ROOT protein) with e-value of 3.6e-71 and BLAST sequence identity of 66.0
  misc_feature: SWISSPROT Homolog: IAA16_ARATH Auxin-responsive protein IAA16 (Indoleacetic acid-induced protein 16) with e-value of 1.1e-67 and BLAST sequence identity of 61.0
  misc_feature: SWISSPROT Homolog: IAA17_ARATH Auxin-responsive protein IAA17 Indoleacetic acid-induced protein 17 (Auxin response 3) with e-value of 2.7e-66 and BLAST sequence identity of 65.3
  misc_feature 357852:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature (1)..(267): Functional Homolog of  Ceres CLONE ID no. 556734 at SEQ ID NO. 3247 with e-value of 1.39E-66 and BLAST sequence identity of 69.7

SEQ ID NO: 3219 - DNA, 885 bp, Populus balsamifera subsp. trichocarpa; identical to SEQ ID NO: 1724
  misc_feature (1)..(885): Ceres ANNOT ID no. 1463396
  misc_feature 357937:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis

SEQ ID NO: 3220 - protein, 294 aa, Populus balsamifera subsp. trichocarpa; identical to SEQ ID NO: 1725
  misc_feature (1)..(294): Ceres ANNOT ID no. 1463396
  misc_feature (14)..(269): Pfam Name: AUX_IAA Pfam Description: AUX/IAA family
  misc_feature: SWISSPROT Homolog: AUX28_SOYBN Auxin-induced protein AUX28 with e-value of 8.1e-97 and BLAST sequence identity of 80.8
  misc_feature: SWISSPROT Homolog: IAA7_ARATH Auxin-responsive protein IAA7 Indoleacetic acid-induced protein 7 (Auxin resistant 2) with e-value of 2.1e-73 and BLAST sequence identity of 64.8
  misc_feature: SWISSPROT Homolog: IAA14_ARATH Auxin-responsive protein IAA14 Indoleacetic acid-induced protein 14 (SOLITARY-ROOT protein) with e-value of 3.6e-71 and BLAST sequence identity of 66.0
  misc_feature: SWISSPROT Homolog: IAA16_ARATH Auxin-responsive protein IAA16 (Indoleacetic acid-induced protein 16) with e-value of 1.1e-67 and BLAST sequence identity of 61.0
  misc_feature: SWISSPROT Homolog: IAA17_ARATH Auxin-responsive protein IAA17 Indoleacetic acid-induced protein 17 (Auxin response 3) with e-value of 2.7e-66 and BLAST sequence identity of 65.3
  misc_feature 358038:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature (1)..(294): Functional Homolog of  Ceres CLONE ID no. 556734 at SEQ ID NO. 3247 with e-value of 4.59E-61 and BLAST sequence identity of 69.4

SEQ ID NO: 3221 - protein, 282 aa, Glycine max
  misc_feature (1)..(282): Ceres CLONE ID no. 557009
  misc_feature (28)..(91): Pfam Name: AP2 Pfam Description: AP2 domain
  misc_feature: Phenotype: ROSETTE LEAVES - Curled 1 Useful for making ornamental plants with altered leaf shape
  misc_feature: Phenotype: ROSETTE LEAVES - Curled 3 Useful for making ornamental plants with altered leaf shape
  misc_feature: Phenotype: WHOLE PLANT - Small Useful for modulating plant size
  misc_feature: Phenotype: WHOLE PLANT - Other Useful for making bigger plants
MDTCKKSPLKPWKKGPTRGKGGPQNASCEYRGVRQRTWGKWVAEIREPKKRTRLWLGSFATAEEAAMAYDEAARRLYGPDAYLNLPHLQPRSTSTITSGKFKWFPSKNFISMFPSCGLLNVNAQPSVHLIHQRLQELKRNSVVSQSSSSSSNDPKAEIQNVDSKNHGEDENPPKDVQTSSEEVLGDLQEKPQIDLHEFLQQMGILKEERQSERTDSSGSSTVREAVLTDDCDHLGVFSDKSVNWEALIEMHGLAGIQESEVTQLEAYEPNDDLTFSTSIWNF

SEQ ID NO: 3222 - DNA, 861 bp, Populus balsamifera subsp. trichocarpa; identical to SEQ ID NO: 13
  misc_feature (1)..(861): Ceres ANNOT ID no. 1474923
  misc_feature 358232:<222: Transcription Factor
  misc_feature: Phenotype: ROSETTE LEAVES - Curled 1 Useful for making ornamental plants with altered leaf shape
  misc_feature: Phenotype: ROSETTE LEAVES - Curled 3 Useful for making ornamental plants with altered leaf shape
  misc_feature: Phenotype: WHOLE PLANT - Small Useful for modulating plant size
  misc_feature: Phenotype: WHOLE PLANT - Other Useful for making bigger plants

SEQ ID NO: 3223 - protein, 286 aa, Populus balsamifera subsp. trichocarpa; identical to SEQ ID NO: 14
  misc_feature (1)..(286): Ceres ANNOT ID no. 1474923
  misc_feature (28)..(91): Pfam Name: AP2 Pfam Description: AP2 domain
  misc_feature: SWISSPROT Homolog: DRE2F_ARATH Dehydration-responsive element-binding protein 2F (DREB2F protein) with e-value of 6.4e-72 and BLAST sequence identity of 53.9
  misc_feature: SWISSPROT Homolog: DRE2G_ARATH Dehydration-responsive element-binding protein 2G (DREB2G protein) with e-value of 3.1e-30 and BLAST sequence identity of 67.1
  misc_feature: SWISSPROT Homolog: DRE2D_ARATH Putative dehydration-responsive element-binding protein 2D (DREB2D protein) with e-value of 4.2e-29 and BLAST sequence identity of 62.5
  misc_feature: SWISSPROT Homolog: DRE2C_ARATH Dehydration-responsive element-binding protein 2C (DREB2C protein) with e-value of 2.1e-27 and BLAST sequence identity of 61.5
  misc_feature: SWISSPROT Homolog: DRE2A_ARATH Dehydration-responsive element-binding protein 2A (DREB2A protein) with e-value of 4.3e-27 and BLAST sequence identity of 60.4
  misc_feature 358354:<222: Transcription Factor
  misc_feature: Phenotype: ROSETTE LEAVES - Curled 1 Useful for making ornamental plants with altered leaf shape
  misc_feature: Phenotype: ROSETTE LEAVES - Curled 3 Useful for making ornamental plants with altered leaf shape
  misc_feature: Phenotype: WHOLE PLANT - Small Useful for modulating plant size
  misc_feature: Phenotype: WHOLE PLANT - Other Useful for making bigger plants
  misc_feature (1)..(286): Functional Homolog of  Ceres CLONE ID no. 557009 at SEQ ID NO. 3268 with e-value of 6.49E-94 and BLAST sequence identity of 65.1

SEQ ID NO: 3224 - protein, 113 aa, Glycine max
  misc_feature (1)..(113): Ceres CLONE ID no. 561791
  misc_feature (55)..(88): Pfam Name: TPR_2 Pfam Description: Tetratricopeptide repeat
  misc_feature: Utility: MSX Useful for making plants tolerant to low nitrogen
  misc_feature: Phenotype: WHOLE PLANT - MSX Useful for making plants tolerant to low nitrogen
MGSGSVHWNVFDGVKIITATPEALMAEIDSAISNLEYSRATALLEADEGYDAHMADEAYKAGCAALAAGKLDEALRSLNLSLSKCPPDKTAALSKLNSLITLTSHHLLQVSSK

SEQ ID NO: 3225 - DNA, 405 bp, Populus balsamifera subsp. trichocarpa
  misc_feature (1)..(405): Ceres ANNOT ID no. 1486447
  misc_feature: Utility: MSX Useful for making plants tolerant to low nitrogen
  misc_feature 358526:<222: Transcription Factor
  misc_feature: Phenotype: WHOLE PLANT - MSX Useful for making plants tolerant to low nitrogen
atgggttccggagaagggagaacttactggagcgtttttgagggagtgagaagcatggcctcatcaaccccagaaactctcatggctgaaatcgacactgctatcggcaaattggaatacagccgtgccactgcacttctcgactctccatcaccaacacccaccaacacatcaaagactagcatgagctccgattcaggtgcaaatcctcaatacgatgtcaaaatggcagatggggcttacagggcaggctgtgcatccttggctgcagggaaacttgatgaggctcttcaatatttgaacgtctctctctcgaaatgtcctcctgataaaacctctgctgttgccaagcttcagtctcttatttctcttacttcacagcaactccagaaattgcccacttga

SEQ ID NO: 3226 - protein, 134 aa, Populus balsamifera subsp. trichocarpa
  misc_feature (1)..(134): Ceres ANNOT ID no. 1486447
  misc_feature (77)..(110): Pfam Name: TPR_2 Pfam Description: Tetratricopeptide repeat
  misc_feature: Utility: MSX Useful for making plants tolerant to low nitrogen
  misc_feature 358577:<222: Transcription Factor
  misc_feature: Phenotype: WHOLE PLANT - MSX Useful for making plants tolerant to low nitrogen
  misc_feature (1)..(134): Functional Homolog of  Ceres CLONE ID no. 561791 at SEQ ID NO. 3271 with e-value of 1.40E-29 and BLAST sequence identity of 68.8
MGSGEGRTYWSVFEGVRSMASSTPETLMAEIDTAIGKLEYSRATALLDSPSPTPTNTSKTSMSSDSGANPQYDVKMADGAYRAGCASLAAGKLDEALQYLNVSLSKCPPDKTSAVAKLQSLISLTSQQLQKLPT

SEQ ID NO: 3227 - protein, 110 aa, Glycine max
  misc_feature (1)..(110): Ceres CLONE ID no. 563522
  misc_feature: Phenotype: FLOWER - Reduced fertility Useful for sterility, genetic confinement systems
  misc_feature: Phenotype: INFLORESCENCE - Weak Useful for making stronger plants
  misc_feature: Phenotype: ROSETTE LEAVES - Interveinal Chlorosis Useful for making ornamental plants with modified color
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MSKRVRSPRLELRLNLSPPRAAATSIISSSELSPTESSMSSPVSVQSLESSCVSSEAEETRAMLLVGCPRCLMYVMLSEVDPKCPKCKSTVLLDFLNNEENNNTKKSSSE

SEQ ID NO: 3228 - DNA, 321 bp, Populus balsamifera subsp. trichocarpa
  misc_feature (1)..(321): Ceres ANNOT ID no. 1460321
  misc_feature 358708:<222: Transcription Factor
  misc_feature: Phenotype: FLOWER - Reduced fertility Useful for sterility, genetic confinement systems
  misc_feature: Phenotype: INFLORESCENCE - Weak Useful for making stronger plants
  misc_feature: Phenotype: ROSETTE LEAVES - Interveinal Chlorosis Useful for making ornamental plants with modified color
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgagtaaaggagggaatagcccgatgttggatttgaagctgaacctttcaccacctaggcctaatcaacaggttgaatcgctttcgaattcatcttgggatatgtcggcagacagctcatgtgtttcatcggagcctgaagacatgagtactgtcaactaccccagctgcccagacacaactcctatggtgctagttggctgtcctcgttgcctcatgtatattatgttatccgaggtggatcccaaatgcccgaaatgcaagagcacagtcttgcttgattttctccgcgaggaaaacaccaagaagacaacaaactga

SEQ ID NO: 3229 - protein, 106 aa, Populus balsamifera subsp. trichocarpa
  misc_feature (1)..(106): Ceres ANNOT ID no. 1460321
  misc_feature 358773:<222: Transcription Factor
  misc_feature: Phenotype: FLOWER - Reduced fertility Useful for sterility, genetic confinement systems
  misc_feature: Phenotype: INFLORESCENCE - Weak Useful for making stronger plants
  misc_feature: Phenotype: ROSETTE LEAVES - Interveinal Chlorosis Useful for making ornamental plants with modified color
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(106): Functional Homolog of  Ceres CLONE ID no. 563522 at SEQ ID NO. 3274 with e-value of 1.89E-23 and BLAST sequence identity of 59.0
MSKGGNSPMLDLKLNLSPPRPNQQVESLSNSSWDMSADSSCVSSEPEDMSTVNYPSCPDTTPMVLVGCPRCLMYIMLSEVDPKCPKCKSTVLLDFLREENTKKTTN

SEQ ID NO: 3230 - DNA, 342 bp, Populus balsamifera subsp. trichocarpa
  misc_feature (1)..(342): Ceres ANNOT ID no. 1508144
  misc_feature 358855:<222: Transcription Factor
  misc_feature: Phenotype: FLOWER - Reduced fertility Useful for sterility, genetic confinement systems
  misc_feature: Phenotype: INFLORESCENCE - Weak Useful for making stronger plants
  misc_feature: Phenotype: ROSETTE LEAVES - Interveinal Chlorosis Useful for making ornamental plants with modified color
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgagtcgaagaaatggtagcctcccaaagcttgacctcaagctgaacctctcaccaccaagggtgaacccaagagtggagtccccaggcagatcggcaacggtgtcaccaacatccccaccaagctcatgtgtgtcgtcagagaggagccacgatgacgctcttagatactctagcagccctgaagctacatccatggtgcttgtgggatgcccgaggtgcctcatgtatgtgatgctctctgaaaatgaccctaaatgccccaaatgcaagagtacagtgctgcttgatttcctccatgacaacaccaccaccaccactttgaagacaaggaggagctag

SEQ ID NO: 3231 - protein, 113 aa, Populus balsamifera subsp. trichocarpa
  misc_feature (1)..(113): Ceres ANNOT ID no. 1508144
  misc_feature 358920:<222: Transcription Factor
  misc_feature: Phenotype: FLOWER - Reduced fertility Useful for sterility, genetic confinement systems
  misc_feature: Phenotype: INFLORESCENCE - Weak Useful for making stronger plants
  misc_feature: Phenotype: ROSETTE LEAVES - Interveinal Chlorosis Useful for making ornamental plants with modified color
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(113): Functional Homolog of  Ceres CLONE ID no. 563522 at SEQ ID NO. 3274 with e-value of 1.30E-22 and BLAST sequence identity of 54.2
MSRRNGSLPKLDLKLNLSPPRVNPRVESPGRSATVSPTSPPSSCVSSERSHDDALRYSSSPEATSMVLVGCPRCLMYVMLSENDPKCPKCKSTVLLDFLHDNTTTTTLKTRRS

SEQ ID NO: 3232 - DNA, 333 bp, Populus balsamifera subsp. trichocarpa
  misc_feature (1)..(333): Ceres ANNOT ID no. 1541886
  misc_feature 359005:<222: Transcription Factor
  misc_feature: Phenotype: FLOWER - Reduced fertility Useful for sterility, genetic confinement systems
  misc_feature: Phenotype: INFLORESCENCE - Weak Useful for making stronger plants
  misc_feature: Phenotype: ROSETTE LEAVES - Interveinal Chlorosis Useful for making ornamental plants with modified color
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgagtcgagtaggagatagccccatgttggatttggagctgaacctttcaccatctaggcctaacccgctagtcgaatcaccgaaggcatcgatttcgaattcatcttctgaaatattgtcagcagagagctcttgtgtttcatcagagcctgaagacatgactgttaacttccccagaagcgtcgtcacaactcctatgttagtagctggctgtcctcgatgcctcatgtatgttctgttatccgaggtggatccgaaatgtccgaaatgcaagagcacagtcttgcttgattttctcagcgtggaaaacaccaagaagacaacgagctga

SEQ ID NO: 3233 - protein, 110 aa, Populus balsamifera subsp. trichocarpa
  misc_feature (1)..(110): Ceres ANNOT ID no. 1541886
  misc_feature 359070:<222: Transcription Factor
  misc_feature: Phenotype: FLOWER - Reduced fertility Useful for sterility, genetic confinement systems
  misc_feature: Phenotype: INFLORESCENCE - Weak Useful for making stronger plants
  misc_feature: Phenotype: ROSETTE LEAVES - Interveinal Chlorosis Useful for making ornamental plants with modified color
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(110): Functional Homolog of  Ceres CLONE ID no. 563522 at SEQ ID NO. 3274 with e-value of 1.70E-22 and BLAST sequence identity of 64.0
MSRVGDSPMLDLELNLSPSRPNPLVESPKASISNSSSEILSAESSCVSSEPEDMTVNFPRSVVTTPMLVAGCPRCLMYVLLSEVDPKCPKCKSTVLLDFLSVENTKKTTS

SEQ ID NO: 3234 - DNA, 435 bp, Populus balsamifera subsp. trichocarpa
  misc_feature (1)..(435): Ceres ANNOT ID no. 1475178
  misc_feature 359152:<222: Transcription Factor
  misc_feature: Phenotype: FLOWER - Reduced fertility Useful for sterility, genetic confinement systems
  misc_feature: Phenotype: INFLORESCENCE - Weak Useful for making stronger plants
  misc_feature: Phenotype: ROSETTE LEAVES - Interveinal Chlorosis Useful for making ornamental plants with modified color
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atggccttagatgtccaaacccaccaccaccaagttcatgttgatggtgctagaggtgagatatactacaaaaacaaaacgtcaaggatgagtcgaagaaacggtagcctcccaaagcttgacctcaagctcaacctatcaccaccaagggtgaacccgagagtggagtccccaggccggtcggcaacagtgtcaccaacatcccctccaagctcatgtgtgtcgtcagagatgagccaggatgacactctcagatactctagtagccctgaggctacatcaatggtgcttgtgggatgcccaaggtgcctcatgtatgtgatgctctctgagaatgaccctaaatgccccaaatgcaagagtacatggctgcttgatttcctccatgataacaccaccaccaccaccaccaccatgaagacaaggaagagctag

SEQ ID NO: 3235 - protein, 115 aa, Populus balsamifera subsp. trichocarpa
  misc_feature (1)..(115): Ceres ANNOT ID no. 1475178
  misc_feature 359221:<222: Transcription Factor
  misc_feature: Phenotype: FLOWER - Reduced fertility Useful for sterility, genetic confinement systems
  misc_feature: Phenotype: INFLORESCENCE - Weak Useful for making stronger plants
  misc_feature: Phenotype: ROSETTE LEAVES - Interveinal Chlorosis Useful for making ornamental plants with modified color
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(115): Functional Homolog of  Ceres CLONE ID no. 563522 at SEQ ID NO. 3274 with e-value of 2.00E-21 and BLAST sequence identity of 53.8
MSRRNGSLPKLDLKLNLSPPRVNPRVESPGRSATVSPTSPPSSCVSSEMSQDDTLRYSSSPEATSMVLVGCPRCLMYVMLSENDPKCPKCKSTWLLDFLHDNTTTTTTTMKTRKS

SEQ ID NO: 3236 - protein, 226 aa, Glycine max
  misc_feature (1)..(226): Ceres CLONE ID no. 563878
  misc_feature (1)..(226): Also Known As Ceres CDNA ID no. 23693590
  misc_feature (1)..(226): Also Known As Ceres GEMINI ID 540E8
  misc_feature (16)..(177): Pfam Name: Ras Pfam Description: Ras family
  misc_feature 359326:<222: Transcription Factor
  misc_feature: Phenotype: Activates expression of the gene endogenous to the AtBBE2 (SEQ ID NO 4151) regalutory region Useful for modulating Alkaloid Biosynthesis
MAFYNEEEKTEDYLFKIVLIGDSAVGKSNLLARFARDEFYPNSKSTIGVEFQTQKMDINGKEVKAQIWDTAGQERFRAVTSAYYRGAVGALLVYDISRHQTFDSIGRWLNELHTHSDMNVVTILVGNKSDLKDAREVATAEGKALAEAQGLFFMETSALDSSNVAAAFETVVKEIYNILSRKVMMSQELNKQDVTRIENGKTVVLQGEGEGDGEADAQSKKRCCSS

SEQ ID NO: 3237 - DNA, 675 bp, Populus balsamifera subsp. trichocarpa
  misc_feature (1)..(675): Ceres ANNOT ID no. 1474489
  misc_feature 359396:<222: Transcription Factor
  misc_feature: Phenotype: Activates expression of the gene endogenous to the AtBBE2 (SEQ ID NO 4151) regalutory region Useful for modulating Alkaloid Biosynthesis
atggccttttactctgaggatgacaaagcagaagattaccttttcaagattgttttaattggcgactcagctgttgggaaatcaaatttgcttgcaagatttgctagagatgaattctaccccaattcaaagtctacaataggggtagagttccaaacccaaaagatggatattaacggaaaggaaattaaagcacagatctgggacacagcaggtcaggagcgatttcgggctgtaacatctgcatactacagaggtgcagttggagctcttctcgtttatgacatcagtaggcgccaaacatttgatagcgttggcagatggcttaacgaacttcacactcactctgacatgaatgtagtaacaatacttgtcgggaataagtccgatctcaaggatgccagagaggtaccaacagtggaaggcaaggacttggctgaagcacagggtttgttcttcatggaaacttcagcactcgattcctccaacgttgctgctgcctttcagacagttgttaaagagatctacaatatattaagccggaaagttatactatcacaagaactcaataaaccaggtgctcctgagctgggaaacggaaagaccgtggttttacagggagatgggaatcaagaaggcaatgcagaaactaaaaaagggtgctgttcatcttag

SEQ ID NO: 3238 - protein, 224 aa, Populus balsamifera subsp. trichocarpa
  misc_feature (1)..(224): Ceres ANNOT ID no. 1474489
  misc_feature (16)..(177): Pfam Name: Ras Pfam Description: Ras family
  misc_feature: SWISSPROT Homolog: ARA4_ARATH Ras-related protein ARA-4 with e-value of 1.4e-67 and BLAST sequence identity of 64.7
  misc_feature: SWISSPROT Homolog: ARA1_ARATH Ras-related protein ARA-1 with e-value of 1.3e-66 and BLAST sequence identity of 62.8
  misc_feature: SWISSPROT Homolog: RB11A_LOTJA Ras-related protein Rab11A with e-value of 2.5e-61 and BLAST sequence identity of 55.6
  misc_feature: SWISSPROT Homolog: RB2BV_BETVU Ras-related protein Rab2BV with e-value of 4.2e-61 and BLAST sequence identity of 55.8
  misc_feature: SWISSPROT Homolog: RB11D_TOBAC Ras-related protein Rab11D with e-value of 5.3e-61 and BLAST sequence identity of 55.2
  misc_feature 359486:<222: Transcription Factor
  misc_feature: Phenotype: Activates expression of the gene endogenous to the AtBBE2 (SEQ ID NO 4151) regalutory region Useful for modulating Alkaloid Biosynthesis
  misc_feature (1)..(224): Functional Homolog of  Ceres CLONE ID no. 563878 at SEQ ID NO. 3283 with e-value of 1.10E-100 and BLAST sequence identity of 87.5
MAFYSEDDKAEDYLFKIVLIGDSAVGKSNLLARFARDEFYPNSKSTIGVEFQTQKMDINGKEIKAQIWDTAGQERFRAVTSAYYRGAVGALLVYDISRRQTFDSVGRWLNELHTHSDMNVVTILVGNKSDLKDAREVPTVEGKDLAEAQGLFFMETSALDSSNVAAAFQTVVKEIYNILSRKVILSQELNKPGAPELGNGKTVVLQGDGNQEGNAETKKGCCSS

SEQ ID NO: 3239 - DNA, 678 bp, Populus balsamifera subsp. trichocarpa
  misc_feature (1)..(678): Ceres ANNOT ID no. 1453294
  misc_feature 359564:<222: Transcription Factor
  misc_feature: Phenotype: Activates expression of the gene endogenous to the AtBBE2 (SEQ ID NO 4151) regalutory region Useful for modulating Alkaloid Biosynthesis
atggccttttactctgaggatgacaaagcagatgattacctttttaagattgttttaattggtgactcggctgttgggaaatcaaatttgcttgcaagatttgctagaaatgaattttaccctagttcaaagtcaacaataggggtagagttccaaacccaaaagatggatattaatggaaaggaaattaaagcacagatctgggacacagcaggtcaggagagatttcgggctgtaacttctgcatactacagaggtgcagttggagctctactggtttatgacatcagcaggcgccaaacatttgacagcattggcaaatggcttaacgaacttcatactcattctgacatgaatgtagtaacaattcttgtcgggaataaatctgatctcaaggatgccagagaggtatcgacagcagaaggcaaggccttggcagaggcgcagggtttgttcttcatggaaacttcagcgctcgattcctccaatgttgctgctgcctttcagacagttgttaaagagatctacaatatattaagccggaaagttatgatgtcgcaagaactcaataaaccaggtgctcccgagctgggaaatgggaagaccgtggttttaaagggagatggggatcaagaaggcaatgcagggactaaaaaaggatggtgttgttcatcttag

SEQ ID NO: 3240 - protein, 225 aa, Populus balsamifera subsp. trichocarpa
  misc_feature (1)..(225): Ceres ANNOT ID no. 1453294
  misc_feature (15)..(130): Pfam Name: MMR_HSR1 Pfam Description: GTPase of unknown function
  misc_feature: SWISSPROT Homolog: ARA4_ARATH Ras-related protein ARA-4 with e-value of 1.4e-67 and BLAST sequence identity of 64.7
  misc_feature: SWISSPROT Homolog: ARA1_ARATH Ras-related protein ARA-1 with e-value of 1.3e-66 and BLAST sequence identity of 62.8
  misc_feature: SWISSPROT Homolog: RB11A_LOTJA Ras-related protein Rab11A with e-value of 2.5e-61 and BLAST sequence identity of 55.6
  misc_feature: SWISSPROT Homolog: RB2BV_BETVU Ras-related protein Rab2BV with e-value of 4.2e-61 and BLAST sequence identity of 55.8
  misc_feature: SWISSPROT Homolog: RB11D_TOBAC Ras-related protein Rab11D with e-value of 5.3e-61 and BLAST sequence identity of 55.2
  misc_feature 359654:<222: Transcription Factor
  misc_feature: Phenotype: Activates expression of the gene endogenous to the AtBBE2 (SEQ ID NO 4151) regalutory region Useful for modulating Alkaloid Biosynthesis
  misc_feature (1)..(225): Functional Homolog of  Ceres CLONE ID no. 563878 at SEQ ID NO. 3283 with e-value of 7.50E-100 and BLAST sequence identity of 86.6
MAFYSEDDKADDYLFKIVLIGDSAVGKSNLLARFARNEFYPSSKSTIGVEFQTQKMDINGKEIKAQIWDTAGQERFRAVTSAYYRGAVGALLVYDISRRQTFDSIGKWLNELHTHSDMNVVTILVGNKSDLKDAREVSTAEGKALAEAQGLFFMETSALDSSNVAAAFQTVVKEIYNILSRKVMMSQELNKPGAPELGNGKTVVLKGDGDQEGNAGTKKGWCCSS

SEQ ID NO: 3241 - protein, 272 aa, Glycine max
  misc_feature (1)..(272): Ceres CLONE ID no. 566317
  misc_feature (106)..(272): Pfam Name: DUF617 Pfam Description: Protein of unknown function, DUF617
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
MKTLVMDTTSSTPQDSSSSKRHFHWTNKVGNEDPQLATSETMSKIIEEEDTNTKEKEQEEDDKAVPLPGPATKRKIQAVAISRLRSVLTVFSKNHRSNLPFGLGSRVVGTLFGYRRGHVHFAFQRDPTSQPAFLIELATPISGLVREMASGLVRIALECDKDKDSEEKKTTKKNKTLRLLQESVWRTYCNGKKCGFATRRECGAKDWDILKAVEPISMGAGVLPNSDGSDGEVMYMRARFERIVGSRDSEAFYMMNPDSNGAPELSIYLLRV

SEQ ID NO: 3242 - DNA, 747 bp, Populus balsamifera subsp. trichocarpa
  misc_feature (1)..(747): Ceres ANNOT ID no. 1489585
  misc_feature 359828:<222: Transcription Factor
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
atggctagagcatcacaagactcttcctccaagtggcacttccactggaccaaaaaggttggaaacgaagatgatgaagttccaatctttaagtcctcaaacaccattgaagaagaaaaaaaggaaaatgttaagagccatgtaggaatgtcaaccccaaagaaaaaactaccagcagtagcagttgctaggctccgatccgttgttacagcccttggtaagaaccgatcaagcctcccactggggcttggatcccgagttgtaggtaccctttttggatatcgccgtggtcatgtccattttgcatttcaaaaggatcccaattcacctccggctttccttattgaacttgctacaccaataagtggattggttagagagatggcatctgggttagtcagaattgccttggaatgtgacaaagagaaagaagaggaaaagaaagctgtgagattgcaggaagaaccaatgtggaggacttattgcaatggtaagaaatgtggtttcgctactaggaaggaatgtgggcctaaagaatggaagttattgaaagctgtagagccaatttcaatgggtgcaggggttttgccagggtgtgcaactgaggctggagctgatggtgaactcatgtatatgagagctaaatttgagagaattgtgggctctagagattctgaggctttctacatgatgaatcctgatagcaatggagctcctgagctcagtatctatctacttcgagtctaa

SEQ ID NO: 3243 - protein, 248 aa, Populus balsamifera subsp. trichocarpa
  misc_feature (1)..(248): Ceres ANNOT ID no. 1489585
  misc_feature (86)..(248): Pfam Name: DUF617 Pfam Description: Protein of unknown function, DUF617
  misc_feature 359899:<222: Transcription Factor
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature (1)..(248): Functional Homolog of  Ceres CLONE ID no. 566317 at SEQ ID NO. 3288 with e-value of 1.29E-88 and BLAST sequence identity of 76.9
MARASQDSSSKWHFHWTKKVGNEDDEVPIFKSSNTIEEEKKENVKSHVGMSTPKKKLPAVAVARLRSVVTALGKNRSSLPLGLGSRVVGTLFGYRRGHVHFAFQKDPNSPPAFLIELATPISGLVREMASGLVRIALECDKEKEEEKKAVRLQEEPMWRTYCNGKKCGFATRKECGPKEWKLLKAVEPISMGAGVLPGCATEAGADGELMYMRAKFERIVGSRDSEAFYMMNPDSNGAPELSIYLLRV

SEQ ID NO: 3244 - DNA, 750 bp, Populus balsamifera subsp. trichocarpa
  misc_feature (1)..(750): Ceres ANNOT ID no. 1467905
  misc_feature 359994:<222: Transcription Factor
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
atggctagaacctctgaagattcctcctccaagagacacttccactggaccaaaaaggttggaaacgaagatgttgaagctccaagcatcaagtcctcctcaaaccccaacgaacaagacaaaaatgaaaatgttaagagccatgttgcaatgccaaccccgaagaaaagactaccagcagtagcagttgctaggctccgatcggttcttgcagcccttggtaagaaccgatcaagccttccaatggggcttggatcccgagtggttggtaccctttttggatatcgccggggtcatgtccatttcgcatttcaaagggatcccaattcacctcctactttccttattgagctggctacaccaataagtggattggttagagagatggcatccgggttagtcagaattgcattggaatgtgacaaagagaaggaagatcaaaagaaagctgtgaaattgctggaagagccaatgtggaggacttattgcaatggaaagagacgtggttttgccacgaggaaggaatgtgggcataaagagtggaaggtactgaaagctgtagagccaatctcaatgggtgcaggtgttttgccagggtgtgcagcagagggtggagctgatggtgaactcatgtatatgagagctaagtttgaaagaattgtggggtctagagactctgaggctttctacatgatgaaccctgatagcaatggagctcctgagctcagcatctacctgcttagagtctga

SEQ ID NO: 3245 - protein, 249 aa, Populus balsamifera subsp. trichocarpa
  misc_feature (1)..(249): Ceres ANNOT ID no. 1467905
  misc_feature (87)..(249): Pfam Name: DUF617 Pfam Description: Protein of unknown function, DUF617
  misc_feature 360065:<222: Transcription Factor
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature (1)..(249): Functional Homolog of  Ceres CLONE ID no. 566317 at SEQ ID NO. 3288 with e-value of 7.09E-88 and BLAST sequence identity of 74.7
MARTSEDSSSKRHFHWTKKVGNEDVEAPSIKSSSNPNEQDKNENVKSHVAMPTPKKRLPAVAVARLRSVLAALGKNRSSLPMGLGSRVVGTLFGYRRGHVHFAFQRDPNSPPTFLIELATPISGLVREMASGLVRIALECDKEKEDQKKAVKLLEEPMWRTYCNGKRRGFATRKECGHKEWKVLKAVEPISMGAGVLPGCAAEGGADGELMYMRAKFERIVGSRDSEAFYMMNPDSNGAPELSIYLLRV

SEQ ID NO: 3246 - DNA, 780 bp, Populus balsamifera subsp. trichocarpa
  misc_feature (1)..(780): Ceres ANNOT ID no. 1517371
  misc_feature 360160:<222: Transcription Factor
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
atggccaagactccacatgactcttctttctctttctccaggagacacttcaactggagaaagaaagttgttgaggatgaagaagatgatgaggaaatcttaactttcaactcctcctcgcattgtgaggagttggaaaatgaccaggagcttagaatcacaatgcctgctgcgggtacaactcaatcagtaccgaggaaaaaaacacttccgattttggcattttctaagctccgatcagctcttactgttttcagtaagagccggtcagcctatcactcaggtttaggcaccagagttgtaggtacccttttcgggtatcgtcgtggacatgttcattttgcgtttcaagaagatgcaaaacagaatccagctctcttgattgagctagcaacaccaacaagtgtactggtccgagaaatggcttctgggttggttaggattgcattagaatgcgaaaagaaggcagggaagaaagcaggaaagttgctagaggagcctttatggaggacttactgtaacggtaagaaatgtgggtatgcatcgagacgtgaatgtaggcctgaagattggaaggttttgaaggccgtggagccagtttcaatgggagctggtgttttaccagggaatggagcagcagggtccgaaataggggagctcatgtacatgagagccaggtttgagagagttgtggggtcaaaagactcggaggcattttacatgatgaatcctgatgggtctggaggtcctgaacttagtatttatttgcttagagtttaa

SEQ ID NO: 3247 - protein, 259 aa, Populus balsamifera subsp. trichocarpa
  misc_feature (1)..(259): Ceres ANNOT ID no. 1517371
  misc_feature (99)..(259): Pfam Name: DUF617 Pfam Description: Protein of unknown function, DUF617
  misc_feature 360233:<222: Transcription Factor
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature (1)..(259): Functional Homolog of  Ceres CLONE ID no. 566317 at SEQ ID NO. 3288 with e-value of 4.40E-72 and BLAST sequence identity of 63.9
MAKTPHDSSFSFSRRHFNWRKKVVEDEEDDEEILTFNSSSHCEELENDQELRITMPAAGTTQSVPRKKTLPILAFSKLRSALTVFSKSRSAYHSGLGTRVVGTLFGYRRGHVHFAFQEDAKQNPALLIELATPTSVLVREMASGLVRIALECEKKAGKKAGKLLEEPLWRTYCNGKKCGYASRRECRPEDWKVLKAVEPVSMGAGVLPGNGAAGSEIGELMYMRARFERVVGSKDSEAFYMMNPDGSGGPELSIYLLRV

SEQ ID NO: 3248 - DNA, 786 bp, Populus balsamifera subsp. trichocarpa
  misc_feature (1)..(786): Ceres ANNOT ID no. 1512104
  misc_feature 360331:<222: Transcription Factor
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
atgaagacaataatggccaagaatcctcatgactcttctttctctttctccaggagatacttcaacaggggaaagaaagttgtcgaggatgaagaagatgatgatgaggaaatcttgactttcaactccttctcacattgttcggaagagttgaaagatgatcaggagcttagaatcacattgcctgctggtgcaattcaacctgctccaaggaaaaaaacccttccgattgtggcagtttctaagctcagatcagctcttactgttttgagtggccggtcaggctatcactcaggtaccagagtgataggtacccttttcgggtatcgtcgtggacatgttcatttttcatttcaagaagatgcaaaacagaatccagctttcttgattgagcttgcaacaccaacaagtatactagtccgagaaatggcttctgggttagttagaattgcactagagtgtgaaaagaaggcaggtaaaaaagcagggaagttgctagaggagcctttatggaggacttactgtaatggtaagaaatgtgggcatgcaacgagacgtgaatgtaggcctgaagattggaaagtcttgaaggctgtggagccagtttcaatgggagctggtgttttaccagggaatggggcaacagggtccgaaataggggagatcatgtacatgagagccaggtatgagagagttgtagggtcaaaagattcagaggcattttacatgatgaatcctgatgggcctggaggtcctgaacttagtatttatttgcttagagtttga

SEQ ID NO: 3249 - protein, 261 aa, Populus balsamifera subsp. trichocarpa
  misc_feature (1)..(261): Ceres ANNOT ID no. 1512104
  misc_feature (101)..(261): Pfam Name: DUF617 Pfam Description: Protein of unknown function, DUF617
  misc_feature 360404:<222: Transcription Factor
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature (1)..(261): Functional Homolog of  Ceres CLONE ID no. 566317 at SEQ ID NO. 3288 with e-value of 2.59E-67 and BLAST sequence identity of 62.5
MKTIMAKNPHDSSFSFSRRYFNRGKKVVEDEEDDDEEILTFNSFSHCSEELKDDQELRITLPAGAIQPAPRKKTLPIVAVSKLRSALTVLSGRSGYHSGTRVIGTLFGYRRGHVHFSFQEDAKQNPAFLIELATPTSILVREMASGLVRIALECEKKAGKKAGKLLEEPLWRTYCNGKKCGHATRRECRPEDWKVLKAVEPVSMGAGVLPGNGATGSEIGEIMYMRARYERVVGSKDSEAFYMMNPDGPGGPELSIYLLRV

SEQ ID NO: 3250 - DNA, 774 bp, Populus balsamifera subsp. trichocarpa
  misc_feature (1)..(774): Ceres ANNOT ID no. 1458837
  misc_feature 360502:<222: Transcription Factor
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
atggccaagaatcctcatgactcttctttctctttctccaggagatacttcaacaggggaaagaaagttgtcgaggatgaagaagatgatgatgaggaaatcttgactttcaactccttctcacattgttcggaagagttgaaagatgatcaggagcttagaatcacattgcctgctggtgcaattcaacctgctccaaggaaaaaaacccttccgattgtggcagtttctaagctcagatcagctcttactgttttgagtggccggtcaggctatcactcaggtaccagagtgataggtacccttttcgggtatcgtcgtggacatgttcatttttcatttcaagaagatgcaaaacagaatccagctttcttgattgagcttgcaacaccaacaagtatactagtccgagaaatggcttctgggttagttagaattgcactagagtgtgaaaagaaggcaggtaaaaaagcagggaagttgctagaggagcctttatggaggacttactgtaatggtaagaaatgtgggcatgcaacgagacgtgaatgtaggcctgaagattggaaagtcttgaaggctgtggagccagtttcaatgggagctggtgttttaccagggaatggggcaacagggtccgaaataggggagatcatgtacatgagagccaggtatgagagagttgtagggtcaaaagattcagaggcattttacatgatgaatcctgatgggcctggaggtcctgaacttagtatttatttgcttagagtttga

SEQ ID NO: 3251 - protein, 257 aa, Populus balsamifera subsp. trichocarpa
  misc_feature (1)..(257): Ceres ANNOT ID no. 1458837
  misc_feature (97)..(257): Pfam Name: DUF617 Pfam Description: Protein of unknown function, DUF617
  misc_feature 360573:<222: Transcription Factor
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature (1)..(257): Functional Homolog of  Ceres CLONE ID no. 566317 at SEQ ID NO. 3288 with e-value of 5.29E-67 and BLAST sequence identity of 62.6
MAKNPHDSSFSFSRRYFNRGKKVVEDEEDDDEEILTFNSFSHCSEELKDDQELRITLPAGAIQPAPRKKTLPIVAVSKLRSALTVLSGRSGYHSGTRVIGTLFGYRRGHVHFSFQEDAKQNPAFLIELATPTSILVREMASGLVRIALECEKKAGKKAGKLLEEPLWRTYCNGKKCGHATRRECRPEDWKVLKAVEPVSMGAGVLPGNGATGSEIGEIMYMRARYERVVGSKDSEAFYMMNPDGPGGPELSIYLLRV

SEQ ID NO: 3252 - protein, 194 aa, Glycine max
  misc_feature (1)..(194): Ceres CLONE ID no. 572121
  misc_feature (33)..(96): Pfam Name: AP2 Pfam Description: AP2 domain
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Reduced Apical Dominance Useful for modifying plant structure, ie increased branching
  misc_feature: Phenotype: SILIQUES - Short Useful for increasing seed/fruit yield or modifying fruit content
MRVSTEKLETEPESKKIKRIRGGGGGDSSNKHPLYRGVRMRNWGKWVSEIREPRKKSRIWLGTFPTPEMAARAHDVAALSIKGSAAILNFPHFANSLPRPASLAPRDVQAAAAKAAHMDPSSLSSLVSAMDLSSASDELSQIIELPSLESTDDGSVVLEKEFVFVDSLDAWMYQPPFGFDTEQDTGFEGLMWNY

SEQ ID NO: 3253 - DNA, 753 bp, Populus balsamifera subsp. trichocarpa
  misc_feature (1)..(753): Ceres ANNOT ID no. 1477450
  misc_feature 360759:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Reduced Apical Dominance Useful for modifying plant structure, ie increased branching
  misc_feature: Phenotype: SILIQUES - Short Useful for increasing seed/fruit yield or modifying fruit content
atgagtgatcatcatcaacaaaattcagagacggaaagtagctcaacaaactccttgtcaccagcctcaccctcttcacctttatctaactctacccaatcaaagaaacctctaaaagaccaagatttctctccttctaagaaaataaaaaggataagagactccaacaagcatccagtctatcgtggagttcgcatgaggaactggggcaaatgggtgtcagaaattcgtgagccacgcaaaaaatctcgcatttggttaggtacttttcctactccagaaatggcagcgcgtgcgcatgatgtcgctgctttaagcatcaaaggaaacccagctattcttaatttccccgaactcgccaattacttacctcgaccagcttcacttgctcctcgtgatgttcaagcagccgctgctaaagctgctcaaatggaccagtttgaccaaaaatctgaaacaacaaccacaacatctccatcgtcttcttcgacatcttctttgacatcacttgtttctttgatggacttgtcgtctcaagaggaagagctgtgtgagattgttgagttgccaagtcttgaaacgagttacgatgagttgagcaatgattttgtttacttcgactcgattgatgagtggatgtatcctccgccatggatgcaaagcatggaaaatcactgttgtggcggcggcggcgggtgtgcttgtgatgattttacattgccgaatgagagtactgttttatgggattattag

SEQ ID NO: 3254 - protein, 250 aa, Populus balsamifera subsp. trichocarpa
  misc_feature (1)..(250): Ceres ANNOT ID no. 1477450
  misc_feature (59)..(122): Pfam Name: AP2 Pfam Description: AP2 domain
  misc_feature: SWISSPROT Homolog: TINY_ARATH Transcriptional factor TINY with e-value of 4.5e-48 and BLAST sequence identity of 61.3
  misc_feature: SWISSPROT Homolog: DRE1D_ARATH Dehydration-responsive element-binding protein 1D with e-value of 2.4e-26 and BLAST sequence identity of 52.2
  misc_feature: SWISSPROT Homolog: DRE1D_ARATH DREB1D protein (C-repeat-binding factor 4) C-repeat/dehydration-responsive element-binding factor 4) (CRT/DRE-binding factor 4)
  misc_feature: SWISSPROT Homolog: DRE1B_ARATH Dehydration-responsive element-binding protein 1B with e-value of 3.0e-26 and BLAST sequence identity of 40.5
  misc_feature: SWISSPROT Homolog: DRE1B_ARATH DREB1B protein (C-repeat-binding factor 1) C-repeat/dehydration-responsive element-binding factor 1 (CRT/DRE-binding factor 1)
  misc_feature: SWISSPROT Homolog: DRE1C_ARATH Dehydration-responsive element-binding protein 1C with e-value of 3.5e-25 and BLAST sequence identity of 39.7
  misc_feature: SWISSPROT Homolog: DRE1C_ARATH DREB1C protein (C-repeat-binding factor 2) (C-repeat/dehydration-responsive element-binding factor 2) (CRT/DRE-binding factor 2)
  misc_feature: SWISSPROT Homolog: DRE1A_ARATH Dehydration-responsive element-binding protein 1A with e-value of 4.4e-25 and BLAST sequence identity of 64.0
  misc_feature: SWISSPROT Homolog: DRE1A_ARATH DREB1A protein (C-repeat-binding factor 3) C-repeat/dehydration-responsive element-binding factor 3) (CRT/DRE-binding factor 3)
  misc_feature 360908:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Reduced Apical Dominance Useful for modifying plant structure, ie increased branching
  misc_feature: Phenotype: SILIQUES - Short Useful for increasing seed/fruit yield or modifying fruit content
  misc_feature (1)..(250): Functional Homolog of  Ceres CLONE ID no. 572121 at SEQ ID NO. 3299 with e-value of 3.40E-56 and BLAST sequence identity of 81.2
MSDHHQQNSETESSSTNSLSPASPSSPLSNSTQSKKPLKDQDFSPSKKIKRIRDSNKHPVYRGVRMRNWGKWVSEIREPRKKSRIWLGTFPTPEMAARAHDVAALSIKGNPAILNFPELANYLPRPASLAPRDVQAAAAKAAQMDQFDQKSETTTTTSPSSSSTSSLTSLVSLMDLSSQEEELCEIVELPSLETSYDELSNDFVYFDSIDEWMYPPPWMQSMENHCCGGGGGCACDDFTLPNESTVLWDY

SEQ ID NO: 3255 - protein, 483 aa, Glycine max
  misc_feature (1)..(483): Ceres CLONE ID no. 590462
  misc_feature (186)..(483): Pfam Name: Glyco_hydro_1 Pfam Description: Glycosyl hydrolase family 1
  misc_feature: Phenotype: ROSETTE LEAVES - Curled 1 Useful for making ornamental plants with altered leaf shape
  misc_feature: Phenotype: WHOLE PLANT - Small Useful for modulating plant size
  misc_feature (477)..(477): Xaa is any aa, unknown, or other
MDSNGYLVVGVVAFALLCSFRVSLTDSVPLFSPVHDAASLTRNSFPAGFIFGAGSSAYQFEGAAKEGGRGPSIWDTFTHNHPEKIRDGANGDVAVDQYHRYKEDVKIMKDMNLDSYRFSISWPRILPKGKLSGGVNQEGINYYNNLINELLANGVLPYVTLFHWDLPQALEDEYGGFLSSHIVQGGYATGATAPGRCTGPQCLGGDAGTEPYIVTHNQILAHAAAVHVYKTKYQAHQKGKIGITLVSNWFIPLAENSTSDIKAARRAIDFQYGWYMEPLTKGEYPKNMRALVGSRLPKFTKWQAKLVNGSFDFIGLNYYSSGYINGVPPSNDKPNFLTDSRTNTSFERNGRPLGLRAASVWIYFYPRGLLDLLLYTKEKYNNPLIYITENGMNEFNDPTLSVEEALMDIYRIDYYYRHFFYLRSAIKAGANVKGFFAWSFLDCNEWFAGFTVRFGLNFVDYKDGLKRYPKLSAQWYXNFLKRN

SEQ ID NO: 3256 - DNA, 1470 bp, Populus balsamifera subsp. trichocarpa
  misc_feature (1)..(1470): Ceres ANNOT ID no. 1490788
  misc_feature 361143:<222: Transcription Factor
  misc_feature: Phenotype: ROSETTE LEAVES - Curled 1 Useful for making ornamental plants with altered leaf shape
  misc_feature: Phenotype: WHOLE PLANT - Small Useful for modulating plant size
atggcaactcaaagctatgtgttgtgtattctcattcttggcttggtagccagtaatattgtagcctctactacacctagccatgagattcattcttttaatcgtcagagttttccaccaggtttcatttttggggcagcatcagcagcttaccagtacgaaggtgcagctttccaagatggcaaaggactaagcatatgggatacatttacgcataaatttcctgaaaaaatagctgatcgtagcaatggagacgtggctgatgatcaatatcatcgttacaaggaagatgttaagatcatgaaagacatgggcttagactcctacagattttcaatctcatggcctagaatattgccaaaaggaaagctgagtgggggagtgaataaagcaggaatcaaatactacaacaacctcattaatgagctcgtagcaaatggcttaaaacccctggtgactcttttccattgggacactcctcaagccttagattctgagtatgggagttttctaagtactaggattgtagaatttggagatagagttaagcactggatcacattgaatgaaccaaatatctttacttcgggaggctatgcttctggtggtggtgcaccaaatagatgttcagcttggcagaatttaaattgtactggtggagattcatcaacagaaccatatgtggtaggacacaatctgattaaatctcatgctgctgctgtaagattatacaaggcaaaataccaggcaactcaaaagggcataatagggatcacagtagcatcccactggtttttgccatactctaattctacacaggacaaagctgctgcacaacggtccctggatttcttgtatggatggtacatggatccagtagttttcggtgattatccaagttcaatgaggtctcttgttgggaaaagattacccaaattcaccaaggaggaatctgcatttataaagggatcatttgattttattgggttgaattactacactgctttctatgcggaaaatttgcctatatcaaatatttcacatccaagctccttgacggatagtcttgccaccagtaggagatcaacttggctccatgtttatcctaaaggaattcgtaaacttttgctctacaccaagaagaaatacaatgatccagttatttacatcactgagaatggcgtaagtgaggtaaataatgaaggcaaattaacgcttaagcaacaactaaatgacaccatgaggatcgattactaccgtagccatctctctttcttgagattagcaatggctgagggtgtcaaggtgaagggatacttcgcatggtcatttttggatgacttcgaatggaattctggttacaccgtaagatttggtatcatctacattgattataaaaatggattgaagagaatcccaaaactctcagctcggtggttcaagaacttcctcgagaaaaagaaggcatga

SEQ ID NO: 3257 - protein, 489 aa, Populus balsamifera subsp. trichocarpa
  misc_feature (1)..(489): Ceres ANNOT ID no. 1490788
  misc_feature (34)..(489): Pfam Name: Glyco_hydro_1 Pfam Description: Glycosyl hydrolase family 1
  misc_feature: SWISSPROT Homolog: BGLS_TRIRP Non-cyanogenic beta-glucosidase precursor (EC 3.2.1.21) with e-value of 5.1e-171 and BLAST sequence identity of 59.1
  misc_feature: SWISSPROT Homolog: BGLT_TRIRP Cyanogenic beta-glucosidase precursor (EC 3.2.1.21) (Linamarase) (Fragment) with e-value of 1.2e-126 and BLAST sequence identity of 73.5
  misc_feature: SWISSPROT Homolog: BGLC_MAIZE Beta-glucosidase, (EC 3.2.1.21)(Gentiobiase) (Cellobiase) (Beta-D-glucoside glucohydrolase) with e-value of 9.8e-110 and BLAST sequence identity of 42.4
  misc_feature: SWISSPROT Homolog: MYR3_SINAL Myrosinase MB3 precursor (EC 3.2.1.147) (Sinigrinase) (Thioglucosidase) with e-value of 4.2e-109 and BLAST sequence identity of 46.6
  misc_feature: SWISSPROT Homolog: MYRO_BRANA Myrosinase precursor (EC 3.2.1.147) (Sinigrinase) (Thioglucosidase) with e-value of 1.8e-108 and BLAST sequence identity of 46.0
  misc_feature 361271:<222: Transcription Factor
  misc_feature: Phenotype: ROSETTE LEAVES - Curled 1 Useful for making ornamental plants with altered leaf shape
  misc_feature: Phenotype: WHOLE PLANT - Small Useful for modulating plant size
  misc_feature (1)..(489): Functional Homolog of  Ceres CLONE ID no. 590462 at SEQ ID NO. 3302 with e-value of 1.39E-148 and BLAST sequence identity of 62.9
MATQSYVLCILILGLVASNIVASTTPSHEIHSFNRQSFPPGFIFGAASAAYQYEGAAFQDGKGLSIWDTFTHKFPEKIADRSNGDVADDQYHRYKEDVKIMKDMGLDSYRFSISWPRILPKGKLSGGVNKAGIKYYNNLINELVANGLKPLVTLFHWDTPQALDSEYGSFLSTRIVEFGDRVKHWITLNEPNIFTSGGYASGGGAPNRCSAWQNLNCTGGDSSTEPYVVGHNLIKSHAAAVRLYKAKYQATQKGIIGITVASHWFLPYSNSTQDKAAAQRSLDFLYGWYMDPVVFGDYPSSMRSLVGKRLPKFTKEESAFIKGSFDFIGLNYYTAFYAENLPISNISHPSSLTDSLATSRRSTWLHVYPKGIRKLLLYTKKKYNDPVIYITENGVSEVNNEGKLTLKQQLNDTMRIDYYRSHLSFLRLAMAEGVKVKGYFAWSFLDDFEWNSGYTVRFGIIYIDYKNGLKRIPKLSARWFKNFLEKKKA

SEQ ID NO: 3258 - DNA, 1494 bp, Populus balsamifera subsp. trichocarpa
  misc_feature (1)..(1494): Ceres ANNOT ID no. 1502230
  misc_feature 361404:<222: Transcription Factor
  misc_feature: Phenotype: ROSETTE LEAVES - Curled 1 Useful for making ornamental plants with altered leaf shape
  misc_feature: Phenotype: WHOLE PLANT - Small Useful for modulating plant size
atggccattcaaagctacttgttgttgagcctcctgctggtttttggctcttgttttaatagcctagctgctacccaaggtgacacagcttcattcaatcgcaagagctttcctcaagattttgtttttggggtagcatcatcggcataccagtatgagggcgcagcatttgaagatggaaagggaccaagcaagatatcaaatggcagcaatggagatgtcgccctagattcatatcatcggtacaaggaggatgttcagattataaaaaaaatgggctttgatttctacagattctcaatctcttggcctagaatattgccaaaaggaaaaaagtgcgggggcgtgaatcagaaaggaattaattactacaacaatctcatcaatgaactcctggccaatggcataaagccatttgtcacccttttccactgggatcttccacaggctttagaagacgagtatggaggatttttaagtgatagaattgtgaatgattatcaagactatgcgaaaatttgtttcgaaaattttggagatcgagttaaacattggatcacattgaatgagccaaccatgtttaccatgcaaggctatattgcgggcatgttcccaccaggtaggtgttctgcttggattggaaaaaactgcaccggtggagattcaggagcagaaccatacatggtgtcgcacaaccaaatccttgctcatgctgctgctgtgaaactgtacaggacaaggtttcaggcaaaacaaaagggcaagatagggattacattacaaacaaattggtttgtgccattgtctaatgctaaagaagaccttgaggctgtcagccgagccctcgatttcaatcttggatggtttatgagtccattaaccagtggcgaatatccaagttcaatgagatctcttgtaggagaaagattgcccaaattctccaagaaacaagctggatctataaagggatcatttgattttattggattgaattattattctgccaattatgtggcccataaatctcaatctaatgatacacaccgaagctatgagacagattcccatgttgcttccttctttgaacgtgatggaattcccatcggtccaaaggcaggctcattttggctcctcgtttacccaagtggacttcatgatcttttggtttacataaagaaggcatacaacgatccagttatttacatcaccgagaatggtgttgacgagacagataacccaagattgcccctaaaggatgccctcattgacaaccaaaggatcgattatttccatcagcatctttcttttgtgcaaaaagccatcaaggatggtgtgaaggtgaaaggatattttgcttggtcgttaatggatggcttcgagtgggtagtaggatacacatcacgtttcggtctgaattatatcgatcataaagatggactcaaaagacatcctaagctctcagcccaatggttcacgaaatttctcaagaaatag

SEQ ID NO: 3259 - protein, 497 aa, Populus balsamifera subsp. trichocarpa
  misc_feature (1)..(497): Ceres ANNOT ID no. 1502230
  misc_feature (33)..(497): Pfam Name: Glyco_hydro_1 Pfam Description: Glycosyl hydrolase family 1
  misc_feature: SWISSPROT Homolog: BGLS_TRIRP Non-cyanogenic beta-glucosidase precursor (EC 3.2.1.21) with e-value of 5.1e-171 and BLAST sequence identity of 59.1
  misc_feature: SWISSPROT Homolog: BGLT_TRIRP Cyanogenic beta-glucosidase precursor (EC 3.2.1.21) (Linamarase) (Fragment) with e-value of 1.2e-126 and BLAST sequence identity of 73.5
  misc_feature: SWISSPROT Homolog: BGLC_MAIZE Beta-glucosidase, (EC 3.2.1.21)(Gentiobiase) (Cellobiase) (Beta-D-glucoside glucohydrolase) with e-value of 9.8e-110 and BLAST sequence identity of 42.4
  misc_feature: SWISSPROT Homolog: MYR3_SINAL Myrosinase MB3 precursor (EC 3.2.1.147) (Sinigrinase) (Thioglucosidase) with e-value of 4.2e-109 and BLAST sequence identity of 46.6
  misc_feature: SWISSPROT Homolog: MYRO_BRANA Myrosinase precursor (EC 3.2.1.147) (Sinigrinase) (Thioglucosidase) with e-value of 1.8e-108 and BLAST sequence identity of 46.0
  misc_feature 361532:<222: Transcription Factor
  misc_feature: Phenotype: ROSETTE LEAVES - Curled 1 Useful for making ornamental plants with altered leaf shape
  misc_feature: Phenotype: WHOLE PLANT - Small Useful for modulating plant size
  misc_feature (1)..(497): Functional Homolog of  Ceres CLONE ID no. 590462 at SEQ ID NO. 3302 with e-value of 3.70E-146 and BLAST sequence identity of 63.6
MAIQSYLLLSLLLVFGSCFNSLAATQGDTASFNRKSFPQDFVFGVASSAYQYEGAAFEDGKGPSKISNGSNGDVALDSYHRYKEDVQIIKKMGFDFYRFSISWPRILPKGKKCGGVNQKGINYYNNLINELLANGIKPFVTLFHWDLPQALEDEYGGFLSDRIVNDYQDYAKICFENFGDRVKHWITLNEPTMFTMQGYIAGMFPPGRCSAWIGKNCTGGDSGAEPYMVSHNQILAHAAAVKLYRTRFQAKQKGKIGITLQTNWFVPLSNAKEDLEAVSRALDFNLGWFMSPLTSGEYPSSMRSLVGERLPKFSKKQAGSIKGSFDFIGLNYYSANYVAHKSQSNDTHRSYETDSHVASFFERDGIPIGPKAGSFWLLVYPSGLHDLLVYIKKAYNDPVIYITENGVDETDNPRLPLKDALIDNQRIDYFHQHLSFVQKAIKDGVKVKGYFAWSLMDGFEWVVGYTSRFGLNYIDHKDGLKRHPKLSAQWFTKFLKK

SEQ ID NO: 3260 - protein, 461 aa, Glycine max
  misc_feature (1)..(461): Ceres CLONE ID no. 597609
  misc_feature (1)..(461): Also Known As Ceres CDNA ID no. 23411827
  misc_feature (1)..(461): Also Known As Ceres GEMINI ID 531C11
  misc_feature (228)..(244): Pfam Name: AP2 Pfam Description: AP2 domain
  misc_feature 361688:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
MLDLNLTAESTQNDELLVLLDKFPEASSGTSNSSIVNAEGSSNEDSCSTRAGDVFTFNFGILKVEAANDVVAAATKELFPVSSENWQGQSSTSLFQARKSLMDLSLDQQHGEVKVVQVQPQPKVKKSRRGPRSRSSQYRGVTFYRRTGRWESHIWDCGKQVYLGGFDTAHAAARAYDRAAIKFRGLDADINFNLVDYEEDLKQMKNLSKEEFVHILRRHSSGFSRGSSKYRGVTLHKCGRWEARMGQFLGKKAYDKAAIKCNGREAVTNFEPSTYESEMKPEAINEGGSHDLDLSLGIATPGHGPKENRGHLQFQSIPYNMHPGRSSMMETNINSVIGDPSLKRLVVTEERPSVWNAAYSTFFPNLERAERMGTDPSKGVPNPNWAWQTHGQVTDTPVPPFSTAASSGFSISATFPSTAIFPTKSINSVPHSLCFTSPSTPGSNAPQFYNYYEVKSPQPPS

SEQ ID NO: 3261 - DNA, 1419 bp, Populus balsamifera subsp. trichocarpa
  misc_feature (1)..(1419): Ceres ANNOT ID no. 1538274
  misc_feature 361808:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
atgttggatcttaacttgagtgcggtttctggtgattcgtcaacgacagggaagaataataagcacaagcagaagaagattctagagctttccaaccctccactggaaagttctggcagcttcgattcttcttccatagtcaatgctgatggctgtggtgatgaggactcttgctccaacggagacctttttgcctacaatttcagtatctttggagatcgaacgatccagctttttccagttgcgtgtgggatcaagaatgtgggaggagagtctcagtcttcttcgacgatgcagatgcagtggtcgggtgtcggtgagtgcagggatcaaggttccccttcggagaacgggatcgtggctcaacaaaagccagtgaagaagagtcggcgtgggcccaggtcgagaagctcccagtatagaggagtcacgttttatcggagaactggaagatgggaatctcatatctgggattgtggaaagcaagtttacttggggggatttgatactgcacatgctgcagctagggtgtatgatcgagccgccattaagttccgtggagttgacgctgatatcaactttaacgttactgattatgatgaggatattaagcagatgcgtaatttcacaaaggaagaatttgtgcatatcctacgtcgtcagagcactggattctcgaggggcagctcaaaatatagaggagtgacgctgcacaaatgtgggcgatgggaggctcgtatggggcagttcctggggaagaagtacatttatcttgggctattcgatagcgagacagaagctgcaagggcttatgacaaggctgccattaaatgcaatggaagggaagcagttaccaactttgagccaagcacgtatgaaggagagatactttctgagcctaacaatggagacggcaaccaaaatcttgacctgaacttgggaattgctccccctgatacatctgatggcctaaaggtaaacagcaacatgggtggtttttatttccagagtggctgggatggcttgtctattgatagggcaccaaagattctgaactctgcttctgcaacgatgaaaaatcaacaacctaatggccctggaatgacatctgtacaccctcctacgtgggatggtgtaaatcatcacatctttcccatctatgaggaaagagcaatagagaagagaatggaagtagattccttcccaaattggaccaggcaaattcaaggcccttatggtggcggagcaaatccactgcctctcttctctactgcagcatcatcaggattcgcttcttcagcaattatggcaccttcagcagctgccggtcaacttcagtttccaagttccacaatcctccaccgttttcctccatttaccaaccccagcaacatctcgcaattctactgtagaagctga

SEQ ID NO: 3262 - protein, 472 aa, Populus balsamifera subsp. trichocarpa
  misc_feature (1)..(472): Ceres ANNOT ID no. 1538274
  misc_feature (138)..(200): Pfam Name: AP2 Pfam Description: AP2 domain
  misc_feature: SWISSPROT Homolog: AP2_ARATH Floral homeotic protein APETALA2 with e-value of 2.9e-76 and BLAST sequence identity of 50.0
  misc_feature: SWISSPROT Homolog: ANT_ARATH Protein AINTEGUMENTA (Complementing a protein kinase C mutant protein 1) (Protein Dragon) (Protein ovule mutant) with e-value of 4.3e-34 and BLAST sequence identity of 45.4
  misc_feature: SWISSPROT Homolog: BBM_ARATH Protein BABY BOOM (AtBBM) with e-value of 1.1e-33 and BLAST sequence identity of 45.9
  misc_feature: SWISSPROT Homolog: BBM1_BRANA Protein BABY BOOM 1 (BnBBM1) with e-value of 1.4e-33 and BLAST sequence identity of 40.8
  misc_feature: SWISSPROT Homolog: BBM2_BRANA Protein BABY BOOM 2 (BnBBM2) with e-value of 1.7e-33 and BLAST sequence identity of 40.8
  misc_feature 361934:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(472): Functional Homolog of  Ceres CLONE ID no. 597609 at SEQ ID NO. 3307 with e-value of 1.50E-101 and BLAST sequence identity of 60.2
MLDLNLSAVSGDSSTTGKNNKHKQKKILELSNPPLESSGSFDSSSIVNADGCGDEDSCSNGDLFAYNFSIFGDRTIQLFPVACGIKNVGGESQSSSTMQMQWSGVGECRDQGSPSENGIVAQQKPVKKSRRGPRSRSSQYRGVTFYRRTGRWESHIWDCGKQVYLGGFDTAHAAARVYDRAAIKFRGVDADINFNVTDYDEDIKQMRNFTKEEFVHILRRQSTGFSRGSSKYRGVTLHKCGRWEARMGQFLGKKYIYLGLFDSETEAARAYDKAAIKCNGREAVTNFEPSTYEGEILSEPNNGDGNQNLDLNLGIAPPDTSDGLKVNSNMGGFYFQSGWDGLSIDRAPKILNSASATMKNQQPNGPGMTSVHPPTWDGVNHHIFPIYEERAIEKRMEVDSFPNWTRQIQGPYGGGANPLPLFSTAASSGFASSAIMAPSAAAGQLQFPSSTILHRFPPFTNPSNISQFYCRS

SEQ ID NO: 3263 - DNA, 1482 bp, Populus balsamifera subsp. trichocarpa
  misc_feature (1)..(1482): Ceres ANNOT ID no. 1528771
  misc_feature 362065:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
atgttggatcttaacttgaccgcgggttctggtgactcgtcaacgacagcgaagaataataataagatgaagattctagagctttccaactctccaatggaaagttctgggagcttcaattcttcttctgtggtcaatgcggatggctgtggtgacgaggactcttgctccaacggcgacgtctttgctctcaatttcagtatcttgtcaaatgaaagcagctccaagaagaccgtttattctaacactaatgatcatgatgaccgtggagatcgaacgatccagctctttccagtggagtgtgggcccaagaatgtaggaggagagtctaactcttcttcgacggtgcagatgcagccggtggatctcggtgggtccaggaattatggtggtcctccggagcaggggatcggggctcgacaacaaaagcccgtgaaaaagagtcggcgtgggcccaggtcgagaagctcgcagtatagaggagtcacgttttatcggagaactggaagatgggaatctcatatttgggattgtggaaagcaagtgtacttggggggatttgatactgcacatgctgcagctagggcatatgatcgagctgcgatcaagttccgtggagttgatgctgacatcaactttaacgttagtgattatgatgaggacattaagcagatgagtggtttcacaaaggaagaatttgtgcatactctacggcgtcagagcactggattctctaggggaagctcaaaatatagaggagtgacactccacaagtgtggccgatgggaggctcgtatggggcagttcctgggaaagaagtacatttatcttgggctattcgatagcgagatagaagctgcaagggcttatgacaaggctgccattaaatgtaatggaagggaagcagttaccaactttgagccaagcaaatatgaaggggagatactttcagagcccagcagtggagacggcaaccaaaatcttgacctgaagttgggaattgcccctcccgatgcttctgatagcctaaaggtaaacagcaacatgggtggcttttatttccacggtggctgggatggcgtgtctactgatagggcaccaaagtttctgaactctgtttctgcaacaatgaaaaatcaactaccgaatggccccggagtgacatctgttcaccctcctatgtgggatggtataaatcatcgaatctttcccatctatgaggaaagagcaatagagaagagaatggaagtagattcctttccaaattggaccaggcaaatccaaggcccttatggtggtggagcaaatccactgcctctcttctctactgcagcatcatcaggattcgcttcttcagcaattatggcaccttcagcagctgctggtcaacttcactatccaagttcaacaatcctccaccatcgattttctcctccaattaccaaccccagcaacatctctcaattctactgtaggagctga

SEQ ID NO: 3264 - protein, 493 aa, Populus balsamifera subsp. trichocarpa
  misc_feature (1)..(493): Ceres ANNOT ID no. 1528771
  misc_feature (157)..(219): Pfam Name: AP2 Pfam Description: AP2 domain
  misc_feature: SWISSPROT Homolog: AP2_ARATH Floral homeotic protein APETALA2 with e-value of 2.9e-76 and BLAST sequence identity of 50.0
  misc_feature: SWISSPROT Homolog: ANT_ARATH Protein AINTEGUMENTA (Complementing a protein kinase C mutant protein 1) (Protein Dragon) (Protein ovule mutant) with e-value of 4.3e-34 and BLAST sequence identity of 45.4
  misc_feature: SWISSPROT Homolog: BBM_ARATH Protein BABY BOOM (AtBBM) with e-value of 1.1e-33 and BLAST sequence identity of 45.9
  misc_feature: SWISSPROT Homolog: BBM1_BRANA Protein BABY BOOM 1 (BnBBM1) with e-value of 1.4e-33 and BLAST sequence identity of 40.8
  misc_feature: SWISSPROT Homolog: BBM2_BRANA Protein BABY BOOM 2 (BnBBM2) with e-value of 1.7e-33 and BLAST sequence identity of 40.8
  misc_feature 362193:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(493): Functional Homolog of  Ceres CLONE ID no. 597609 at SEQ ID NO. 3307 with e-value of 3.19E-101 and BLAST sequence identity of 57.4
MLDLNLTAGSGDSSTTAKNNNKMKILELSNSPMESSGSFNSSSVVNADGCGDEDSCSNGDVFALNFSILSNESSSKKTVYSNTNDHDDRGDRTIQLFPVECGPKNVGGESNSSSTVQMQPVDLGGSRNYGGPPEQGIGARQQKPVKKSRRGPRSRSSQYRGVTFYRRTGRWESHIWDCGKQVYLGGFDTAHAAARAYDRAAIKFRGVDADINFNVSDYDEDIKQMSGFTKEEFVHTLRRQSTGFSRGSSKYRGVTLHKCGRWEARMGQFLGKKYIYLGLFDSEIEAARAYDKAAIKCNGREAVTNFEPSKYEGEILSEPSSGDGNQNLDLKLGIAPPDASDSLKVNSNMGGFYFHGGWDGVSTDRAPKFLNSVSATMKNQLPNGPGVTSVHPPMWDGINHRIFPIYEERAIEKRMEVDSFPNWTRQIQGPYGGGANPLPLFSTAASSGFASSAIMAPSAAAGQLHYPSSTILHHRFSPPITNPSNISQFYCRS

SEQ ID NO: 3265 - DNA, 1491 bp, Populus balsamifera subsp. trichocarpa
  misc_feature (1)..(1491): Ceres ANNOT ID no. 1484866
  misc_feature 362327:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
atgatgttggatcttaacttgagtgcggtttctggtgattcgtcaacgacagggaagaataataagcacaagcagaagaagattctagagctttccaaccctccactggaaagttctggcagcttcgattcttcttccatagtcaatgctgatggctgtggtgatgaggactcttgctccaacggagacctttttgcctacaatttcagtatcttgtcaaatgaaatcagcgtcaagaagaccgttgattgtgataattataataatgatgatggtgatgacagtggagatcgaacgatccagctttttccagttgcgtgtgggatcaagaatgtgggaggagagtctcagtcttcttcgacgatgcagatgcagtggtcgggtgtcggtgagtgcagggatcaaggttccccttcggagaacgggatcgtggctcaacaaaagccagtgaagaagagtcggcgtgggcccaggtcgagaagctcccagtatagaggagtcacgttttatcggagaactggaagatgggaatctcatatctgggattgtggaaagcaagtttacttggggggatttgatactgcacatgctgcagctagggtgtatgatcgagccgccattaagttccgtggagttgacgctgatatcaactttaacgttactgattatgatgaggatattaagcagatgcgtaatttcacaaaggaagaatttgtgcatatcctacgtcgtcagagcactggattctcgaggggcagctcaaaatatagaggagtgacgctgcacaaatgtgggcgatgggaggctcgtatggggcagttcctggggaagaagtacatttatcttgggctattcgatagcgagacagaagctgcaagggcttatgacaaggctgccattaaatgcaatggaagggaagcagttaccaactttgagccaagcacgtatgaaggagagatactttctgagcctaacaatggagacggcaaccaaaatcttgacctgaacttgggaattgctccccctgatacatctgatggcctaaaggtaaacagcaacatgggtggtttttatttccagagtggctgggatggcttgtctattgatagggcaccaaagattctgaactctgcttctgcaacgatgaaaaatcaacaacctaatggccctggaatgacatctgtacaccctcctacgtgggatggtgtaaatcatcacatctttcccatctatgaggaaagagcaatagagaagagaatggaagtagattccttcccaaattggaccaggcaaattcaaggcccttatggtggcggagcaaatccactgcctctcttctctactgcagcatcatcaggattcgcttcttcagcaattatggcaccttcagcagctgccggtcaacttcagtttccaagttccacaatcctccaccgttttcctccatttaccaaccccagcaacatctcgcaattctactgtagaagctga

SEQ ID NO: 3266 - protein, 495 aa, Populus balsamifera subsp. trichocarpa
  misc_feature (1)..(495): Ceres ANNOT ID no. 1484866
  misc_feature (161)..(223): Pfam Name: AP2 Pfam Description: AP2 domain
  misc_feature: SWISSPROT Homolog: AP2_ARATH Floral homeotic protein APETALA2 with e-value of 2.9e-76 and BLAST sequence identity of 50.0
  misc_feature: SWISSPROT Homolog: ANT_ARATH Protein AINTEGUMENTA (Complementing a protein kinase C mutant protein 1) (Protein Dragon) (Protein ovule mutant) with e-value of 4.3e-34 and BLAST sequence identity of 45.4
  misc_feature: SWISSPROT Homolog: BBM_ARATH Protein BABY BOOM (AtBBM) with e-value of 1.1e-33 and BLAST sequence identity of 45.9
  misc_feature: SWISSPROT Homolog: BBM1_BRANA Protein BABY BOOM 1 (BnBBM1) with e-value of 1.4e-33 and BLAST sequence identity of 40.8
  misc_feature: SWISSPROT Homolog: BBM2_BRANA Protein BABY BOOM 2 (BnBBM2) with e-value of 1.7e-33 and BLAST sequence identity of 40.8
  misc_feature 362455:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(495): Functional Homolog of  Ceres CLONE ID no. 597609 at SEQ ID NO. 3307 with e-value of 3.19E-101 and BLAST sequence identity of 59.6
MLDLNLSAVSGDSSTTGKNNKHKQKKILELSNPPLESSGSFDSSSIVNADGCGDEDSCSNGDLFAYNFSILSNEISVKKTVDCDNYNNDDGDDSGDRTIQLFPVACGIKNVGGESQSSSTMQMQWSGVGECRDQGSPSENGIVAQQKPVKKSRRGPRSRSSQYRGVTFYRRTGRWESHIWDCGKQVYLGGFDTAHAAARVYDRAAIKFRGVDADINFNVTDYDEDIKQMRNFTKEEFVHILRRQSTGFSRGSSKYRGVTLHKCGRWEARMGQFLGKKYIYLGLFDSETEAARAYDKAAIKCNGREAVTNFEPSTYEGEILSEPNNGDGNQNLDLNLGIAPPDTSDGLKVNSNMGGFYFQSGWDGLSIDRAPKILNSASATMKNQQPNGPGMTSVHPPTWDGVNHHIFPIYEERAIEKRMEVDSFPNWTRQIQGPYGGGANPLPLFSTAASSGFASSAIMAPSAAAGQLQFPSSTILHRFPPFTNPSNISQFYCRS

SEQ ID NO: 3267 - protein, 384 aa, Glycine max
  misc_feature (1)..(384): Ceres CLONE ID no. 597624
  misc_feature (1)..(384): Also Known As Ceres CDNA ID no. 23402435
  misc_feature (1)..(384): Also Known As Ceres GEMINI ID 531B11
  misc_feature (204)..(318): Pfam Name: B3 Pfam Description: B3 DNA binding domain
  misc_feature (75)..(136): Pfam Name: AP2 Pfam Description: AP2 domain
  misc_feature 362615:<222: Transcription Factor
  misc_feature: Phenotype: Activates expression of the gene endogenous to the PsROMT (SEQ ID NO 4161) regalutory region Useful for modulating Alkaloid Biosynthesis
MDAISCLDESTTTESLSISQAKPSSTIMSSEKASPSPPPPNRLCRVGSGASAVVDSDGGGGGGSTEVESRKLPSSKYKGVVPQPNGRWGSQIYEKHQRVWLGTFNEEDEAARAYDVAVQRFRGKDAVTNFKPLSGTDDDDGESEFLNSHSKSEIVDMLRKHTYNDELEQSKRSRGFVRRRGSAAGAGNGNSISGACVMKAREQLFQKAVTPSDVGKLNRLVIPKQHAEKHFPLQSAANGVSATAAAAKGVLLNFEDVGGKVWRFRYSYWNSSQSYVLTKGWSRFVKEKNLKAGDTVCFQRSTGPDRQLYIDWKTRNVVNEVALFGPVVEPIQMVRLFGVNILKLPGSDSIANNNNASGCCNGKRREMELFSLECSKKPKIIGAL

SEQ ID NO: 3268 - DNA, 1104 bp, Populus balsamifera subsp. trichocarpa
  misc_feature (1)..(1104): Ceres ANNOT ID no. 1464039
  misc_feature 362715:<222: Transcription Factor
  misc_feature: Phenotype: Activates expression of the gene endogenous to the PsROMT (SEQ ID NO 4161) regalutory region Useful for modulating Alkaloid Biosynthesis
atggatggaagctgcatagatgaaagcacaactagtagtgctgataactccatatccattacaccaacctccctccctcccttcccaccaactgctaccactacaaaatcaccacctgagtcactttgccgtgttaggagcggcaatagtagtgttattcttgattcggaatcaggtgtcgaagctgaatcgagaaaactcccttcttctaaatacaaaggtgttgtcccccaaccaaatggtcgctggggtgcacagatttacgagaagcaccagcgtgtgtggctcgggacgttcaatgaagaaaatgaagcagcaagagcctatgatattgctgctcagagattccgtggaagggatgccgtgactaacttcaagcaagttaatgagaccgaagatgatgaaatagaggctgctttcctgaacgctcattcgaaagctgaaatcgttgacatgttgaggaaacacacgtacagcgatgagctagagcaaagcaaaaggaaccacaggagtaacaatgggggaaatgggaagcaatacaagaatacagcaaactacgagaataatagttatgatcatggttgtggtcgggtgttgaaagcgcgtgaacagctttttgagaaagctgtgactccgagtgatgttgggaaattgaatcggcttgtgataccaaaacaacatgcggaaaagcattttcctttgcaaagtacatcaagcaatagtactaaaggtgtattgcttaacttggaagatgtgagcggcaaagtgtggaggtttcgttattcttattggaatagtagccaaagttatgttttgacaaaagggtggagccgatttgttaaagaaaagaacttgaaagctggtgacattgtttgctttcaaagatcaactggacctgataaccagctttacattgattggaaagcaagatgcgggtccaaccaggtccaaccggttcagatggtgaggttgtttggggttaatatttttaatgtacctgggatggaaaatgggtgtgatgggaagagatcaataagggatatggagcttttgtcaatagatcgtcagtatagtaagaaacaaaggatcgttggagccttgtaa

SEQ ID NO: 3269 - protein, 367 aa, Populus balsamifera subsp. trichocarpa
  misc_feature (1)..(367): Ceres ANNOT ID no. 1464039
  misc_feature (205)..(313): Pfam Name: B3 Pfam Description: B3 DNA binding domain
  misc_feature (70)..(131): Pfam Name: AP2 Pfam Description: AP2 domain
  misc_feature: SWISSPROT Homolog: RAV1_ARATH DNA-binding protein RAV1 with e-value of 1.5e-97 and BLAST sequence identity of 66.8
  misc_feature: SWISSPROT Homolog: ERF9_ARATH Ethylene-responsive transcription factor 9 EREBP-9(AtERF9) with e-value of 4.3e-15 and BLAST sequence identity of 41.8
  misc_feature: SWISSPROT Homolog: ERF4_ARATH Ethylene-responsive transcription factor 4 Related to APETALA-2 protein 5 (EREBP-4) (AtERF4) with e-value of 2.9e-11 and BLAST sequence identity of 43.4
  misc_feature: SWISSPROT Homolog: ERF14_ARATH Ethylene-responsive transcription factor 14 EREBP-14(AtERF14) with e-value of 3.1e-11 and BLAST sequence identity of 40.8
  misc_feature: SWISSPROT Homolog: ERF4_NICSY Ethylene-responsive transcription factor 4 EREBP-3 (NsERF3) with e-value of 6.8e-11 and BLAST sequence identity of 40.2
  misc_feature 362829:<222: Transcription Factor
  misc_feature: Phenotype: Activates expression of the gene endogenous to the PsROMT (SEQ ID NO 4161) regalutory region Useful for modulating Alkaloid Biosynthesis
  misc_feature (1)..(367): Functional Homolog of  Ceres CLONE ID no. 597624 at SEQ ID NO. 3314 with e-value of 2.70E-120 and BLAST sequence identity of 70.9
MDGSCIDESTTSSADNSISITPTSLPPFPPTATTTKSPPESLCRVRSGNSSVILDSESGVEAESRKLPSSKYKGVVPQPNGRWGAQIYEKHQRVWLGTFNEENEAARAYDIAAQRFRGRDAVTNFKQVNETEDDEIEAAFLNAHSKAEIVDMLRKHTYSDELEQSKRNHRSNNGGNGKQYKNTANYENNSYDHGCGRVLKAREQLFEKAVTPSDVGKLNRLVIPKQHAEKHFPLQSTSSNSTKGVLLNLEDVSGKVWRFRYSYWNSSQSYVLTKGWSRFVKEKNLKAGDIVCFQRSTGPDNQLYIDWKARCGSNQVQPVQMVRLFGVNIFNVPGMENGCDGKRSIRDMELLSIDRQYSKKQRIVGAL

SEQ ID NO: 3270 - protein, 150 aa, Glycine max
  misc_feature (1)..(150): Ceres CLONE ID no. 599633
  misc_feature (1)..(150): Also Known As Ceres CDNA ID no. 23401404
  misc_feature (1)..(150): Also Known As Ceres GEMINI ID 552E6
  misc_feature (62)..(131): Pfam Name: HMG_box Pfam Description: HMG (high mobility group) box
  misc_feature: Utility: Low Nitrate Useful for making plants tolerant to low nitrogen
  misc_feature 362957:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: WHOLE PLANT - Low Nitrate Useful for making plants tolerant to low nitrogen
MAKKAKGSHSASSASASSSSDKLVLRIKSNEGTKRSVRQTNSRKKLKAKQKKNKQKFDAMKPRKPPTAFFYFLEDFRKEFQEQNPDVKSMRDIGKACGEKWKTMTYEEKVQYYDIATKKREEFDSAMAEFNKKMENGEFDETDDESEFDE

SEQ ID NO: 3271 - DNA, 675 bp, Populus balsamifera subsp. trichocarpa
  misc_feature (1)..(675): Ceres ANNOT ID no. 1449885
  misc_feature: Utility: Low Nitrate Useful for making plants tolerant to low nitrogen
  misc_feature 363026:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: WHOLE PLANT - Low Nitrate Useful for making plants tolerant to low nitrogen
atgagagacaagaaaatcatcgataacattgatacagaaactgttgagagtgcagagtttttagatcttggtttctctgaaatcccaagaaaaccctttcatggtaagcaaaacagggagagaccagagatgccaaaaaagaaaagaaagcaaatcgaagaggacaaaagccagcacacactcagacaggagagcccaacaagagagaacaatttttcagtttttttgctcacccctaactgcaacagtaggctgaggacttttacaaggggaaaaatggtgttgaggataaggtccaatgagatcacaaagaggtctacacggcaacagagagtggttaggagtgagaatgagaggagaccaaagtcgaagaccaagaaaaataagaaatttgatgctaaaaagcccaagaaacctccaactgctttcttttacttcttagaggatttccgcaaggaattccaagagcagaatccagatgtcaagtcaatgcgtgaggttggcaaggcatgtggagaaaagtggaaaacaatgacctatgaggaaaaggttaaatattatgatatagccacagaaaagagggcggagtttgatagagccacgtcagaatatatcaagagaaaggaaagcggtgaagatgaagaccctgaggatgcctctgagtttgacgagtag

SEQ ID NO: 3272 - protein, 181 aa, Populus balsamifera subsp. trichocarpa
  misc_feature (1)..(181): Ceres ANNOT ID no. 1449885
  misc_feature (93)..(162): Pfam Name: HMG_box Pfam Description: HMG (high mobility group) box
  misc_feature: SWISSPROT Homolog: HMGL_VICFA HMG1/2-like protein with e-value of 5.3e-22 and BLAST sequence identity of 40.5
  misc_feature: SWISSPROT Homolog: HMGL_IPONI HMG1/2-like protein with e-value of 1.8e-19 and BLAST sequence identity of 37.4
  misc_feature: SWISSPROT Homolog: HMGL_SOYBN HMG1/2-like protein (SB11 protein) with e-value of 6.2e-19 and BLAST sequence identity of 37.7
  misc_feature: SWISSPROT Homolog: MNB1B_MAIZE DNA-binding protein MNB1B (HMG1-like protein) with e-value of 1.6e-18 and BLAST sequence identity of 38.2
  misc_feature: SWISSPROT Homolog: HMGL_WHEAT HMG1/2-like protein with e-value of 3.1e-17 and BLAST sequence identity of 41.4
  misc_feature: Utility: Low Nitrate Useful for making plants tolerant to low nitrogen
  misc_feature 363132:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: WHOLE PLANT - Low Nitrate Useful for making plants tolerant to low nitrogen
  misc_feature (1)..(181): Functional Homolog of  Ceres CLONE ID no. 599633 at SEQ ID NO. 3317 with e-value of 9.29E-47 and BLAST sequence identity of 73.4
MPKKKRKQIEEDKSQHTLRQESPTRENNFSVFLLTPNCNSRLRTFTRGKMVLRIRSNEITKRSTRQQRVVRSENERRPKSKTKKNKKFDAKKPKKPPTAFFYFLEDFRKEFQEQNPDVKSMREVGKACGEKWKTMTYEEKVKYYDIATEKRAEFDRATSEYIKRKESGEDEDPEDASEFDE

SEQ ID NO: 3273 - protein, 171 aa, Glycine max
  misc_feature (1)..(171): Ceres CLONE ID no. 608818
  misc_feature (29)..(94): Pfam Name: CBFD_NFYB_HMF Pfam Description: Histone-like transcription factor CBF/NF-Y) and archaeal histone
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Small Useful for modulating plant size
MADGPASPGGGSHESGEHSPRSNVREQDRYLPIANISRIMKKALPANGKIAKDAKETVQECVSEFISFITSEASDKCQREKRKTINGDDLLWAMATLGFEDYIDPLKIYLTRYREMEGDTKGSAKGGDSSSKKDVQPSPNAQLAHQGSFSQGVSYTISQGQHMMVPMQGPE

SEQ ID NO: 3274 - DNA, 585 bp, Populus balsamifera subsp. trichocarpa
  misc_feature (1)..(585): Ceres ANNOT ID no. 1528780
  misc_feature 363285:<222: Transcription Factor
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Small Useful for modulating plant size
atggcggcagaggcaccggcgagtccagggggaggaagccatgagagcggagaccaaagtcctcgctctaattctaatgtacgtgaacaagacaggttcttaccgatcgcaaatatcagtaggattatgaagaaagcgctacctgctaatggaaagattgctaaggatgctaaagagactgttcaagaatgtgtttctgagttcattagctttatcactagcgaagcaagtgataagtgtcagcgagaaaagaggaagacgataaatggtgatgatttgctttgggctatggctacgttagggtttgaggattatattgatcctcttaagatttacctgtctcgatacagagagatggagggtgataccaagggatctgcgaagactggagatacatctgctaaaaaggatattcaccctggtccaaatgcgcagatttctcatcaaggttctttctcacaaggtgttagttatggaaattcaaattctcaagtaagcaccctctccctctctctcacacacactgcacagtgtgataatcattcttggaacatttcttcttatctggacattaaattaatgtaa

SEQ ID NO: 3275 - protein, 194 aa, Populus balsamifera subsp. trichocarpa
  misc_feature (1)..(194): Ceres ANNOT ID no. 1528780
  misc_feature (32)..(97): Pfam Name: CBFD_NFYB_HMF Pfam Description: Histone-like transcription factor CBF/NF-Y) and archaeal histone
  misc_feature: SWISSPROT Homolog: NFYBA_ARATH Nuclear transcription factor Y subunit B-10 (AtNF-YB-10) with e-value of 1.0e-64 and BLAST sequence identity of 79.2
  misc_feature: SWISSPROT Homolog: NFYB8_ARATH Nuclear transcription factor Y subunit B-8 (AtNF-YB-8) with e-value of 5.1e-63 and BLAST sequence identity of 74.7
  misc_feature: SWISSPROT Homolog: NFYB_MAIZE Nuclear transcription factor Y subunit B (NF-YB) (CAAT-box DNA-binding protein subunit B) with e-value of 4.4e-57 and BLAST sequence identity of 73.2
  misc_feature: SWISSPROT Homolog: NFYB3_ORYSA Nuclear transcription factor Y subunit B-3 (OsNF-YB-3) (Transcriptional activator HAP3B) with e-value of 9.2e-57 and BLAST sequence identity of 71.4
  misc_feature: SWISSPROT Homolog: NFYB1_ARATH Nuclear transcription factor Y subunit B-1 (AtNF-YB-1) (Transcriptional activator HAP3A) with e-value of 5.4e-52 and BLAST sequence identity of 78.8
  misc_feature 363391:<222: Transcription Factor
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Small Useful for modulating plant size
  misc_feature (1)..(194): Functional Homolog of  Ceres CLONE ID no. 608818 at SEQ ID NO. 3320 with e-value of 4.89E-73 and BLAST sequence identity of 88.75
MAAEAPASPGGGSHESGDQSPRSNSNVREQDRFLPIANISRIMKKALPANGKIAKDAKETVQECVSEFISFITSEASDKCQREKRKTINGDDLLWAMATLGFEDYIDPLKIYLSRYREMEGDTKGSAKTGDTSAKKDIHPGPNAQISHQGSFSQGVSYGNSNSQVSTLSLSLTHTAQCDNHSWNISSYLDIKLM

SEQ ID NO: 3276 - DNA, 480 bp, Populus balsamifera subsp. trichocarpa; identical to SEQ ID NO: 334
  misc_feature (1)..(480): Ceres ANNOT ID no. 1518351
  misc_feature 363477:<222: Transcription Factor
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Small Useful for modulating plant size

SEQ ID NO: 3277 - protein, 159 aa, Populus balsamifera subsp. trichocarpa; identical to SEQ ID NO: 335
  misc_feature (1)..(159): Ceres ANNOT ID no. 1518351
  misc_feature (30)..(95): Pfam Name: CBFD_NFYB_HMF Pfam Description: Histone-like transcription factor CBF/NF-Y) and archaeal histone
  misc_feature: SWISSPROT Homolog: NFYBA_ARATH Nuclear transcription factor Y subunit B-10 (AtNF-YB-10) with e-value of 1.0e-64 and BLAST sequence identity of 79.2
  misc_feature: SWISSPROT Homolog: NFYB8_ARATH Nuclear transcription factor Y subunit B-8 (AtNF-YB-8) with e-value of 5.1e-63 and BLAST sequence identity of 74.7
  misc_feature: SWISSPROT Homolog: NFYB_MAIZE Nuclear transcription factor Y subunit B (NF-YB) (CAAT-box DNA-binding protein subunit B) with e-value of 4.4e-57 and BLAST sequence identity of 73.2
  misc_feature: SWISSPROT Homolog: NFYB3_ORYSA Nuclear transcription factor Y subunit B-3 (OsNF-YB-3) (Transcriptional activator HAP3B) with e-value of 9.2e-57 and BLAST sequence identity of 71.4
  misc_feature: SWISSPROT Homolog: NFYB1_ARATH Nuclear transcription factor Y subunit B-1 (AtNF-YB-1) (Transcriptional activator HAP3A) with e-value of 5.4e-52 and BLAST sequence identity of 78.8
  misc_feature 363581:<222: Transcription Factor
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Small Useful for modulating plant size
  misc_feature (1)..(159): Functional Homolog of  Ceres CLONE ID no. 608818 at SEQ ID NO. 3320 with e-value of 7.49E-61 and BLAST sequence identity of 83.4

SEQ ID NO: 3278 - DNA, 570 bp, Populus balsamifera subsp. trichocarpa
  misc_feature (1)..(570): Ceres ANNOT ID no. 1525569
  misc_feature 363658:<222: Transcription Factor
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Small Useful for modulating plant size
atggcggattcggacaatgaatcaggaggacacaacgccgtcagtgagctgtctgcgaaggagcaagacaggtttctgccaattgcaaacgtgagcaggataatgaaaaaagccctgcctgcaaacgcgaagatctcgaaagacgcaaaggagacggttcaggagtgtgtgtcggagttcatcagctttataacaggagaggcctcagacaagtgccagagagagaagcggaagaccataaacggtgacgatcttttgtgggccatgacgacgctagggttcgaggagtacgtggagcccttgaagatttacttgcagaagtatagggagatggaaggagagaagagttccatgggaagaccagcaggggagaaggatggtcctggtggtgggtctggtgggagtggtgctgcgggaggtggaggcggggctaattccaccggcggtggaggtggagggtttaatggtggtggggggcaagggatgtatggcgggatgatgatgatgggtcatcaccatcaaggacacgtgtacggtgctggtgggtttcatcatcaagcttcgaggtag

SEQ ID NO: 3279 - protein, 189 aa, Populus balsamifera subsp. trichocarpa
  misc_feature (1)..(189): Ceres ANNOT ID no. 1525569
  misc_feature (24)..(89): Pfam Name: CBFD_NFYB_HMF Pfam Description: Histone-like transcription factor CBF/NF-Y) and archaeal histone
  misc_feature: SWISSPROT Homolog: NFYBA_ARATH Nuclear transcription factor Y subunit B-10 (AtNF-YB-10) with e-value of 1.0e-64 and BLAST sequence identity of 79.2
  misc_feature: SWISSPROT Homolog: NFYB8_ARATH Nuclear transcription factor Y subunit B-8 (AtNF-YB-8) with e-value of 5.1e-63 and BLAST sequence identity of 74.7
  misc_feature: SWISSPROT Homolog: NFYB_MAIZE Nuclear transcription factor Y subunit B (NF-YB) (CAAT-box DNA-binding protein subunit B) with e-value of 4.4e-57 and BLAST sequence identity of 73.2
  misc_feature: SWISSPROT Homolog: NFYB3_ORYSA Nuclear transcription factor Y subunit B-3 (OsNF-YB-3) (Transcriptional activator HAP3B) with e-value of 9.2e-57 and BLAST sequence identity of 71.4
  misc_feature: SWISSPROT Homolog: NFYB1_ARATH Nuclear transcription factor Y subunit B-1 (AtNF-YB-1) (Transcriptional activator HAP3A) with e-value of 5.4e-52 and BLAST sequence identity of 78.8
  misc_feature 363764:<222: Transcription Factor
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Small Useful for modulating plant size
  misc_feature (1)..(189): Functional Homolog of  Ceres CLONE ID no. 608818 at SEQ ID NO. 3320 with e-value of 6.69E-44 and BLAST sequence identity of 77.3
MADSDNESGGHNAVSELSAKEQDRFLPIANVSRIMKKALPANAKISKDAKETVQECVSEFISFITGEASDKCQREKRKTINGDDLLWAMTTLGFEEYVEPLKIYLQKYREMEGEKSSMGRPAGEKDGPGGGSGGSGAAGGGGGANSTGGGGGGFNGGGGQGMYGGMMMMGHHHQGHVYGAGGFHHQASR

SEQ ID NO: 3280 - DNA, 552 bp, Populus balsamifera subsp. trichocarpa
  misc_feature (1)..(552): Ceres ANNOT ID no. 1453192
  misc_feature 363847:<222: Transcription Factor
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Small Useful for modulating plant size
atggctgattcagacaatgagtctggagggcaaaacaacagcaatacaaactacagtgagacatcatcaagggagcaggacaagctcttgcctatagccaatgttagcaggatcatgaagaaagcgttaccagctaatgcaaagatctcgaaggatgggaaggagaccgtgcaagagtgtgtgtctgagttcattagcttcatcaccggagaggcatcagataagtgtcaaagagagaagaggaagacggtcaatggtgatgatcttttgtgggccatgacaactttgggttttgaagattatgctgaacccttgaagatttatctgcaaaagtttagggagacggaaggagagaggactgctgccatgggaacagttaggcaaggtgatcaaagagatggtgctgtcgtaaatagtggagattctgggggtgggttcggtggaagtgggggcaatgtgtatggtgggatgcagtcaagtatgatgatgatgggacaccatccccttcatcaaggcaacatgtatggttctgcttctggtaggccaaagtaa

SEQ ID NO: 3281 - protein, 183 aa, Populus balsamifera subsp. trichocarpa
  misc_feature (1)..(183): Ceres ANNOT ID no. 1453192
  misc_feature (28)..(93): Pfam Name: CBFD_NFYB_HMF Pfam Description: Histone-like transcription factor CBF/NF-Y) and archaeal histone
  misc_feature: SWISSPROT Homolog: NFYBA_ARATH Nuclear transcription factor Y subunit B-10 (AtNF-YB-10) with e-value of 1.0e-64 and BLAST sequence identity of 79.2
  misc_feature: SWISSPROT Homolog: NFYB8_ARATH Nuclear transcription factor Y subunit B-8 (AtNF-YB-8) with e-value of 5.1e-63 and BLAST sequence identity of 74.7
  misc_feature: SWISSPROT Homolog: NFYB_MAIZE Nuclear transcription factor Y subunit B (NF-YB) (CAAT-box DNA-binding protein subunit B) with e-value of 4.4e-57 and BLAST sequence identity of 73.2
  misc_feature: SWISSPROT Homolog: NFYB3_ORYSA Nuclear transcription factor Y subunit B-3 (OsNF-YB-3) (Transcriptional activator HAP3B) with e-value of 9.2e-57 and BLAST sequence identity of 71.4
  misc_feature: SWISSPROT Homolog: NFYB1_ARATH Nuclear transcription factor Y subunit B-1 (AtNF-YB-1) (Transcriptional activator HAP3A) with e-value of 5.4e-52 and BLAST sequence identity of 78.8
  misc_feature 363953:<222: Transcription Factor
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Small Useful for modulating plant size
  misc_feature (1)..(183): Functional Homolog of  Ceres CLONE ID no. 608818 at SEQ ID NO. 3320 with e-value of 6.00E-43 and BLAST sequence identity of 70.0
MADSDNESGGQNNSNTNYSETSSREQDKLLPIANVSRIMKKALPANAKISKDGKETVQECVSEFISFITGEASDKCQREKRKTVNGDDLLWAMTTLGFEDYAEPLKIYLQKFRETEGERTAAMGTVRQGDQRDGAVVNSGDSGGGFGGSGGNVYGGMQSSMMMMGHHPLHQGNMYGSASGRPK

SEQ ID NO: 3282 - DNA, 624 bp, Populus balsamifera subsp. trichocarpa
  misc_feature (1)..(624): Ceres ANNOT ID no. 1441586
  misc_feature 364036:<222: Transcription Factor
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Small Useful for modulating plant size
atggcggactcagacaacgactctggaggacaaaaccccacaagcaccaacgagctgttttccccaagagagatggaccgtttcttgccggtggccaacgtcagtaggatcatgaagaaagcactgccagcaaacgctaagatctccaaagaagccaaagagacagtacaagaatgcgtgtccgagttcatcagcttcatcacaggagaggcctctgacaagtgccagagagagaagagaaagacgatcaacggcgatgatctcttgtgggccatgacgaccctgggctttgaggaatacgtggagccgctcaaggtttatttgcagaggtttagagagatggagggggagaagaataccgtggcgcgtgacagggacgctccttctaatgggagtgggcctggagcggaggggtttagtgggtacgtgtacggctctggtgcagggttttttaatcaggtgggtggtggtggggctggagatagcttggtctatgggcagcccatcatgctccaacgcgacaagatgatgatgctccatcaaaacctggggattttcaaggaccctctaccccagcacggccctgttgcttcgacaaacccatatgcctcatctccacagtaa

SEQ ID NO: 3283 - protein, 207 aa, Populus balsamifera subsp. trichocarpa
  misc_feature (1)..(207): Ceres ANNOT ID no. 1441586
  misc_feature (27)..(92): Pfam Name: CBFD_NFYB_HMF Pfam Description: Histone-like transcription factor CBF/NF-Y) and archaeal histone
  misc_feature: SWISSPROT Homolog: NFYBA_ARATH Nuclear transcription factor Y subunit B-10 (AtNF-YB-10) with e-value of 1.0e-64 and BLAST sequence identity of 79.2
  misc_feature: SWISSPROT Homolog: NFYB8_ARATH Nuclear transcription factor Y subunit B-8 (AtNF-YB-8) with e-value of 5.1e-63 and BLAST sequence identity of 74.7
  misc_feature: SWISSPROT Homolog: NFYB_MAIZE Nuclear transcription factor Y subunit B (NF-YB) (CAAT-box DNA-binding protein subunit B) with e-value of 4.4e-57 and BLAST sequence identity of 73.2
  misc_feature: SWISSPROT Homolog: NFYB3_ORYSA Nuclear transcription factor Y subunit B-3 (OsNF-YB-3) (Transcriptional activator HAP3B) with e-value of 9.2e-57 and BLAST sequence identity of 71.4
  misc_feature: SWISSPROT Homolog: NFYB1_ARATH Nuclear transcription factor Y subunit B-1 (AtNF-YB-1) (Transcriptional activator HAP3A) with e-value of 5.4e-52 and BLAST sequence identity of 78.8
  misc_feature 364144:<222: Transcription Factor
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Small Useful for modulating plant size
  misc_feature (1)..(207): Functional Homolog of  Ceres CLONE ID no. 608818 at SEQ ID NO. 3320 with e-value of 1.30E-42 and BLAST sequence identity of 70.8
MADSDNDSGGQNPTSTNELFSPREMDRFLPVANVSRIMKKALPANAKISKEAKETVQECVSEFISFITGEASDKCQREKRKTINGDDLLWAMTTLGFEEYVEPLKVYLQRFREMEGEKNTVARDRDAPSNGSGPGAEGFSGYVYGSGAGFFNQVGGGGAGDSLVYGQPIMLQRDKMMMLHQNLGIFKDPLPQHGPVASTNPYASSPQ

SEQ ID NO: 3284 - DNA, 672 bp, Populus balsamifera subsp. trichocarpa
  misc_feature (1)..(672): Ceres ANNOT ID no. 1509714
  misc_feature 364230:<222: Transcription Factor
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Small Useful for modulating plant size
atgacaggaaaaaggacccagatcagcccaatcggaagccccttgtctgagaacatctcagaaagctcttccaaattagagcaggaccgattcctccccatcgccaacgtaagccggatcatgaagaaatccctcccagcaaatgcaaagatatccaaagaagccaaggaaactgtccaagagtgtgtctctgagttcataagcttcatcacaggcgaagcatccgacaagtgtcaacgagagaagaggaagactataaacggtgatgatcttttgtgggctatgagcacactagggtttgagaattacgttggatccttgaaggtttatctcaacaagtatagagatactgagggagagaaaaattctatggctagacaagaggaccagttatctcccactaaccatggttctcttggtactcatgaaactattaaagtcaatggttctccttctctatcaactgggatggatcttcagagttttaacgccggactctactcactcggcacggaagtaacagccaagagctatggacaaaacacaaggttccttggttatcaggagagttcgatggttggtgatttcaacatgaataagatacgcgatcatggagacaggaatggcaatatagctatggctggtcagcttcatcacggggttggctggtag

SEQ ID NO: 3285 - protein, 223 aa, Populus balsamifera subsp. trichocarpa
  misc_feature (1)..(223): Ceres ANNOT ID no. 1509714
  misc_feature (30)..(95): Pfam Name: CBFD_NFYB_HMF Pfam Description: Histone-like transcription factor CBF/NF-Y) and archaeal histone
  misc_feature: SWISSPROT Homolog: NFYBA_ARATH Nuclear transcription factor Y subunit B-10 (AtNF-YB-10) with e-value of 1.0e-64 and BLAST sequence identity of 79.2
  misc_feature: SWISSPROT Homolog: NFYB8_ARATH Nuclear transcription factor Y subunit B-8 (AtNF-YB-8) with e-value of 5.1e-63 and BLAST sequence identity of 74.7
  misc_feature: SWISSPROT Homolog: NFYB_MAIZE Nuclear transcription factor Y subunit B (NF-YB) (CAAT-box DNA-binding protein subunit B) with e-value of 4.4e-57 and BLAST sequence identity of 73.2
  misc_feature: SWISSPROT Homolog: NFYB3_ORYSA Nuclear transcription factor Y subunit B-3 (OsNF-YB-3) (Transcriptional activator HAP3B) with e-value of 9.2e-57 and BLAST sequence identity of 71.4
  misc_feature: SWISSPROT Homolog: NFYB1_ARATH Nuclear transcription factor Y subunit B-1 (AtNF-YB-1) (Transcriptional activator HAP3A) with e-value of 5.4e-52 and BLAST sequence identity of 78.8
  misc_feature 364340:<222: Transcription Factor
  misc_feature: Phenotype: ROSETTE LEAVES - Curled 4 Useful for making ornamental plants with altered leaf shape
  misc_feature: Phenotype: ROSETTE LEAVES - Curled 5 Useful for making ornamental plants with altered leaf shape
  misc_feature: Phenotype: WHOLE PLANT - Small Useful for modulating plant size
  misc_feature (1)..(223): Functional Homolog of  Ceres CLONE ID no. 608818 at SEQ ID NO. 3320 with e-value of 1.30E-40 and BLAST sequence identity of 69.4
MTGKRTQISPIGSPLSENISESSSKLEQDRFLPIANVSRIMKKSLPANAKISKEAKETVQECVSEFISFITGEASDKCQREKRKTINGDDLLWAMSTLGFENYVGSLKVYLNKYRDTEGEKNSMARQEDQLSPTNHGSLGTHETIKVNGSPSLSTGMDLQSFNAGLYSLGTEVTAKSYGQNTRFLGYQESSMVGDFNMNKIRDHGDRNGNIAMAGQLHHGVGW

SEQ ID NO: 3286 - protein, 452 aa, Glycine max
  misc_feature (1)..(452): Ceres CLONE ID no. 609573
  misc_feature (327)..(355): Pfam Name: Pkinase_Tyr Pfam Description: Protein tyrosine kinase
  misc_feature: Phenotype: WHOLE PLANT - Small Useful for modulating plant size
METGGGRDSGMSSETINSSTQRTSMSNESVCSTSFSRLSFDLPPPSSSPETLFVKPHRSSDFAYSAILRRKSALTFRDFHLLRRIGAGDIGTVYLCRLRHDAGDEDDDEDPCFYAMKVVDKEAVALKKKAQRAEMERKILKMVDHPFLPTLYAEFEASNFSCIVMEYCSGGDLHSLQHNHPNNRFSLSSARFYAAEVLVALEYLHMLGIIYRDLKPENVLVRSDGHIMLSDFDLSLCSDAIPAVESPDCSLDPAFAPALRYTRQYSTPFSCLSNRVFRSRKVQTLQPNRLFVAEPVGARSCSFVGTHEYVSPEVASGNSHGNAVDWWSFGIFIYEMVYGRTPFAGSSNEATLRSIIKKPLAFPTSTPSSTLEMHARDLISGLLNKDPNRRLGSKRGSADVKKHPFFAGLNLALIRTVTPPEVPSLRRHKTTPFYYPANVNNSRQQLTAFDYF

SEQ ID NO: 3287 - DNA, 1467 bp, Populus balsamifera subsp. trichocarpa
  misc_feature (1)..(1467): Ceres ANNOT ID no. 1473808
  misc_feature 364544:<222: Transcription Factor
  misc_feature: Phenotype: WHOLE PLANT - Small Useful for modulating plant size
atgactaccaaagcgactagagatgagtccctccccgactatgatagcagctcctcctccaccactgtacctgactctagccggagctggatgagcaacctcagcttcggtagccgtcgaagttctatctctatttcttcatctgtagctgatagtgcttcaatctgcagcactgcccgcatgaagccacacaaggctaaccaagccgcatggcaggccataaagcggctacaaagagcaacaggccgagttggtctcgaccattttcgtctcctacgccgtttaggcagtggagatataggcaatgtctatctttgccagataaggaaccctgtggtgggtttgccacagtgcttttatgccatgaaagtggtggataaagaggcacttgctataaggaacaagctgcagagagctgagatggagaaagaaattctgggtatgcttgatcatccttttttgcctactctttatgcagagtttgaggcttctcattactcttgcttggttactgagtactgtcctggtggagatttgtatgctgcaagacaacgccagccatggaagcgctttagcatctcatctgctaagttttatgctgccgagactctcctggccctggaatatctacacatgatgggaattgtttacagagatcttaaaccggagaatgttcttgtcagagaagacggtcacattatgctttcagattttgatctttctttcaaatgtgatgttgtcccaaagcttttaaggtctaaacccagcttggaagccattgttcgtcacaagaatgaaaccactagtttcgcacccttaaccttttgcgctacacctatacaccctgtcctatcttgtttctcatcttccaacaagaaaaggaaacctagaatcacaactacaattacagaacaaattgatggccagggttatgacgaagaagttgaaacagaattggtagccgagcccatcagtgctagatcaaagtcctttgtcgggacccacgagtacttagcaccagaggtgatatcagggcagggccatggaagtgcggtggattggtggactcttggggtgttcttgtacgagatgttatatgggagaacacccttcaaaggtgaaaacaacgaaaaaaccttgattaacatacttaaacagcccttaacctttccaagaataggtgtaaatagcagcaaagaatttgaagagatggtgaaacttcaagaccttgtaggcaagcttctagtgaagaatcccaaaaggagaattgggagcttaaaggggtctgttgaaatcaagaggcacgagttcttcaaaggtgtgaactgggctttgatcaggtcaatcaagccaccagagtctcctagtgatctttgcaggttcaggagtagagctcacataccaatgttgagcaagaaagagagacaagaaccatatcagatccctagtcattttgaatacttctaa

SEQ ID NO: 3288 - protein, 488 aa, Populus balsamifera subsp. trichocarpa
  misc_feature (1)..(488): Ceres ANNOT ID no. 1473808
  misc_feature (338)..(380): Pfam Name: Pkinase_Tyr Pfam Description: Protein tyrosine kinase
  misc_feature: SWISSPROT Homolog: KPK1_PHAVU Protein kinase PVPK-1 chloroplast precursor (EC 2.7.11.1) with e-value of 8.3e-98 and BLAST sequence identity of 51.0
  misc_feature: SWISSPROT Homolog: G11A_ORYSA Protein kinase G11A chloroplast precursor (EC 2.7.11.1) with e-value of 4.6e-94 and BLAST sequence identity of 46.3
  misc_feature: SWISSPROT Homolog: KPK7_ARATH Putative serine/threonine-protein kinase PK7 chloroplast precursor (EC 2.7.11.1) with e-value of 2.3e-89 and BLAST sequence identity of 53.8
  misc_feature: SWISSPROT Homolog: PHOT2_ARATH Phototropin-2 with e-value of 3.9e-75 and BLAST sequence identity of 37.6
  misc_feature: SWISSPROT Homolog: PHOT2_ARATH EC 2.7.11.1 (Defective in chloroplast avoidance protein 1) Non phototropic hypocotyl 1-like protein 1) (NPH1-like 1) (AtKin7)
  misc_feature: SWISSPROT Homolog: PHOT1_ARATH Phototropin-1 chloroplast precursor (EC 2.7.11.1) Non-phototropic hypocotyl protein 1 (Root phototropism protein 1) with e-value of 1.2e-71 and BLAST sequence identity of 39.5
  misc_feature 364672:<222: Transcription Factor
  misc_feature: Phenotype: WHOLE PLANT - Small Useful for modulating plant size
  misc_feature (1)..(488): Functional Homolog of  Ceres CLONE ID no. 609573 at SEQ ID NO. 3333 with e-value of 3.80E-105 and BLAST sequence identity of 53.3
MTTKATRDESLPDYDSSSSSTTVPDSSRSWMSNLSFGSRRSSISISSSVADSASICSTARMKPHKANQAAWQAIKRLQRATGRVGLDHFRLLRRLGSGDIGNVYLCQIRNPVVGLPQCFYAMKVVDKEALAIRNKLQRAEMEKEILGMLDHPFLPTLYAEFEASHYSCLVTEYCPGGDLYAARQRQPWKRFSISSAKFYAAETLLALEYLHMMGIVYRDLKPENVLVREDGHIMLSDFDLSFKCDVVPKLLRSKPSLEAIVRHKNETTSFAPLTFCATPIHPVLSCFSSSNKKRKPRITTTITEQIDGQGYDEEVETELVAEPISARSKSFVGTHEYLAPEVISGQGHGSAVDWWTLGVFLYEMLYGRTPFKGENNEKTLINILKQPLTFPRIGVNSSKEFEEMVKLQDLVGKLLVKNPKRRIGSLKGSVEIKRHEFFKGVNWALIRSIKPPESPSDLCRFRSRAHIPMLSKKERQEPYQIPSHFEYF

SEQ ID NO: 3289 - DNA, 1527 bp, Populus balsamifera subsp. trichocarpa
  misc_feature (1)..(1527): Ceres ANNOT ID no. 1476668
  misc_feature 364798:<222: Transcription Factor
  misc_feature: Phenotype: WHOLE PLANT - Small Useful for modulating plant size
atggacaaagatacaacacaaaagatgggaacgtttgatgctgaggctgagtctgtgattactagcagctttcaggatctcagcttcactaacagcactgttagtatcggcttgtgtagttccgtctctgataatagtgttagtaatagcagcaatgtgagcaatggtactgctgctagtgaatctaaagagagtgaaaaggctagtttgatttgtgacccaaatgaggctagcttcaggagctcctacccttcgaaaccccataagggaaatgactttagatgggatgctgtacagtgtgtaaagggtaaagatggggatatggggatgggtttgggtcattttaggttattgaagaaacttggtgtcggggatatagggagtgtatatttggctgagttgagagggatgggttgcttgtttgcaatgaaggtaatggataaaggaatgttagctgggaggaagaagttgttgagagctcgaactgagagagagattttaggtttgttggatcatccatttttaccaaccctttattcgcatttcgagaccgataagttttcttgtttgttaatggagttttgcagtggtggggatcttcatatactaagacagcgacaacctggcaagcattttagcgagcaggcagcaaggttttatgcttcggaagtgcttcttgctttagagtacttgcacatgatgggcgttgtatatagagatttgaagcctgaaaatgtgttggtgagggaggatggccatattatgctttcggactttgatttgtcattaagatgctgtgtgagtcctactcttgttcaatctagtactgtgtcttcttgtaagatttcttcatactgtattgagccatcatgtattgatccagcctgcaagttgcccgtttgtgtagagccttcttgcttgcaaccatcttgccttaaacctcgtttcttcaaacccaagacagcaaaagttagaaatgaaaagccaaacctggcaaattcaaattcacttcctgtacttgttgcagaaccaaccaccgctcgttccatgtcatttgtcggtacacatgagtatttagcaccggagataataagaggggacggccatggaagtgctgttgattggtggacgttcggtatcttcttgtatgaattgatacttggtaggactccttttaaaggcaatggaaatcgagagacattgtttaatgtggtaggtcagcccctaaaatttcctgaaggatcttctgtcagttttgcggcaaaagatttaatccgtggtctgctcatgaaggacccgcaaaagagattagggttcaaaagaggtgctacagagatcaagcagcatcctttctttgagactgttaactgggctctcattcgcagcactcaccctccagaaattccaaaaccagttgaccttttatctttgaatctcgcattcaagtcatccttggctcccaatgataacagagctacagattctgacagatcatcaggtccctttttagattttgaattcttctaa

SEQ ID NO: 3290 - protein, 500 aa, Populus balsamifera subsp. trichocarpa
  misc_feature (1)..(500): Ceres ANNOT ID no. 1476668
  misc_feature (107)..(254): Pfam Name: Pkinase Pfam Description: Protein kinase domain
  misc_feature (351)..(406): Pfam Name: Pkinase_Tyr Pfam Description: Protein tyrosine kinase
  misc_feature: SWISSPROT Homolog: KPK1_PHAVU Protein kinase PVPK-1 chloroplast precursor (EC 2.7.11.1) with e-value of 8.3e-98 and BLAST sequence identity of 51.0
  misc_feature: SWISSPROT Homolog: G11A_ORYSA Protein kinase G11A chloroplast precursor (EC 2.7.11.1) with e-value of 4.6e-94 and BLAST sequence identity of 46.3
  misc_feature: SWISSPROT Homolog: KPK7_ARATH Putative serine/threonine-protein kinase PK7 chloroplast precursor (EC 2.7.11.1) with e-value of 2.3e-89 and BLAST sequence identity of 53.8
  misc_feature: SWISSPROT Homolog: PHOT2_ARATH Phototropin-2 with e-value of 3.9e-75 and BLAST sequence identity of 37.6
  misc_feature: SWISSPROT Homolog: PHOT2_ARATH EC 2.7.11.1 (Defective in chloroplast avoidance protein 1) Non phototropic hypocotyl 1-like protein 1) (NPH1-like 1) (AtKin7)
  misc_feature: SWISSPROT Homolog: PHOT1_ARATH Phototropin-1 chloroplast precursor (EC 2.7.11.1) (Non-phototropic hypocotyl protein 1)(Root phototropism protein 1) with e-value of 1.2e-71 and BLAST sequence identity of 39.5
  misc_feature 364934:<222: Transcription Factor
  misc_feature: Phenotype: WHOLE PLANT - Small Useful for modulating plant size
  misc_feature (1)..(500): Functional Homolog of  Ceres CLONE ID no. 609573 at SEQ ID NO. 3333 with e-value of 6.29E-96 and BLAST sequence identity of 52.5
MGTFDAEAESVITSSFQDLSFTNSTVSIGLCSSVSDNSVSNSSNVSNGTAASESKESEKASLICDPNEASFRSSYPSKPHKGNDFRWDAVQCVKGKDGDMGMGLGHFRLLKKLGVGDIGSVYLAELRGMGCLFAMKVMDKGMLAGRKKLLRARTEREILGLLDHPFLPTLYSHFETDKFSCLLMEFCSGGDLHILRQRQPGKHFSEQAARFYASEVLLALEYLHMMGVVYRDLKPENVLVREDGHIMLSDFDLSLRCCVSPTLVQSSTVSSCKISSYCIEPSCIDPACKLPVCVEPSCLQPSCLKPRFFKPKTAKVRNEKPNLANSNSLPVLVAEPTTARSMSFVGTHEYLAPEIIRGDGHGSAVDWWTFGIFLYELILGRTPFKGNGNRETLFNVVGQPLKFPEGSSVSFAAKDLIRGLLMKDPQKRLGFKRGATEIKQHPFFETVNWALIRSTHPPEIPKPVDLLSLNLAFKSSLAPNDNRATDSDRSSGPFLDFEFF

SEQ ID NO: 3291 - DNA, 1839 bp, Populus balsamifera subsp. trichocarpa
  misc_feature (1)..(1839): Ceres ANNOT ID no. 1474436
  misc_feature 365063:<222: Transcription Factor
  misc_feature: Phenotype: WHOLE PLANT - Small Useful for modulating plant size
atggcctcaaaaactggtagcaaagcatcctcaaaacaacaccagaaaacagctggttttcaaagagcggatgtcactgatctcaggcatttgtctttgcagggctcaaagccgagcaagccccagctgattaatcatgagcaggtgcaatcttcagtagaaaatatgccaaagcaggttttgttagaagcttctgaaaataaaaagcttccgaattctaatcaagagggggcttctgattctttgagtaatacgttggaatccaattcttccttgccctgtcttgaacaatcatcaattgaggtggattctattgtcaatgagactagaggctcacaggatgtttctgttgatcaagagaagaaaatatcagaatatggaagtgtaaaaaacagctcggtatctgccaaagttagtgatggaaccagcagcctggctaagacgagtggaagtgccaaaatgagtgaccgtgttgattatgctgagagtggcaagaggagtttgtgtagaggaagcaccagcagcgatgttagtgatgaaagcacttgtagtagctttagtagtagcatcaacaaacctcacaaagcaaatgacttgagatgggaagccatccaagctgttagagcaaaagatggggttttaggtttgagtcattttagactgctgaagaggttgggttgtggggatattggtagtgtatacctgtctgagctgagtggaactaagtgttattttgcaatgaaggtaatggacaaaggttctcttgccagtcgtaagaagctgcttcgggctcagacagagagagaaatattgcaatctttggaccaccctttccttccgtcgctctacacccactttgaaacagataaattttcatgtctggtaatggagttctgtcctggaggagatttgcacactcttaggcagaggcagccagggaaacactttctggagcaggcagtaaaattttatgtagcagaggttctgctagctttggaatatttgcatatgcttgggatcatttaccgtgatcttaagccagagaatgtccttgtgagggatgatggacatataatgctctccgacttcgacctttccctccgttgtgctgtgagcccaacacttgtcaaaacagcatctcttgaggctgacccatttcgaaagaaccctgtttactgtgttcagccagcttgtatcgagccttcatgcatccagccatcctgtgttgctcctacaacatgctttgggccccgcctcttttctagcaagtccaagaaggataggaaacccaaaaatgaactaggaaatcaagtcagtccattacctgagctcatagcagagccaacagatgcaaggtcaatgtcttttgttggaacccacgagtatttggcacctgagatcatcaagggtgaaggtcatggaagtgctgttgactggtggacttttggaatttttctatatgaactcttattcgggaaaactcccttcaagggatctggaaaccgagccacattgttcaatgttgttggccagcctcttcgattcccagaatcaccagtcgtcagttttgcagctagggatctcataaggggtttgcttgtaaaagaaccacagcatagattagcatccaaacgaggcgccactgaaataaagcaacaccccttctttgaaggcgtgaattgggcattaatacgctgtgctaccccacccgagatccctaagccagttgagattgagcggatacctgccccagcatcaacaagtgaaaaggccacaacagttgcagctgctcctggtcaaaaaggttctgataattacctggagtttgatttcttttag

SEQ ID NO: 3292 - protein, 459 aa, Populus balsamifera subsp. trichocarpa
  misc_feature (1)..(459): Ceres ANNOT ID no. 1474436
  misc_feature (294)..(403): Pfam Name: Pkinase Pfam Description: Protein kinase domain
  misc_feature (66)..(153): Pfam Name: Pkinase_Tyr Pfam Description: Protein tyrosine kinase
  misc_feature: SWISSPROT Homolog: KPK1_PHAVU Protein kinase PVPK-1 chloroplast precursor (EC 2.7.11.1) with e-value of 8.3e-98 and BLAST sequence identity of 51.0
  misc_feature: SWISSPROT Homolog: G11A_ORYSA Protein kinase G11A chloroplast precursor (EC 2.7.11.1) with e-value of 4.6e-94 and BLAST sequence identity of 46.3
  misc_feature: SWISSPROT Homolog: KPK7_ARATH Putative serine/threonine-protein kinase PK7 chloroplast precursor (EC 2.7.11.1) with e-value of 2.3e-89 and BLAST sequence identity of 53.8
  misc_feature: SWISSPROT Homolog: PHOT2_ARATH Phototropin-2 with e-value of 3.9e-75 and BLAST sequence identity of 37.6
  misc_feature: SWISSPROT Homolog: PHOT2_ARATH EC 2.7.11.1 (Defective in chloroplast avoidance protein 1) Non phototropic hypocotyl 1-like protein 1) (NPH1-like 1) (AtKin7)
  misc_feature: SWISSPROT Homolog: PHOT1_ARATH Phototropin-1 chloroplast precursor (EC 2.7.11.1) (Non-phototropic hypocotyl protein 1)(Root phototropism protein 1) with e-value of 1.2e-71 and BLAST sequence identity of 39.5
  misc_feature 365208:<222: Transcription Factor
  misc_feature: Phenotype: WHOLE PLANT - Small Useful for modulating plant size
  misc_feature (1)..(459): Functional Homolog of  Ceres CLONE ID no. 609573 at SEQ ID NO. 3333 with e-value of 7.99E-96 and BLAST sequence identity of 54.1
MSDRVDYAESGKRSLCRGSTSSDVSDESTCSSFSSSINKPHKANDLRWEAIQAVRAKDGVLGLSHFRLLKRLGCGDIGSVYLSELSGTKCYFAMKVMDKGSLASRKKLLRAQTEREILQSLDHPFLPSLYTHFETDKFSCLVMEFCPGGDLHTLRQRQPGKHFLEQAVKFYVAEVLLALEYLHMLGIIYRDLKPENVLVRDDGHIMLSDFDLSLRCAVSPTLVKTASLEADPFRKNPVYCVQPACIEPSCIQPSCVAPTTCFGPRLFSSKSKKDRKPKNELGNQVSPLPELIAEPTDARSMSFVGTHEYLAPEIIKGEGHGSAVDWWTFGIFLYELLFGKTPFKGSGNRATLFNVVGQPLRFPESPVVSFAARDLIRGLLVKEPQHRLASKRGATEIKQHPFFEGVNWALIRCATPPEIPKPVEIERIPAPASTSEKATTVAAAPGQKGSDNYLEFDFF

SEQ ID NO: 3293 - DNA, 1323 bp, Populus balsamifera subsp. trichocarpa
  misc_feature (1)..(1323): Ceres ANNOT ID no. 1513750
  misc_feature 365328:<222: Transcription Factor
  misc_feature: Phenotype: WHOLE PLANT - Small Useful for modulating plant size
atggagcctcctcctccatggctggacgatttaaccgacgacctccaaagcacaagcttcacatccaccgccacgacaaccaccacactccaccgtagcaccagctccggttcctcctccgccacacttactcccgctccctccactcacacctctttctcctccaaatccacaagcaaacactccctctccctctccgatctccgtttctcccaccgcctcggttccggcgacatcggttccgtctacttagccgaactcaaaaccaaacttaatgaaacggactctaagttttttgcggcgaaagttatggataagaaggagctagttagcagaaataaagaaggaagagcgaggacggagcgggaaatacttgaaacgctggatcatccgtttttgcctacattatacgcctttattgacactcaacgatggctatgtttgttaacggagttttgttccggcggtgaccttcacgttctccgtcaacgacagcctcttaaacgattcgaagaaaccgccgtcaggttctacgcatcagaggtgattgtagctttagagtaccttcatatgatggggattgtttaccgtgatctcaagcctgaaaacgttcttgttcgatcagatggtcatataatgctcactgactttgacctctcgttaaaatgtgatgattcaacgtcaactccccagattatctccgacaaaatagatgctgctgcagccccaaaaaatgactatctgtttgagcatccttcttatacttcatcctcatgcattcttcctaactgtatagtcccagctgtgtcatgtttccacccaagacgtaaacgcaagaagaagatgggcaaccgtggtgggcctgagtttgtagccgaacctgttgatgttcgatctatgtcatttgttgggacccacgagtatttagcaccggagattgtttccggtgagggccatggtagtcctgtggattggtggacgctaggaatatttatgttcgaactattttacgggtatacgccttttagaggagttgaccatgagctaactctagctaatgttgtggcccgagcccttgagttccctaaagaaccagttgtgcctgccacagctaaggacctcgtatcgcaacttctggttaaggatccagcaaggcgaatgggttcccccatgggtgcatcagcggtcaagcaccacccttttttccaaggagttaattgggcattgttgagatgtagacctccaccatatgttcctccaccatttagtagagaagttgtatcagatgaaagttgtcccgagaccccagtggaatattattag

SEQ ID NO: 3294 - protein, 440 aa, Populus balsamifera subsp. trichocarpa
  misc_feature (1)..(440): Ceres ANNOT ID no. 1513750
  misc_feature (68)..(159): Pfam Name: Pkinase_Tyr Pfam Description: Protein tyrosine kinase
  misc_feature: SWISSPROT Homolog: KPK1_PHAVU Protein kinase PVPK-1 chloroplast precursor (EC 2.7.11.1) with e-value of 8.3e-98 and BLAST sequence identity of 51.0
  misc_feature: SWISSPROT Homolog: G11A_ORYSA Protein kinase G11A chloroplast precursor (EC 2.7.11.1) with e-value of 4.6e-94 and BLAST sequence identity of 46.3
  misc_feature: SWISSPROT Homolog: KPK7_ARATH Putative serine/threonine-protein kinase PK7 chloroplast precursor (EC 2.7.11.1) with e-value of 2.3e-89 and BLAST sequence identity of 53.8
  misc_feature: SWISSPROT Homolog: PHOT2_ARATH Phototropin-2 with e-value of 3.9e-75 and BLAST sequence identity of 37.6
  misc_feature: SWISSPROT Homolog: PHOT2_ARATH EC 2.7.11.1 (Defective in chloroplast avoidance protein 1) Non phototropic hypocotyl 1-like protein 1) (NPH1-like 1) (AtKin7)
  misc_feature: SWISSPROT Homolog: PHOT1_ARATH Phototropin-1 chloroplast precursor (EC 2.7.11.1) (Non-phototropic hypocotyl protein 1)(Root phototropism protein 1) with e-value of 1.2e-71 and BLAST sequence identity of 39.5
  misc_feature 365451:<222: Transcription Factor
  misc_feature: Phenotype: WHOLE PLANT - Small Useful for modulating plant size
  misc_feature (1)..(440): Functional Homolog of  Ceres CLONE ID no. 609573 at SEQ ID NO. 3333 with e-value of 1.89E-87 and BLAST sequence identity of 48.1
MEPPPPWLDDLTDDLQSTSFTSTATTTTTLHRSTSSGSSSATLTPAPSTHTSFSSKSTSKHSLSLSDLRFSHRLGSGDIGSVYLAELKTKLNETDSKFFAAKVMDKKELVSRNKEGRARTEREILETLDHPFLPTLYAFIDTQRWLCLLTEFCSGGDLHVLRQRQPLKRFEETAVRFYASEVIVALEYLHMMGIVYRDLKPENVLVRSDGHIMLTDFDLSLKCDDSTSTPQIISDKIDAAAAPKNDYLFEHPSYTSSSCILPNCIVPAVSCFHPRRKRKKKMGNRGGPEFVAEPVDVRSMSFVGTHEYLAPEIVSGEGHGSPVDWWTLGIFMFELFYGYTPFRGVDHELTLANVVARALEFPKEPVVPATAKDLVSQLLVKDPARRMGSPMGASAVKHHPFFQGVNWALLRCRPPPYVPPPFSREVVSDESCPETPVEYY

SEQ ID NO: 3295 - DNA, 1359 bp, Populus balsamifera subsp. trichocarpa
  misc_feature (1)..(1359): Ceres ANNOT ID no. 1510994
  misc_feature 365568:<222: Transcription Factor
  misc_feature: Phenotype: WHOLE PLANT - Small Useful for modulating plant size
atggagccagttgtggaagatctaaccgatgatctagataatcttagtttagcttccaccaccaccaccaccactgctgccgagacacgacacagcacaggttcagggtccgaaaccacatggactacctcaacctcgagcctcgtgtcaaactcctgcaagccccatcatccgcctcaatgtgatcagtgttggcatgcaatccaacgtgacaactgcgataactcacccctaaccctagctgatttacgctttgtccacaaattaggaagtggtgacatagggagtgtgtatcttgtagagctcaaggaaggcaacgggtgcctttttgctgccaaagtcatggacaaaaaagaaatggccactaggaataaagatagtagggctagaattgagagggaaatattagaaatgttggagcatccatttttgcctacattgtatgccacattggactcgcccaggcggtcttgtttgttaacggagttttgtcctggcggtgacctccatgtcctccggcaacagcaacctgagagacgtttcggcgaagctgccatccggttctatgcgtcagaggttgtggctgctcttgaatacttgcacatgatgggaatagtctaccgtgacctcaagcctgaaaatgttcttgtaagatcagacggtcacataatgcttacagattttgatctctccttgaaggacgataactcaccgtcaacagctcagattatctccgatcaaaaccagccaaccacagcttcatcaacaagagactacccttctgatacatctcaatttgccacatcatcatgtattctacccagttgtattgtgccagctgtctcttgcttccaccataggagaaaacgcaagaagaaactccatcaacgcgggaccctcgagatagtagcagagccaatagacgtccgatccatgtcgtttgttgggacccatgagtacttggcaccggagattgtgtccggcgagggacacggcaacgcagtggattggtggaccttaggcatattcatgtttgaaatgttctacggcgttacaccattcaaagggatggaccatgagttaaccctagcaaacattgtggctcgagcccttgaattccccaaggaaccctcaattccagtcctcgcgaaggacttgatcacccaacttctcatcaaagatcccgtaagacgactgggttctaccatgggagctacagccatcaaacaccatcagttttttgacgggataaactgggcactgctaaggtgtagaacaccaccttatattcctcgaccggtcacttataaaaaccttgttgtggcagaacatgggaataattctatagagtattattag

SEQ ID NO: 3296 - protein, 452 aa, Populus balsamifera subsp. trichocarpa
  misc_feature (1)..(452): Ceres ANNOT ID no. 1510994
  misc_feature (83)..(210): Pfam Name: Pkinase_Tyr Pfam Description: Protein tyrosine kinase
  misc_feature: SWISSPROT Homolog: KPK1_PHAVU Protein kinase PVPK-1 chloroplast precursor (EC 2.7.11.1) with e-value of 8.3e-98 and BLAST sequence identity of 51.0
  misc_feature: SWISSPROT Homolog: G11A_ORYSA Protein kinase G11A chloroplast precursor (EC 2.7.11.1) with e-value of 4.6e-94 and BLAST sequence identity of 46.3
  misc_feature: SWISSPROT Homolog: KPK7_ARATH Putative serine/threonine-protein kinase PK7 chloroplast precursor (EC 2.7.11.1) with e-value of 2.3e-89 and BLAST sequence identity of 53.8
  misc_feature: SWISSPROT Homolog: PHOT2_ARATH Phototropin-2 with e-value of 3.9e-75 and BLAST sequence identity of 37.6
  misc_feature: SWISSPROT Homolog: PHOT2_ARATH EC 2.7.11.1 (Defective in chloroplast avoidance protein 1) Non phototropic hypocotyl 1-like protein 1) (NPH1-like 1) (AtKin7)
  misc_feature: SWISSPROT Homolog: PHOT1_ARATH Phototropin-1 chloroplast precursor (EC 2.7.11.1) (Non-phototropic hypocotyl protein 1)(Root phototropism protein 1) with e-value of 1.2e-71 and BLAST sequence identity of 39.5
  misc_feature 365691:<222: Transcription Factor
  misc_feature: Phenotype: WHOLE PLANT - Small Useful for modulating plant size
  misc_feature (1)..(452): Functional Homolog of  Ceres CLONE ID no. 609573 at SEQ ID NO. 3333 with e-value of 4.99E-87 and BLAST sequence identity of 50.5
MEPVVEDLTDDLDNLSLASTTTTTTAAETRHSTGSGSETTWTTSTSSLVSNSCKPHHPPQCDQCWHAIQRDNCDNSPLTLADLRFVHKLGSGDIGSVYLVELKEGNGCLFAAKVMDKKEMATRNKDSRARIEREILEMLEHPFLPTLYATLDSPRRSCLLTEFCPGGDLHVLRQQQPERRFGEAAIRFYASEVVAALEYLHMMGIVYRDLKPENVLVRSDGHIMLTDFDLSLKDDNSPSTAQIISDQNQPTTASSTRDYPSDTSQFATSSCILPSCIVPAVSCFHHRRKRKKKLHQRGTLEIVAEPIDVRSMSFVGTHEYLAPEIVSGEGHGNAVDWWTLGIFMFEMFYGVTPFKGMDHELTLANIVARALEFPKEPSIPVLAKDLITQLLIKDPVRRLGSTMGATAIKHHQFFDGINWALLRCRTPPYIPRPVTYKNLVVAEHGNNSIEYY

SEQ ID NO: 3297 - DNA, 1494 bp, Populus balsamifera subsp. trichocarpa
  misc_feature (1)..(1494): Ceres ANNOT ID no. 1457771
  misc_feature 365811:<222: Transcription Factor
  misc_feature: Phenotype: WHOLE PLANT - Small Useful for modulating plant size
atggcccaaccccatcttgccggcccgtacttccctcctccgttccctttaaaatctcaactccctctccgcaccctcattccaaaaccccagttgtccaatccactcccggccaccattctttccgccaccgccatggagccagttgtggaagatctaaccgatgatctagataatcttagtttagcttccaccaccaccaccaccactgctgccgagacacgacacagcacaggttcagggtccgaaaccacatggactacctcaacctcgagcctcgtgtcaaactcctgcaagccccatcatccgcctcaatgtgatcagtgttggcatgcaatccaacgtgacaactgcgataactcacccctaaccctagctgatttacgctttgtccacaaattaggaagtggtgacatagggagtgtgtatcttgtagagctcaaggaaggcaacgggtgcctttttgctgccaaagtcatggacaaaaaagaaatggccactaggaataaagatagtagggctagaattgagagggaaatattagaaatgttggagcatccatttttgcctacattgtatgccacattggactcgcccaggcggtcttgtttgttaacggagttttgtcctggcggtgacctccatgtcctccggcaacagcaacctgagagacgtttcggcgaagctgccatccggttctatgcgtcagaggttgtggctgctcttgaatacttgcacatgatgggaatagtctaccgtgacctcaagcctgaaaatgttcttgtaagatcagacggtcacataatgcttacagattttgatctctccttgaaggacgataactcaccgtcaacagctcagattatctccgatcaaaaccagccaaccacagcttcatcaacaagagactacccttctgatacatctcaatttgccacatcatcatgtattctacccagttgtattgtgccagctgtctcttgcttccaccataggagaaaacgcaagaagaaactccatcaacgcgggaccctcgagatagtagcagagccaatagacgtccgatccatgtcgtttgttgggacccatgagtacttggcaccggagattgtgtccggcgagggacacggcaacgcagtggattggtggaccttaggcatattcatgtttgaaatgttctacggcgttacaccattcaaagggatggaccatgagttaaccctagcaaacattgtggctcgagcccttgaattccccaaggaaccctcaattccagtcctcgcgaaggacttgatcacccaacttctcatcaaagatcccgtaagacgactgggttctaccatgggagctacagccatcaaacaccatcagttttttgacgggataaactgggcactgctaaggtgtagaacaccaccttatattcctcgaccggtcacttataaaaaccttgttgtggcagaacatgggaataattctatagagtattattag

SEQ ID NO: 3298 - protein, 452 aa, Populus balsamifera subsp. trichocarpa; identical to SEQ ID NO: 3296
  misc_feature (1)..(452): Ceres ANNOT ID no. 1457771
  misc_feature (83)..(210): Pfam Name: Pkinase_Tyr Pfam Description: Protein tyrosine kinase
  misc_feature: SWISSPROT Homolog: KPK1_PHAVU Protein kinase PVPK-1 chloroplast precursor (EC 2.7.11.1) with e-value of 8.3e-98 and BLAST sequence identity of 51.0
  misc_feature: SWISSPROT Homolog: G11A_ORYSA Protein kinase G11A chloroplast precursor (EC 2.7.11.1) with e-value of 4.6e-94 and BLAST sequence identity of 46.3
  misc_feature: SWISSPROT Homolog: KPK7_ARATH Putative serine/threonine-protein kinase PK7 chloroplast precursor (EC 2.7.11.1) with e-value of 2.3e-89 and BLAST sequence identity of 53.8
  misc_feature: SWISSPROT Homolog: PHOT2_ARATH Phototropin-2 with e-value of 3.9e-75 and BLAST sequence identity of 37.6
  misc_feature: SWISSPROT Homolog: PHOT2_ARATH EC 2.7.11.1 (Defective in chloroplast avoidance protein 1) Non phototropic hypocotyl 1-like protein 1) (NPH1-like 1) (AtKin7)
  misc_feature: SWISSPROT Homolog: PHOT1_ARATH Phototropin-1 chloroplast precursor (EC 2.7.11.1) (Non-phototropic hypocotyl protein 1)(Root phototropism protein 1) with e-value of 1.2e-71 and BLAST sequence identity of 39.5
  misc_feature 365938:<222: Transcription Factor
  misc_feature: Phenotype: WHOLE PLANT - Small Useful for modulating plant size
  misc_feature (1)..(452): Functional Homolog of  Ceres CLONE ID no. 609573 at SEQ ID NO. 3333 with e-value of 4.99E-87 and BLAST sequence identity of 50.5

SEQ ID NO: 3299 - protein, 528 aa, Glycine max
  misc_feature (1)..(528): Ceres CLONE ID no. 627596
  misc_feature (53)..(520): Pfam Name: p450 Pfam Description: Cytochrome P450
  misc_feature: Phenotype: INFLORESCENCE - Corkscrew Appearance Useful for making ornamental plants with modified flowers
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Other Useful for making ornamental plants with modified flowers
MSSSELSSFFLLRLSDILSFDVLLGVMFLVAVFGYWLVPGGFAWAFSKFKPAIPGPSGYPVVGLVWAFIGPLTHRVLAKLAETFDAKPLMAFSVGFTRFIISSHPDTAKEILNSSAFADRPVKESAYELLFHRAMGFAPYGEYWRNLRRISATHMFSPRRIAAQGVFRARIGAQMVRDIVGLMGRDGVVEVRKVLHFGSLNNVMKSVFGRSYVFGEGGDGCELEGLVSEGYHLLGVFNWSDHFPLLGWLDLQGVRKSCRSLVDRVNVYVGKIILEHRVKRVAQGEDNKAIDTDSSGDFVDVLLDLEKENRLNHSDMVAVLWEMIFRGTDTVAILLEWILARMVLHPEIQAKAQSEIDSVVGSGRSVSDDDLPNLPYVRAIVKETLRMHPPGPLLSWARLSIHDTQIGNHFVPAGTTAMVNMWAITHDQEVWYEPKQFKPERFLKDEDVPIMGSDLRLAPFGSGRRVCPGKAMGLATVELWLAMFLQKFKWMPCDDSGVDLSECLKLSMEMKHSLKTKVVARPVVSLAM

SEQ ID NO: 3300 - DNA, 1560 bp, Populus balsamifera subsp. trichocarpa
  misc_feature (1)..(1560): Ceres ANNOT ID no. 1500987
  misc_feature 366230:<222: Transcription Factor
  misc_feature: Phenotype: INFLORESCENCE - Corkscrew Appearance Useful for making ornamental plants with modified flowers
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Other Useful for making ornamental plants with modified flowers
atgaagtccataccagcaaacctttcttccatactattttgcttagctgtcatcacccaccaaactccatggcctgttgctctccttttattctcgttatcctctttctttgctttctctctaaactattggttagtccctggaggttttgcatggagaaaccatcacgacaatcaaaacccttcaagatttcgtggtccaattgggtggcctatagtgggcactttaccccaaatgggttcacttgctcatcgaaaattagctagcatggctgcctcattaggggcaactaagcttatggcattcagtttaggctcaactcgtgtgataattagtagccatccagacacagccagggaaatcctatgcgggtgctctttcgctgaccgtcctattaaggaatcagctcgtttgttaatgtttgagcgtgccattggctttgctccttccggagactattggcgacacttgcgtagaattgcggcaaattacatgttttccccgaggaaaatctctgctctagagccacttaggcaacgtttagctaatgaaatggtggcagaagtgagagaggagatgaaggagagacgggttgttgtgttaagagacatattgcagaaaggttcattaagtaatgtattagagagtgtttttggtagtgatgtctctatagagagggaggagttagggttcatggttaaagaaggatttgacttgattgcagaatttaatttggatgactattttccactaaggtttttggactttcatggagtgaagagaaggtgttgtcagttggctggcaaggttaatagtgttgtgggtcaaattgtgaaggaaagaaaaggagctggagactcaaggagtggaagtgactttcttagtgctttgctatccttgcctgaggaagaccagttgaatgaatcagatatggtggctcttttatgggagatgatattccgaggaacagacacagttgctttgcttctcgagtggataatggctcggatggtggtgcacccagaaatccaagcaaaggcccaggaggagcttgacacgtgcattggcggccacagggaggtgcaagattcggatatccctaatctcccctacctccgagcaatagtcaaagaagtcctgagattgcacccacctggcccactactctcgtgggcccgcctagccatccatgatgtgcacgtggacaagacgttcatccctgccggcacaacagtgatggttaacatgtgggccataacacatgacccttccatttggagggatccatggtccttcaatcctgaccggttcattgaagaggatgtgctgattatgggctcagatctaaggctcgcaccatttggagcagggcgcagggtgtgtccaggcaaggcacttgggctagccacggtgcacctatggctcgcacggcttttacacgagtacagatggttacccgcaaaacccgtggatctttctgagtgtttaaggctctctctcgaaatgaaaaggccactggaatgtcatgtggttcaacgacggagcaaagtcacgcaatga

SEQ ID NO: 3301 - protein, 519 aa, Populus balsamifera subsp. trichocarpa
  misc_feature (1)..(519): Ceres ANNOT ID no. 1500987
  misc_feature (64)..(509): Pfam Name: p450 Pfam Description: Cytochrome P450
  misc_feature: SWISSPROT Homolog: C78A3_SOYBN Cytochrome P450 78A3 (EC 1.14.-.-) with e-value of 1.8e-138 and BLAST sequence identity of 53.5
  misc_feature: SWISSPROT Homolog: C78A4_PINRA Cytochrome P450 78A4 (EC 1.14.-.-) with e-value of 6.1e-131 and BLAST sequence identity of 52.1
  misc_feature: SWISSPROT Homolog: C78AB_ORYSA Cytochrome P450 78A11 (EC 1.14.-.-) (PLASTOCHRON1 protein) with e-value of 2.4e-120 and BLAST sequence identity of 49.6
  misc_feature: SWISSPROT Homolog: C78A1_MAIZE Cytochrome P450 78A1 (EC 1.14.-.-) (CYPLXXVIII) with e-value of 1.4e-115 and BLAST sequence identity of 52.6
  misc_feature: SWISSPROT Homolog: F3PH_ARATH Flavonoid 3'-monooxygenase EC 1.14.13.21(Flavonoid 3'-hydroxylase) (AtF3'H) (Cytochrome P450 75B1) (TRANSPARENT TESTA 7 protein) with e-value of 2.0e-68 and BLAST sequence identity of 33.6
  misc_feature 366397:<222: Transcription Factor
  misc_feature: Phenotype: INFLORESCENCE - Corkscrew Appearance Useful for making ornamental plants with modified flowers
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Other Useful for making ornamental plants with modified flowers
  misc_feature (1)..(519): Functional Homolog of  Ceres CLONE ID no. 627596 at SEQ ID NO. 3346 with e-value of 2.50E-140 and BLAST sequence identity of 59.1
MKSIPANLSSILFCLAVITHQTPWPVALLLFSLSSFFAFSLNYWLVPGGFAWRNHHDNQNPSRFRGPIGWPIVGTLPQMGSLAHRKLASMAASLGATKLMAFSLGSTRVIISSHPDTAREILCGCSFADRPIKESARLLMFERAIGFAPSGDYWRHLRRIAANYMFSPRKISALEPLRQRLANEMVAEVREEMKERRVVVLRDILQKGSLSNVLESVFGSDVSIEREELGFMVKEGFDLIAEFNLDDYFPLRFLDFHGVKRRCCQLAGKVNSVVGQIVKERKGAGDSRSGSDFLSALLSLPEEDQLNESDMVALLWEMIFRGTDTVALLLEWIMARMVVHPEIQAKAQEELDTCIGGHREVQDSDIPNLPYLRAIVKEVLRLHPPGPLLSWARLAIHDVHVDKTFIPAGTTVMVNMWAITHDPSIWRDPWSFNPDRFIEEDVLIMGSDLRLAPFGAGRRVCPGKALGLATVHLWLARLLHEYRWLPAKPVDLSECLRLSLEMKRPLECHVVQRRSKVTQ

SEQ ID NO: 3302 - DNA, 1572 bp, Populus balsamifera subsp. trichocarpa
  misc_feature (1)..(1572): Ceres ANNOT ID no. 1490915
  misc_feature 366571:<222: Transcription Factor
  misc_feature: Phenotype: INFLORESCENCE - Corkscrew Appearance Useful for making ornamental plants with modified flowers
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Other Useful for making ornamental plants with modified flowers
atgatgtccttgctagccaacctttctttcttactctttttcctggccatcatcacccaccaaactccatggcctatcactgtccttttactctcattattctcttcttttgctctctctctgaactattggttagtccctggaggttttgcatggagaaaccatcacgacaatcaaaacccttcaaagttccggggtccaattggctggcctgtattcggcactctacctcaaatgggttcacttgctcatcgaaaactagctagcatggctacctcgttaggtgcaactaagcttatggcatttagtctaggcacaactcgtgtgatcattagtagccacccagacacggccagggaaatcctatgggggtcttctttcgctgaccgtcctgtaaaggaatcagctcgtttgttaatgtttgagcgtgccattggctttgctccatccggggactattggcgacacttacgtagaattgctgcaaatcatatgttttcccctaagaaaatctctggtctagagccacttaggcaacgtttagctaatgaaatgttggcggaagtgagtggggagatgaaggagagacgggctgttgtgctaagagggatattacaaaaaagttcattaagcaatgtactggagagtgttcttggcagtgatgtccatgtaaaaagggaggagttagggttcatggctcaagaaggatttgacttggtttcaagatttaatttggaggactattttccactaaggtttttagacttttatggggtgaagagaaggtgttataagctggctggcaaggtcaatagtcttgtgggtcaaattgtgagggaaagaaaaagagctggagacttcaggagtcgtactgactttcttagtgctttgttgtctttgcccgagcaagagcggttggacgaatcagatatggttcctcttttgtgggagatgatatttcgaggaacggacacagttgctatacttctcgagtggatcatggcgaggatggtgttgcacccagagatccaagctaaggcccagcaagagcttgaaaagttcatcggcaatcacaggcgagtgcaagattctgacatccctaatctaccctacctccaagcaatagtcaaggaagtcctacgactgcacccacctggcccacttctctcgtgggcccgccttgccatccatgatgtgcacgtggacaaaatgtctatcccagctggcacaacagcaatggtcaacatgtgggccataacacacgacccgtccatttggagggatccgtgggccttcaatccagaccggttcatggaagaggatgtgttgataatgggttcagacttgaggcttgcacctttcgggtcagggcgcagggtgtgtccaggcaaggcacttgggttagccacggtgcacctctggctagcacggcttttacacgagtacaagtggctacccgccaagcctgtggatctttccgagtgtttgaggctctctctcgaaatgaaaaggccactggaatgccatgtcgttccatggagcaaagttgccgattttgatcagaaaacttag

SEQ ID NO: 3303 - protein, 522 aa, Populus balsamifera subsp. trichocarpa
  misc_feature (1)..(522): Ceres ANNOT ID no. 1490915
  misc_feature (63)..(508): Pfam Name: p450 Pfam Description: Cytochrome P450
  misc_feature: SWISSPROT Homolog: C78A3_SOYBN Cytochrome P450 78A3 (EC 1.14.-.-) with e-value of 1.8e-138 and BLAST sequence identity of 53.5
  misc_feature: SWISSPROT Homolog: C78A4_PINRA Cytochrome P450 78A4 (EC 1.14.-.-) with e-value of 6.1e-131 and BLAST sequence identity of 52.1
  misc_feature: SWISSPROT Homolog: C78AB_ORYSA Cytochrome P450 78A11 (EC 1.14.-.-) (PLASTOCHRON1 protein) with e-value of 2.4e-120 and BLAST sequence identity of 49.6
  misc_feature: SWISSPROT Homolog: C78A1_MAIZE Cytochrome P450 78A1 (EC 1.14.-.-) (CYPLXXVIII) with e-value of 1.4e-115 and BLAST sequence identity of 52.6
  misc_feature: SWISSPROT Homolog: F3PH_ARATH Flavonoid 3'-monooxygenase EC 1.14.13.21(Flavonoid 3'-hydroxylase) (AtF3'H) (Cytochrome P450 75B1) (TRANSPARENT TESTA 7 protein) with e-value of 2.0e-68 and BLAST sequence identity of 33.6
  misc_feature 366738:<222: Transcription Factor
  misc_feature: Phenotype: INFLORESCENCE - Corkscrew Appearance Useful for making ornamental plants with modified flowers
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Other Useful for making ornamental plants with modified flowers
  misc_feature (1)..(522): Functional Homolog of  Ceres CLONE ID no. 627596 at SEQ ID NO. 3346 with e-value of 1.60E-136 and BLAST sequence identity of 56.8
MSLLANLSFLLFFLAIITHQTPWPITVLLLSLFSSFALSLNYWLVPGGFAWRNHHDNQNPSKFRGPIGWPVFGTLPQMGSLAHRKLASMATSLGATKLMAFSLGTTRVIISSHPDTAREILWGSSFADRPVKESARLLMFERAIGFAPSGDYWRHLRRIAANHMFSPKKISGLEPLRQRLANEMLAEVSGEMKERRAVVLRGILQKSSLSNVLESVLGSDVHVKREELGFMAQEGFDLVSRFNLEDYFPLRFLDFYGVKRRCYKLAGKVNSLVGQIVRERKRAGDFRSRTDFLSALLSLPEQERLDESDMVPLLWEMIFRGTDTVAILLEWIMARMVLHPEIQAKAQQELEKFIGNHRRVQDSDIPNLPYLQAIVKEVLRLHPPGPLLSWARLAIHDVHVDKMSIPAGTTAMVNMWAITHDPSIWRDPWAFNPDRFMEEDVLIMGSDLRLAPFGSGRRVCPGKALGLATVHLWLARLLHEYKWLPAKPVDLSECLRLSLEMKRPLECHVVPWSKVADFDQKT

SEQ ID NO: 3304 - protein, 138 aa, Glycine max
  misc_feature (1)..(138): Ceres CLONE ID no. 641355
  misc_feature (16)..(80): Pfam Name: AP2 Pfam Description: AP2 domain
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: INFLORESCENCE - No Branching Useful for modifying plant architecture, ie amount of  branching
  misc_feature: Phenotype: ROSETTE LEAVES - Glossy Useful for making plants with enhanced abiotic stress tolerance
  misc_feature: Phenotype: ROSETTE LEAVES - Oval Shaped Useful for making plants with increased biomass and foliage
MEEESKEKKKDTKEEPRYRGVRRRPWGKFAAEIRDPARHGARVWLGTFLTAEEAARAYDRAAYEMRGALAVLNFPNEYPSCSSMNSSSTLAPSSSSSNSMLKSDHGKQVIEFECLDDKLLEDLLDCDDYAYEKDLPKN

SEQ ID NO: 3305 - DNA, 417 bp, Populus balsamifera subsp. trichocarpa
  misc_feature (1)..(417): Ceres ANNOT ID no. 1463335
  misc_feature 367016:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: INFLORESCENCE - No Branching Useful for modifying plant architecture, ie amount of  branching
  misc_feature: Phenotype: ROSETTE LEAVES - Glossy Useful for making plants with enhanced abiotic stress tolerance
  misc_feature: Phenotype: ROSETTE LEAVES - Oval Shaped Useful for making plants with increased biomass and foliage
atggacgaggacaaaacaaagagcaaggatgaaggaggagaggtcaagtacagaggtgtcaggaagaggccatggggaaaattcgctgcggagatacgtgattcagccaggcaaggggcgagggtgtggctggggacttttagcacggcggaggaggcagcaagagcctatgacagagcagcttatgcaatgagagggcacttggccgttctcaattttcctaacgagtacccaaatatggccggtaatgctagcgttggttccagtagttctactcccttttcctcttcaggctatccaggttcttcttcctcttcatcatcaacgcaacaagaagtttttgagttcgaatgcttggatgataagttgcttgaggagctgctagagcaagaagagaaaaggagtaagaaaacgtaa

SEQ ID NO: 3306 - protein, 138 aa, Populus balsamifera subsp. trichocarpa
  misc_feature (1)..(138): Ceres ANNOT ID no. 1463335
  misc_feature (15)..(79): Pfam Name: AP2 Pfam Description: AP2 domain
  misc_feature: SWISSPROT Homolog: ERF14_ARATH Ethylene-responsive transcription factor 14 EREBP-14(AtERF14) with e-value of 1.7e-30 and BLAST sequence identity of 63.4
  misc_feature: SWISSPROT Homolog: ERF15_ARATH Ethylene-responsive transcription factor 15 EREBP-15 (AtERF15) with e-value of 2.7e-27 and BLAST sequence identity of 62.3
  misc_feature: SWISSPROT Homolog: PTI5_LYCES Pathogenesis-related genes transcriptional activator PTI5 (PTO-interacting protein 5) with e-value of 4.4e-25 and BLAST sequence identity of 66.3
  misc_feature: SWISSPROT Homolog: ERF2_ARATH Ethylene-responsive transcription factor 2 EREBP-2 (AtERF2) with e-value of 1.2e-24 and BLAST sequence identity of 55.3
  misc_feature: SWISSPROT Homolog: ERF5_TOBAC Ethylene-responsive transcription factor 5 EREBP-4 (NtERF4) with e-value of 2.2e-23 and BLAST sequence identity of 53.0
  misc_feature 367150:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: INFLORESCENCE - No Branching Useful for modifying plant architecture, ie amount of  branching
  misc_feature: Phenotype: ROSETTE LEAVES - Glossy Useful for making plants with enhanced abiotic stress tolerance
  misc_feature: Phenotype: ROSETTE LEAVES - Oval Shaped Useful for making plants with increased biomass and foliage
  misc_feature (1)..(138): Functional Homolog of  Ceres CLONE ID no. 641355 at SEQ ID NO. 3351 with e-value of 3.49E-38 and BLAST sequence identity of 65.6
MDEDKTKSKDEGGEVKYRGVRKRPWGKFAAEIRDSARQGARVWLGTFSTAEEAARAYDRAAYAMRGHLAVLNFPNEYPNMAGNASVGSSSSTPFSSSGYPGSSSSSSSTQQEVFEFECLDDKLLEELLEQEEKRSKKT

SEQ ID NO: 3307 - DNA, 447 bp, Populus balsamifera subsp. trichocarpa
  misc_feature (1)..(447): Ceres ANNOT ID no. 1463334
  misc_feature 367259:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: INFLORESCENCE - No Branching Useful for modifying plant architecture, ie amount of  branching
  misc_feature: Phenotype: ROSETTE LEAVES - Glossy Useful for making plants with enhanced abiotic stress tolerance
  misc_feature: Phenotype: ROSETTE LEAVES - Oval Shaped Useful for making plants with increased biomass and foliage
atggaagagcctgataaagggaaggaaaaggaattgaaagggagagaagaggttcgataccggggtgttcgaaggagaccttggggaaaatttgcggcggaaatacgagacccatcaaggcagggagcaaggttatggttagggacatttgatacggcagaggaggcagctcgtgcttatgatagagctgcatttagcatgagaggtcatcttgcaatcctcaactttcctaatgattatctctctcaagcgataggatcttctcctcgtcgtccaccagtttcatcatctagtagtgatgttggtgcaagcgagagttttcagaggggaagctcatcaagtgccggacaaggaaagcaagttatcgagtttgagtacttggatgataagattttggaggagcttcttgaaacagaagaggagaagaagaaacggcagcaagattga

SEQ ID NO: 3308 - protein, 148 aa, Populus balsamifera subsp. trichocarpa
  misc_feature (1)..(148): Ceres ANNOT ID no. 1463334
  misc_feature (18)..(82): Pfam Name: AP2 Pfam Description: AP2 domain
  misc_feature: SWISSPROT Homolog: ERF14_ARATH Ethylene-responsive transcription factor 14 EREBP-14(AtERF14) with e-value of 1.7e-30 and BLAST sequence identity of 63.4
  misc_feature: SWISSPROT Homolog: ERF15_ARATH Ethylene-responsive transcription factor 15 EREBP-15 (AtERF15) with e-value of 2.7e-27 and BLAST sequence identity of 62.3
  misc_feature: SWISSPROT Homolog: PTI5_LYCES Pathogenesis-related genes transcriptional activator PTI5 (PTO-interacting protein 5) with e-value of 4.4e-25 and BLAST sequence identity of 66.3
  misc_feature: SWISSPROT Homolog: ERF2_ARATH Ethylene-responsive transcription factor 2 EREBP-2 (AtERF2) with e-value of 1.2e-24 and BLAST sequence identity of 55.3
  misc_feature: SWISSPROT Homolog: ERF5_TOBAC Ethylene-responsive transcription factor 5 EREBP-4 (NtERF4) with e-value of 2.2e-23 and BLAST sequence identity of 53.0
  misc_feature 367395:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: INFLORESCENCE - No Branching Useful for modifying plant architecture, ie amount of  branching
  misc_feature: Phenotype: ROSETTE LEAVES - Glossy Useful for making plants with enhanced abiotic stress tolerance
  misc_feature: Phenotype: ROSETTE LEAVES - Oval Shaped Useful for making plants with increased biomass and foliage
  misc_feature (1)..(148): Functional Homolog of  Ceres CLONE ID no. 641355 at SEQ ID NO. 3351 with e-value of 2.50E-37 and BLAST sequence identity of 68.5
MEEPDKGKEKELKGREEVRYRGVRRRPWGKFAAEIRDPSRQGARLWLGTFDTAEEAARAYDRAAFSMRGHLAILNFPNDYLSQAIGSSPRRPPVSSSSSDVGASESFQRGSSSSAGQGKQVIEFEYLDDKILEELLETEEEKKKRQQD

SEQ ID NO: 3309 - DNA, 432 bp, Populus balsamifera subsp. trichocarpa
  misc_feature (1)..(432): Ceres ANNOT ID no. 1452665
  misc_feature 367507:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: INFLORESCENCE - No Branching Useful for modifying plant architecture, ie amount of  branching
  misc_feature: Phenotype: ROSETTE LEAVES - Glossy Useful for making plants with enhanced abiotic stress tolerance
  misc_feature: Phenotype: ROSETTE LEAVES - Oval Shaped Useful for making plants with increased biomass and foliage
atggaaacacatcaaggagagaagaacacaaagaagcaagagaaaggaaggggggagaatgcgtataggggaattcgcaggcgaccttggggtaagtttgctgccgagatacgtgacccaacaaagaatggggcacgtcgttggctaggaacatatgacacggcggaggaggcggctcgggcatatgaccgagctgcttttgccttccggggtcatttagccattctcaatttcccgaatgaataccaacatcaggatccaagctctgccatgtcatttgcttcttcatcttcattctccactgccaatcctgtgaattatggccatgaagtttcctctactggcggacaagaagttatagagttcgagtatttggataacaaattgttggaggagctgctgggaacgaatgatcccagcaggcagcattag

SEQ ID NO: 3310 - protein, 143 aa, Populus balsamifera subsp. trichocarpa
  misc_feature (1)..(143): Ceres ANNOT ID no. 1452665
  misc_feature (20)..(84): Pfam Name: AP2 Pfam Description: AP2 domain
  misc_feature: SWISSPROT Homolog: ERF14_ARATH Ethylene-responsive transcription factor 14 EREBP-14(AtERF14) with e-value of 1.7e-30 and BLAST sequence identity of 63.4
  misc_feature: SWISSPROT Homolog: ERF15_ARATH Ethylene-responsive transcription factor 15 EREBP-15 (AtERF15) with e-value of 2.7e-27 and BLAST sequence identity of 62.3
  misc_feature: SWISSPROT Homolog: PTI5_LYCES Pathogenesis-related genes transcriptional activator PTI5 (PTO-interacting protein 5) with e-value of 4.4e-25 and BLAST sequence identity of 66.3
  misc_feature: SWISSPROT Homolog: ERF2_ARATH Ethylene-responsive transcription factor 2 EREBP-2 (AtERF2) with e-value of 1.2e-24 and BLAST sequence identity of 55.3
  misc_feature: SWISSPROT Homolog: ERF5_TOBAC Ethylene-responsive transcription factor 5 EREBP-4 (NtERF4) with e-value of 2.2e-23 and BLAST sequence identity of 53.0
  misc_feature 367643:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: INFLORESCENCE - No Branching Useful for modifying plant architecture, ie amount of  branching
  misc_feature: Phenotype: ROSETTE LEAVES - Glossy Useful for making plants with enhanced abiotic stress tolerance
  misc_feature: Phenotype: ROSETTE LEAVES - Oval Shaped Useful for making plants with increased biomass and foliage
  misc_feature (1)..(143): Functional Homolog of  Ceres CLONE ID no. 641355 at SEQ ID NO. 3351 with e-value of 2.39E-32 and BLAST sequence identity of 58.7
METHQGEKNTKKQEKGRGENAYRGIRRRPWGKFAAEIRDPTKNGARRWLGTYDTAEEAARAYDRAAFAFRGHLAILNFPNEYQHQDPSSAMSFASSSSFSTANPVNYGHEVSSTGGQEVIEFEYLDNKLLEELLGTNDPSRQH

SEQ ID NO: 3311 - protein, 199 aa, Zea mays
  misc_feature (1)..(199): Ceres CLONE ID no. 645550
  misc_feature (75)..(174): Pfam Name: K-box Pfam Description: K-box region
  misc_feature (9)..(59): Pfam Name: SRF-TF Pfam Description: SRF-type transcription factor DNA-binding and dimerisation domain)
  misc_feature: Phenotype: CAULINE LEAVES - Curled 2 Useful for making ornamental plants with altered leaf shape
  misc_feature: Phenotype: ROSETTE LEAVES - Curled 2 Useful for making ornamental plants with altered leaf shape
  misc_feature: Phenotype: CAULINE LEAVES - Curled 3 Useful for making ornamental plants with altered leaf shape
  misc_feature: Phenotype: ROSETTE LEAVES - Curled 3 Useful for making ornamental plants with altered leaf shape
MARGKVQMRRIENPVHRQVTFCKRRMGLLKKARELSVLCDAAIGVIVISPHGKIYDLATNGNMQGLIERYRRACSEMHGESSNHNETQTIKQEVLALTHEIDLLQKGFRYMHGENDIDHMNLVELQTLENNLEMWANNIRSQKMQIISREIDMLRNKEAILQAVNGVLQERIIEQNGILNFSGTAMTPSQLTMESNYYL

SEQ ID NO: 3312 - DNA, 621 bp, Populus balsamifera subsp. trichocarpa; identical to SEQ ID NO: 2917
  misc_feature (1)..(621): Ceres ANNOT ID no. 1479649
  misc_feature 367847:<222: Transcription Factor
  misc_feature: Phenotype: CAULINE LEAVES - Curled 2 Useful for making ornamental plants with altered leaf shape
  misc_feature: Phenotype: ROSETTE LEAVES - Curled 2 Useful for making ornamental plants with altered leaf shape
  misc_feature: Phenotype: CAULINE LEAVES - Curled 3 Useful for making ornamental plants with altered leaf shape
  misc_feature: Phenotype: ROSETTE LEAVES - Curled 3 Useful for making ornamental plants with altered leaf shape

SEQ ID NO: 3313 - protein, 206 aa, Populus balsamifera subsp. trichocarpa; identical to SEQ ID NO: 2918
  misc_feature (1)..(206): Ceres ANNOT ID no. 1479649
  misc_feature (83)..(178): Pfam Name: K-box Pfam Description: K-box region
  misc_feature (9)..(59): Pfam Name: SRF-TF Pfam Description: SRF-type transcription factor DNA-binding and dimerisation domain)
  misc_feature: SWISSPROT Homolog: MAD26_ORYSA MADS-box transcription factor 26 (OsMADS26) (FDRMADS3) (RMADS220) with e-value of 2.6e-52 and BLAST sequence identity of 59.3
  misc_feature: SWISSPROT Homolog: MAD33_ORYSA MADS-box transcription factor 33 (OsMADS33) with e-value of 6.8e-45 and BLAST sequence identity of 55.4
  misc_feature: SWISSPROT Homolog: AGL12_ARATH Agamous-like MADS-box protein AGL12 with e-value of 2.3e-44 and BLAST sequence identity of 49.5
  misc_feature: SWISSPROT Homolog: AGL14_ARATH Agamous-like MADS-box protein AGL14 with e-value of 8.2e-33 and BLAST sequence identity of 38.6
  misc_feature: SWISSPROT Homolog: MAD14_ORYSA MADS-box transcription factor 14 (OsMADS14) (Protein APETALA1- like B)(Protein AGAMOUS-like 10) (FDRMADS6) (RMADS211) with e-value of 2.2e-32 and BLAST sequence identity of 43.6
  misc_feature 367966:<222: Transcription Factor
  misc_feature: Phenotype: CAULINE LEAVES - Curled 2 Useful for making ornamental plants with altered leaf shape
  misc_feature: Phenotype: ROSETTE LEAVES - Curled 2 Useful for making ornamental plants with altered leaf shape
  misc_feature: Phenotype: CAULINE LEAVES - Curled 3 Useful for making ornamental plants with altered leaf shape
  misc_feature: Phenotype: ROSETTE LEAVES - Curled 3 Useful for making ornamental plants with altered leaf shape
  misc_feature (1)..(206): Functional Homolog of  Ceres CLONE ID no. 645550 at SEQ ID NO. 3358 with e-value of 2.09E-47 and BLAST sequence identity of 56.7

SEQ ID NO: 3314 - protein, 299 aa, Glycine max
  misc_feature (1)..(299): Ceres CLONE ID no. 660003
  misc_feature (1)..(299): Also Known As Ceres CDNA ID no. 23704291
  misc_feature (1)..(299): Also Known As Ceres GEMINI ID 553H5
  misc_feature (76)..(181): Pfam Name: B3 Pfam Description: B3 DNA binding domain
  misc_feature 368079:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: WHOLE PLANT - Other Useful for making bigger plants
  misc_feature: Phenotype: ROSETTE LEAVES - Other Useful for making ornamental plants with modified leaves
  misc_feature (239)..(239): Xaa is any aa, unknown, or other
MSSIHHYSPETTLYWTSDHQQQQQQQQQQQQQAATWLSNSHTPRFNLNEDDDEEDDVVVSDKATNNLAQEQEKEAMFEKPLTPSDVGKLNRLVIPKQHAEKYFPLDSSGGDSAAAKGLLLSFEDESGKCWRFRYSYWNSSQSYVLTKGWSRYVKDKRLHAGDVVLFHRHRAHPQRFFISCTRHQPNPNPPAHVSIRSSSYSALPAYPTHHHHHLPFPYQPHSLHAPGGGSQGQNETTPXGNSSSGRVLRLFGVNMECQPDNDNDSQNSTHECSYTHLYHHQTSSYPSSNPHHHMLPQQP

SEQ ID NO: 3315 - DNA, 843 bp, Populus balsamifera subsp. trichocarpa
  misc_feature (1)..(843): Ceres ANNOT ID no. 1508184
  misc_feature 368215:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: WHOLE PLANT - Other Useful for making bigger plants
  misc_feature: Phenotype: ROSETTE LEAVES - Other Useful for making ornamental plants with modified leaves
atgtctataaaccatttctccacagaccttcaagaaacactcagctggtgggcacagcaacatcaacaacaacaacccatcatggaaccaaacccaaaccagcagcaagatgaaacacaacaagaacaagaagtactagtactagataaagaacccatgtttgagaaacccttaacaccaagtgatgtaggaaaactaaaccgtttagtaataccaaaacaacatgcagagaagtactttccacttagtggtgactcagtggataaagggttgttactgagttttgaagacgagtccggcaggtattggaagttcaggtactcatattggaacagtagtcaaagctatgtattgactaaagggtggagtagatatgtgaaagagaaacaacttgatgcaggtgatgtcgttttgtttgaacgacaccgtacggatggtgacagattgttcatagggtggaggaggagaggtgagagtggcagtaacagtggggtgatggtgcagggtagtggtggtggggtgtggagcagaggaatattatatccatcatcatcttctgggcctcatcatctttctactgctaatgtgccataccaaccttactgtctccatgcagggtccattgcacagaaccaaacaacaccgcttgggaactcaaagagactcaggttatttggggtgaacttggagtgccagcttgatgggtccgagccatcaacacctgatggttcttctgtgtccagcctgcagggtcccggccacccgcaattctactctcaatcttcttattcttcaaacagtactcatggtcaaatggagaatttgtttacgtatagccattaa

SEQ ID NO: 3316 - protein, 280 aa, Populus balsamifera subsp. trichocarpa
  misc_feature (1)..(280): Ceres ANNOT ID no. 1508184
  misc_feature (53)..(159): Pfam Name: B3 Pfam Description: B3 DNA binding domain
  misc_feature: SWISSPROT Homolog: RAV1_ARATH DNA-binding protein RAV1 with e-value of 1.1e-39 and BLAST sequence identity of 69.5
  misc_feature: SWISSPROT Homolog: ARFT_ARATH Putative auxin response factor 20 with e-value of 1.1e-10 and BLAST sequence identity of 39.2
  misc_feature: SWISSPROT Homolog: ARFL_ARATH Putative auxin response factor 12 with e-value of 4.4e-10 and BLAST sequence identity of 36.1
  misc_feature: SWISSPROT Homolog: ARFO_ARATH Putative auxin response factor 15 with e-value of 9.0e-10 and BLAST sequence identity of 36.8
  misc_feature: SWISSPROT Homolog: ARFU_ARATH Putative auxin response factor 21 with e-value of 1.4e-09 and BLAST sequence identity of 36.7
  misc_feature 368360:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: WHOLE PLANT - Other Useful for making bigger plants
  misc_feature: Phenotype: ROSETTE LEAVES - Other Useful for making ornamental plants with modified leaves
  misc_feature (1)..(280): Functional Homolog of  Ceres CLONE ID no. 660003 at SEQ ID NO. 3361 with e-value of 1.40E-57 and BLAST sequence identity of 59.2
MSINHFSTDLQETLSWWAQQHQQQQPIMEPNPNQQQDETQQEQEVLVLDKEPMFEKPLTPSDVGKLNRLVIPKQHAEKYFPLSGDSVDKGLLLSFEDESGRYWKFRYSYWNSSQSYVLTKGWSRYVKEKQLDAGDVVLFERHRTDGDRLFIGWRRRGESGSNSGVMVQGSGGGVWSRGILYPSSSSGPHHLSTANVPYQPYCLHAGSIAQNQTTPLGNSKRLRLFGVNLECQLDGSEPSTPDGSSVSSLQGPGHPQFYSQSSYSSNSTHGQMENLFTYSH

SEQ ID NO: 3317 - DNA, 852 bp, Populus balsamifera subsp. trichocarpa
  misc_feature (1)..(852): Ceres ANNOT ID no. 1528645
  misc_feature 368496:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: WHOLE PLANT - Other Useful for making bigger plants
  misc_feature: Phenotype: ROSETTE LEAVES - Other Useful for making ornamental plants with modified leaves
atgtctataaaccatttctccacagaccttcagcaaacactcagctggtggcaacaagaagaagcacaacgagaacacgaacaagaagggctagtacaagataaagaacccatgtttgagaaacccttaacaccaagtgatgtaggaaagctaaaccgtctagtaataccaaaacaacatgcggagaagtactttccacttagtggtgactcagtggataaagggttgttactgagtttcgaagacgagtcaggcaaatattggaggtttaggtactcatattggaacagtagtcaaagctatgtattgactaaagggtggagtaggtatgtgaaagagaaacaactcgatgcaggtgatgccgttttgtttgaacgacaccgaacggatggtgacagattgttcatagggtggaggaggagaggtgagatgagtagcagtagtagtgctaataatagtggggtgatggtgcagggtagtggtggtggggcgtggagaagaggattatattcttctccatcatcttctgggccttatcatctttctggtagtaatatgcaacatggccatggggctaatgtgagtgctacaactgtgccattccaatctgactttcttcatgcagtgtctgctgcacagaaccaaacagcacagccaggtaactcgaggagactgaggctatttggggttaacttggagtgccagctcgacgaggccgagccaccaacacctgacggttcatctctgtcgagcctacagggccctgttcaccagcaattctactcccaacctgcttattcttcaaacagtactcatagtcaaatggtaagcccacatgaccttataatttag

SEQ ID NO: 3318 - protein, 283 aa, Populus balsamifera subsp. trichocarpa
  misc_feature (1)..(283): Ceres ANNOT ID no. 1528645
  misc_feature (38)..(143): Pfam Name: B3 Pfam Description: B3 DNA binding domain
  misc_feature: SWISSPROT Homolog: RAV1_ARATH DNA-binding protein RAV1 with e-value of 1.1e-39 and BLAST sequence identity of 69.5
  misc_feature: SWISSPROT Homolog: ARFT_ARATH Putative auxin response factor 20 with e-value of 1.1e-10 and BLAST sequence identity of 39.2
  misc_feature: SWISSPROT Homolog: ARFL_ARATH Putative auxin response factor 12 with e-value of 4.4e-10 and BLAST sequence identity of 36.1
  misc_feature: SWISSPROT Homolog: ARFO_ARATH Putative auxin response factor 15 with e-value of 9.0e-10 and BLAST sequence identity of 36.8
  misc_feature: SWISSPROT Homolog: ARFU_ARATH Putative auxin response factor 21 with e-value of 1.4e-09 and BLAST sequence identity of 36.7
  misc_feature 368641:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature: Phenotype: WHOLE PLANT - Other Useful for making bigger plants
  misc_feature: Phenotype: ROSETTE LEAVES - Other Useful for making ornamental plants with modified leaves
  misc_feature (1)..(283): Functional Homolog of  Ceres CLONE ID no. 660003 at SEQ ID NO. 3361 with e-value of 3.89E-52 and BLAST sequence identity of 60.4
MSINHFSTDLQQTLSWWQQEEAQREHEQEGLVQDKEPMFEKPLTPSDVGKLNRLVIPKQHAEKYFPLSGDSVDKGLLLSFEDESGKYWRFRYSYWNSSQSYVLTKGWSRYVKEKQLDAGDAVLFERHRTDGDRLFIGWRRRGEMSSSSSANNSGVMVQGSGGGAWRRGLYSSPSSSGPYHLSGSNMQHGHGANVSATTVPFQSDFLHAVSAAQNQTAQPGNSRRLRLFGVNLECQLDEAEPPTPDGSSLSSLQGPVHQQFYSQPAYSSNSTHSQMVSPHDLII

SEQ ID NO: 3319 - protein, 203 aa, Glycine max
  misc_feature (1)..(203): Ceres CLONE ID no. 664365
  misc_feature (61)..(125): Pfam Name: AP2 Pfam Description: AP2 domain
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
  misc_feature: Phenotype: ROSETTE LEAVES - Serrate Margins Useful for making plants with increased biomass and foliage
  misc_feature (51)..(51): Xaa is any aa, unknown, or other
  misc_feature (57)..(57): Xaa is any aa, unknown, or other
  misc_feature (58)..(58): Xaa is any aa, unknown, or other
MDCSSVLHSSNSSFFPFNENDPEEMLLYGMITSYQEKVIIKEEEVNSEENXNKNKKXXNKSSFRGVRSRPWGKFAAEIRDSTRHGVRVWLGTFDSAEAAALAYDQAAFSMRGSAAVLNFPVEKVKESLRDMNCTLSQLDGSSPVVALKRRHSLGRKMAAKKKKVEETHGDVRLENVVVLEDLGAEYLEHLLMMSSHDTTSCSW

SEQ ID NO: 3320 - DNA, 666 bp, Populus balsamifera subsp. trichocarpa; identical to SEQ ID NO: 822
  misc_feature (1)..(666): Ceres ANNOT ID no. 1463333
  misc_feature 368880:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
  misc_feature: Phenotype: ROSETTE LEAVES - Serrate Margins Useful for making plants with increased biomass and foliage

SEQ ID NO: 3321 - protein, 221 aa, Populus balsamifera subsp. trichocarpa; identical to SEQ ID NO: 823
  misc_feature (1)..(221): Ceres ANNOT ID no. 1463333
  misc_feature (85)..(149): Pfam Name: AP2 Pfam Description: AP2 domain
  misc_feature: SWISSPROT Homolog: ERF1B_ARATH Ethylene-responsive transcription factor 1B EREBP-1B (AtERF1) with e-value of 1.6e-50 and BLAST sequence identity of 56.8
  misc_feature: SWISSPROT Homolog: ERF15_ARATH Ethylene-responsive transcription factor 15 EREBP-15 (AtERF15) with e-value of 4.3e-40 and BLAST sequence identity of 58.9
  misc_feature: SWISSPROT Homolog: PTI5_LYCES Pathogenesis-related genes transcriptional activator PTI5 (PTO-interacting protein 5) with e-value of 1.7e-25 and BLAST sequence identity of 50.4
  misc_feature: SWISSPROT Homolog: ERF1A_ARATH Ethylene-responsive transcription factor 1A EREBP-1A (AtERF1) with e-value of 3.3e-25 and BLAST sequence identity of 47.9
  misc_feature: SWISSPROT Homolog: ERF2_ARATH Ethylene-responsive transcription factor 2 EREBP-2 (AtERF2) with e-value of 3.3e-25 and BLAST sequence identity of 49.1
  misc_feature 368996:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
  misc_feature: Phenotype: ROSETTE LEAVES - Serrate Margins Useful for making plants with increased biomass and foliage
  misc_feature (1)..(221): Functional Homolog of  Ceres CLONE ID no. 664365 at SEQ ID NO. 3366 with e-value of 3.50E-55 and BLAST sequence identity of 63.3

SEQ ID NO: 3322 - DNA, 687 bp, Populus balsamifera subsp. trichocarpa; identical to SEQ ID NO: 824
  misc_feature (1)..(687): Ceres ANNOT ID no. 1505772
  misc_feature 369092:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
  misc_feature: Phenotype: ROSETTE LEAVES - Serrate Margins Useful for making plants with increased biomass and foliage

SEQ ID NO: 3323 - protein, 228 aa, Populus balsamifera subsp. trichocarpa; identical to SEQ ID NO: 825
  misc_feature (1)..(228): Ceres ANNOT ID no. 1505772
  misc_feature (92)..(156): Pfam Name: AP2 Pfam Description: AP2 domain
  misc_feature: SWISSPROT Homolog: ERF1B_ARATH Ethylene-responsive transcription factor 1B EREBP-1B (AtERF1) with e-value of 1.6e-50 and BLAST sequence identity of 56.8
  misc_feature: SWISSPROT Homolog: ERF15_ARATH Ethylene-responsive transcription factor 15 EREBP-15 (AtERF15) with e-value of 4.3e-40 and BLAST sequence identity of 58.9
  misc_feature: SWISSPROT Homolog: PTI5_LYCES Pathogenesis-related genes transcriptional activator PTI5 (PTO-interacting protein 5) with e-value of 1.7e-25 and BLAST sequence identity of 50.4
  misc_feature: SWISSPROT Homolog: ERF1A_ARATH Ethylene-responsive transcription factor 1A EREBP-1A (AtERF1) with e-value of 3.3e-25 and BLAST sequence identity of 47.9
  misc_feature: SWISSPROT Homolog: ERF2_ARATH Ethylene-responsive transcription factor 2 EREBP-2 (AtERF2) with e-value of 3.3e-25 and BLAST sequence identity of 49.1
  misc_feature 369208:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
  misc_feature: Phenotype: ROSETTE LEAVES - Serrate Margins Useful for making plants with increased biomass and foliage
  misc_feature (1)..(228): Functional Homolog of  Ceres CLONE ID no. 664365 at SEQ ID NO. 3366 with e-value of 1.20E-51 and BLAST sequence identity of 65.7

SEQ ID NO: 3324 - DNA, 678 bp, Populus balsamifera subsp. trichocarpa
  misc_feature (1)..(678): Ceres ANNOT ID no. 1478872
  misc_feature 369307:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
  misc_feature: Phenotype: ROSETTE LEAVES - Serrate Margins Useful for making plants with increased biomass and foliage
atggattcttcatattttcactcccaaaactctcaattcttcccgggatcatcttcttctttcaattcccttgattctttctcatgtaacgtacaaaacttctacagccaaccccttccttttaatgaaaatgattcccaagaaatgcttctctcaggagtcccaaatgagccccccatcaactcttttgatacctcttcatccaccaatactaactacgatgaggcaagttctagagctaattatcaagaggagccaccccaagaaattgcttatagaggggttaggaggcggccttggggcaagtatgctgccgagataagggattcaacaagaaaacatgtcagagtttggttaggaacatttgatactgccgaggccgcggccttagcttatgatcaagctgcatttacaattagaggctcaatggccgtactaaattttcctgttcaaaaagtttatgagtcacttcaacaaatgggctatggtttccaagaagggcaatcgccaattgtagcaatgaaaaaaagacactcaatgaataggaaagccgagagtaggaaaaggaaagagaaaggaacgagaattggaatggaaaatgtggtggtcctggaggatttaggggctgattacttggaagatcttctaaccatttcagagagtgctcgtccttcgtaa

SEQ ID NO: 3325 - protein, 225 aa, Populus balsamifera subsp. trichocarpa
  misc_feature (1)..(225): Ceres ANNOT ID no. 1478872
  misc_feature (90)..(154): Pfam Name: AP2 Pfam Description: AP2 domain
  misc_feature: SWISSPROT Homolog: ERF1B_ARATH Ethylene-responsive transcription factor 1B EREBP-1B (AtERF1) with e-value of 1.6e-50 and BLAST sequence identity of 56.8
  misc_feature: SWISSPROT Homolog: ERF15_ARATH Ethylene-responsive transcription factor 15 EREBP-15 (AtERF15) with e-value of 4.3e-40 and BLAST sequence identity of 58.9
  misc_feature: SWISSPROT Homolog: PTI5_LYCES Pathogenesis-related genes transcriptional activator PTI5 (PTO-interacting protein 5) with e-value of 1.7e-25 and BLAST sequence identity of 50.4
  misc_feature: SWISSPROT Homolog: ERF1A_ARATH Ethylene-responsive transcription factor 1A EREBP-1A (AtERF1) with e-value of 3.3e-25 and BLAST sequence identity of 47.9
  misc_feature: SWISSPROT Homolog: ERF2_ARATH Ethylene-responsive transcription factor 2 EREBP-2 (AtERF2) with e-value of 3.3e-25 and BLAST sequence identity of 49.1
  misc_feature 369423:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
  misc_feature: Phenotype: ROSETTE LEAVES - Serrate Margins Useful for making plants with increased biomass and foliage
  misc_feature (1)..(225): Functional Homolog of  Ceres CLONE ID no. 664365 at SEQ ID NO. 3366 with e-value of 4.40E-49 and BLAST sequence identity of 57.7
MDSSYFHSQNSQFFPGSSSSFNSLDSFSCNVQNFYSQPLPFNENDSQEMLLSGVPNEPPINSFDTSSSTNTNYDEASSRANYQEEPPQEIAYRGVRRRPWGKYAAEIRDSTRKHVRVWLGTFDTAEAAALAYDQAAFTIRGSMAVLNFPVQKVYESLQQMGYGFQEGQSPIVAMKKRHSMNRKAESRKRKEKGTRIGMENVVVLEDLGADYLEDLLTISESARPS

SEQ ID NO: 3326 - DNA, 654 bp, Populus balsamifera subsp. trichocarpa; identical to SEQ ID NO: 830
  misc_feature (1)..(654): Ceres ANNOT ID no. 1442758
  misc_feature 369522:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
  misc_feature: Phenotype: ROSETTE LEAVES - Serrate Margins Useful for making plants with increased biomass and foliage

SEQ ID NO: 3327 - protein, 217 aa, Populus balsamifera subsp. trichocarpa; identical to SEQ ID NO: 831
  misc_feature (1)..(217): Ceres ANNOT ID no. 1442758
  misc_feature (81)..(145): Pfam Name: AP2 Pfam Description: AP2 domain
  misc_feature: SWISSPROT Homolog: ERF1B_ARATH Ethylene-responsive transcription factor 1B EREBP-1B (AtERF1) with e-value of 1.6e-50 and BLAST sequence identity of 56.8
  misc_feature: SWISSPROT Homolog: ERF15_ARATH Ethylene-responsive transcription factor 15 EREBP-15 (AtERF15) with e-value of 4.3e-40 and BLAST sequence identity of 58.9
  misc_feature: SWISSPROT Homolog: PTI5_LYCES Pathogenesis-related genes transcriptional activator PTI5 (PTO-interacting protein 5) with e-value of 1.7e-25 and BLAST sequence identity of 50.4
  misc_feature: SWISSPROT Homolog: ERF1A_ARATH Ethylene-responsive transcription factor 1A EREBP-1A (AtERF1) with e-value of 3.3e-25 and BLAST sequence identity of 47.9
  misc_feature: SWISSPROT Homolog: ERF2_ARATH Ethylene-responsive transcription factor 2 EREBP-2 (AtERF2) with e-value of 3.3e-25 and BLAST sequence identity of 49.1
  misc_feature 369636:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
  misc_feature: Phenotype: ROSETTE LEAVES - Serrate Margins Useful for making plants with increased biomass and foliage
  misc_feature (1)..(217): Functional Homolog of  Ceres CLONE ID no. 664365 at SEQ ID NO. 3366 with e-value of 5.49E-49 and BLAST sequence identity of 65.0

SEQ ID NO: 3328 - DNA, 681 bp, Populus balsamifera subsp. trichocarpa; identical to SEQ ID NO: 826
  misc_feature (1)..(681): Ceres ANNOT ID no. 1495675
  misc_feature 369732:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
  misc_feature: Phenotype: ROSETTE LEAVES - Serrate Margins Useful for making plants with increased biomass and foliage

SEQ ID NO: 3329 - protein, 226 aa, Populus balsamifera subsp. trichocarpa; identical to SEQ ID NO: 827
  misc_feature (1)..(226): Ceres ANNOT ID no. 1495675
  misc_feature (90)..(154): Pfam Name: AP2 Pfam Description: AP2 domain
  misc_feature: SWISSPROT Homolog: ERF1B_ARATH Ethylene-responsive transcription factor 1B EREBP-1B (AtERF1) with e-value of 1.6e-50 and BLAST sequence identity of 56.8
  misc_feature: SWISSPROT Homolog: ERF15_ARATH Ethylene-responsive transcription factor 15 EREBP-15 (AtERF15) with e-value of 4.3e-40 and BLAST sequence identity of 58.9
  misc_feature: SWISSPROT Homolog: PTI5_LYCES Pathogenesis-related genes transcriptional activator PTI5 (PTO-interacting protein 5) with e-value of 1.7e-25 and BLAST sequence identity of 50.4
  misc_feature: SWISSPROT Homolog: ERF1A_ARATH Ethylene-responsive transcription factor 1A EREBP-1A (AtERF1) with e-value of 3.3e-25 and BLAST sequence identity of 47.9
  misc_feature: SWISSPROT Homolog: ERF2_ARATH Ethylene-responsive transcription factor 2 EREBP-2 (AtERF2) with e-value of 3.3e-25 and BLAST sequence identity of 49.1
  misc_feature 369848:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
  misc_feature: Phenotype: ROSETTE LEAVES - Serrate Margins Useful for making plants with increased biomass and foliage
  misc_feature (1)..(226): Functional Homolog of  Ceres CLONE ID no. 664365 at SEQ ID NO. 3366 with e-value of 5.49E-49 and BLAST sequence identity of 65.0

SEQ ID NO: 3330 - DNA, 678 bp, Populus balsamifera subsp. trichocarpa; identical to SEQ ID NO: 828
  misc_feature (1)..(678): Ceres ANNOT ID no. 1469576
  misc_feature 369947:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
  misc_feature: Phenotype: ROSETTE LEAVES - Serrate Margins Useful for making plants with increased biomass and foliage

SEQ ID NO: 3331 - protein, 225 aa, Populus balsamifera subsp. trichocarpa; identical to SEQ ID NO: 829
  misc_feature (1)..(225): Ceres ANNOT ID no. 1469576
  misc_feature (90)..(154): Pfam Name: AP2 Pfam Description: AP2 domain
  misc_feature: SWISSPROT Homolog: ERF1B_ARATH Ethylene-responsive transcription factor 1B EREBP-1B (AtERF1) with e-value of 1.6e-50 and BLAST sequence identity of 56.8
  misc_feature: SWISSPROT Homolog: ERF15_ARATH Ethylene-responsive transcription factor 15 EREBP-15 (AtERF15) with e-value of 4.3e-40 and BLAST sequence identity of 58.9
  misc_feature: SWISSPROT Homolog: PTI5_LYCES Pathogenesis-related genes transcriptional activator PTI5 (PTO-interacting protein 5) with e-value of 1.7e-25 and BLAST sequence identity of 50.4
  misc_feature: SWISSPROT Homolog: ERF1A_ARATH Ethylene-responsive transcription factor 1A EREBP-1A (AtERF1) with e-value of 3.3e-25 and BLAST sequence identity of 47.9
  misc_feature: SWISSPROT Homolog: ERF2_ARATH Ethylene-responsive transcription factor 2 EREBP-2 (AtERF2) with e-value of 3.3e-25 and BLAST sequence identity of 49.1
  misc_feature 370063:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
  misc_feature: Phenotype: ROSETTE LEAVES - Serrate Margins Useful for making plants with increased biomass and foliage
  misc_feature (1)..(225): Functional Homolog of  Ceres CLONE ID no. 664365 at SEQ ID NO. 3366 with e-value of 1.89E-48 and BLAST sequence identity of 56.1

SEQ ID NO: 3332 - DNA, 540 bp, Populus balsamifera subsp. trichocarpa
  misc_feature (1)..(540): Ceres ANNOT ID no. 1452666
  misc_feature 370162:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
  misc_feature: Phenotype: ROSETTE LEAVES - Serrate Margins Useful for making plants with increased biomass and foliage
atggtcctttttaatgctttagccaatggaccgcccaaggaatcctcagaatctaattcttcaagtggaattaaggaagaggaagtgacttcaaatgcgaaagaagaggaggaggctaagagagagaaatcttacagaggggttagaaggcggccatgggggaagtatgctgcagagataagggattctacaaggaatggcatcagggtttggctagggacctttgatagtgcagaggcagctgctttggcatatgatcaagcagcattttccatgcggggttcgatggctgttctcaattttcctgtggagatggtgagagagtcacttcaagacatgaattatagatgtgaagatgggtgttcgcctgtggtggcactgaagaggaaacactctatgagaagaaaatcaaagagttggaaaactaaagtaaatcaagtacctcatagtaggccacaaaatgtggtggttttggaggatttgggagctgactacctggaagagcttctgaattcatgtgacacttctaattcttggtga

SEQ ID NO: 3333 - protein, 179 aa, Populus balsamifera subsp. trichocarpa
  misc_feature (1)..(179): Ceres ANNOT ID no. 1452666
  misc_feature (43)..(107): Pfam Name: AP2 Pfam Description: AP2 domain
  misc_feature: SWISSPROT Homolog: ERF1B_ARATH Ethylene-responsive transcription factor 1B EREBP-1B (AtERF1) with e-value of 1.6e-50 and BLAST sequence identity of 56.8
  misc_feature: SWISSPROT Homolog: ERF15_ARATH Ethylene-responsive transcription factor 15 EREBP-15 (AtERF15) with e-value of 4.3e-40 and BLAST sequence identity of 58.9
  misc_feature: SWISSPROT Homolog: PTI5_LYCES Pathogenesis-related genes transcriptional activator PTI5 (PTO-interacting protein 5) with e-value of 1.7e-25 and BLAST sequence identity of 50.4
  misc_feature: SWISSPROT Homolog: ERF1A_ARATH Ethylene-responsive transcription factor 1A EREBP-1A (AtERF1) with e-value of 3.3e-25 and BLAST sequence identity of 47.9
  misc_feature: SWISSPROT Homolog: ERF2_ARATH Ethylene-responsive transcription factor 2 EREBP-2 (AtERF2) with e-value of 3.3e-25 and BLAST sequence identity of 49.1
  misc_feature 370274:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
  misc_feature: Phenotype: ROSETTE LEAVES - Serrate Margins Useful for making plants with increased biomass and foliage
  misc_feature (1)..(179): Functional Homolog of  Ceres CLONE ID no. 664365 at SEQ ID NO. 3366 with e-value of 5.00E-48 and BLAST sequence identity of 70.3
MVLFNALANGPPKESSESNSSSGIKEEEVTSNAKEEEEAKREKSYRGVRRRPWGKYAAEIRDSTRNGIRVWLGTFDSAEAAALAYDQAAFSMRGSMAVLNFPVEMVRESLQDMNYRCEDGCSPVVALKRKHSMRRKSKSWKTKVNQVPHSRPQNVVVLEDLGADYLEELLNSCDTSNSW

SEQ ID NO: 3334 - DNA, 726 bp, Populus balsamifera subsp. trichocarpa
  misc_feature (1)..(726): Ceres ANNOT ID no. 1452668
  misc_feature 370364:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
  misc_feature: Phenotype: ROSETTE LEAVES - Serrate Margins Useful for making plants with increased biomass and foliage
atggatcattctttcttcaaccacccaaatctagaattctcgccatcatctccctccagctctctagatctattgcaggatgaccttctttttaaccctcatgataatttctatctattcaattcaaatgactctgaagagacacttccatctgatgttcctttcaccgaagccaaagaatctgctactagtgttacctccgatgttccaccaaataacaaagccaaagacttgtcggaacttatttcctcgaatgagatcaaggaaaaggaagccgctccgaatgctacagaagaaaatcccggaagggaaaagacctatagaggggtccgaaagcggccgtggggaaaatacgcggcggaaataagagattccactagaaatggagtgcgagtttggctaggcacatttgatactggtgaaacagctgctttagcttatgaccaagctgcattatccttgcatggctctaaggctgtcctcaattttccgattgagaaagtgagaaaatcattaagagaaatgaaaagtggtttagaagatcagtactggtgctccccagccgaggcactgaagaagactcattccaaaagaagggcagtgagtagggaagggaaggggaaagggaacgggttagcaaccaaagaagtggtggtgttcgaggatctaggagctgaatatttggaagaacttttaagctcttgtgagagaggtactcctcaatga

SEQ ID NO: 3335 - protein, 241 aa, Populus balsamifera subsp. trichocarpa
  misc_feature (1)..(241): Ceres ANNOT ID no. 1452668
  misc_feature (105)..(169): Pfam Name: AP2 Pfam Description: AP2 domain
  misc_feature: SWISSPROT Homolog: ERF1B_ARATH Ethylene-responsive transcription factor 1B EREBP-1B (AtERF1) with e-value of 1.6e-50 and BLAST sequence identity of 56.8
  misc_feature: SWISSPROT Homolog: ERF15_ARATH Ethylene-responsive transcription factor 15 EREBP-15 (AtERF15) with e-value of 4.3e-40 and BLAST sequence identity of 58.9
  misc_feature: SWISSPROT Homolog: PTI5_LYCES Pathogenesis-related genes transcriptional activator PTI5 (PTO-interacting protein 5) with e-value of 1.7e-25 and BLAST sequence identity of 50.4
  misc_feature: SWISSPROT Homolog: ERF1A_ARATH Ethylene-responsive transcription factor 1A EREBP-1A (AtERF1) with e-value of 3.3e-25 and BLAST sequence identity of 47.9
  misc_feature: SWISSPROT Homolog: ERF2_ARATH Ethylene-responsive transcription factor 2 EREBP-2 (AtERF2) with e-value of 3.3e-25 and BLAST sequence identity of 49.1
  misc_feature 370482:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
  misc_feature: Phenotype: ROSETTE LEAVES - Serrate Margins Useful for making plants with increased biomass and foliage
  misc_feature (1)..(241): Functional Homolog of  Ceres CLONE ID no. 664365 at SEQ ID NO. 3366 with e-value of 2.19E-36 and BLAST sequence identity of 58.6
MDHSFFNHPNLEFSPSSPSSSLDLLQDDLLFNPHDNFYLFNSNDSEETLPSDVPFTEAKESATSVTSDVPPNNKAKDLSELISSNEIKEKEAAPNATEENPGREKTYRGVRKRPWGKYAAEIRDSTRNGVRVWLGTFDTGETAALAYDQAALSLHGSKAVLNFPIEKVRKSLREMKSGLEDQYWCSPAEALKKTHSKRRAVSREGKGKGNGLATKEVVVFEDLGAEYLEELLSSCERGTPQ

SEQ ID NO: 3336 - DNA, 720 bp, Populus balsamifera subsp. trichocarpa
  misc_feature (1)..(720): Ceres ANNOT ID no. 1442757
  misc_feature 370584:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
  misc_feature: Phenotype: ROSETTE LEAVES - Serrate Margins Useful for making plants with increased biomass and foliage
atggatcattctttcttcaacaatccaaatcaagaattctcaacatcacctcccttcggccttctggatccatcgtgggataagcttccttttaaccttcatggtttctctccattcaactcaaatgactctgaagggagtcaagagactcttccatctgacgttccactcaccgaagccaaagcatctactcatagtattgcttcggatgttccaccaaacatagccaaaaataatttaccgcaacttagttcctcgaaagagatcgaggaacaggaagccactccaaaagctaaaaaaaacattccgacaaggaaaaagacttaccgaggggtccgaaatcggccctggggaacatatgcggcagaaataagagattccactaggaacggagtgcgagtttggcttggcacatttgagactggtgaagcagctgctctagcttatgaccaagcagcattatcattacagggctctaaggctgtcctcaattttccgattgagcaagtgagaaaatcactcgaagagttaaagtgcggtttcacagactggtgctcgccagctgaggcactgaagaagactcattccaaaagaaagccagtgagtggtaaaaggaaagggaaagggttagcaacaaaagaagtgttggtgttggaggatctaggagctgattatttggaaacacttttaagctcttgtgagagaggtattcccaagtga

SEQ ID NO: 3337 - protein, 239 aa, Populus balsamifera subsp. trichocarpa
  misc_feature (1)..(239): Ceres ANNOT ID no. 1442757
  misc_feature (107)..(171): Pfam Name: AP2 Pfam Description: AP2 domain
  misc_feature: SWISSPROT Homolog: ERF1B_ARATH Ethylene-responsive transcription factor 1B EREBP-1B (AtERF1) with e-value of 1.6e-50 and BLAST sequence identity of 56.8
  misc_feature: SWISSPROT Homolog: ERF15_ARATH Ethylene-responsive transcription factor 15 EREBP-15 (AtERF15) with e-value of 4.3e-40 and BLAST sequence identity of 58.9
  misc_feature: SWISSPROT Homolog: PTI5_LYCES Pathogenesis-related genes transcriptional activator PTI5 (PTO-interacting protein 5) with e-value of 1.7e-25 and BLAST sequence identity of 50.4
  misc_feature: SWISSPROT Homolog: ERF1A_ARATH Ethylene-responsive transcription factor 1A EREBP-1A (AtERF1) with e-value of 3.3e-25 and BLAST sequence identity of 47.9
  misc_feature: SWISSPROT Homolog: ERF2_ARATH Ethylene-responsive transcription factor 2 EREBP-2 (AtERF2) with e-value of 3.3e-25 and BLAST sequence identity of 49.1
  misc_feature 370702:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
  misc_feature: Phenotype: ROSETTE LEAVES - Serrate Margins Useful for making plants with increased biomass and foliage
  misc_feature (1)..(239): Functional Homolog of  Ceres CLONE ID no. 664365 at SEQ ID NO. 3366 with e-value of 7.59E-36 and BLAST sequence identity of 57.0
MDHSFFNNPNQEFSTSPPFGLLDPSWDKLPFNLHGFSPFNSNDSEGSQETLPSDVPLTEAKASTHSIASDVPPNIAKNNLPQLSSSKEIEEQEATPKAKKNIPTRKKTYRGVRNRPWGTYAAEIRDSTRNGVRVWLGTFETGEAAALAYDQAALSLQGSKAVLNFPIEQVRKSLEELKCGFTDWCSPAEALKKTHSKRKPVSGKRKGKGLATKEVLVLEDLGADYLETLLSSCERGIPK

SEQ ID NO: 3338 - protein, 349 aa, Glycine max
  misc_feature (1)..(349): Ceres CLONE ID no. 674157
  misc_feature (1)..(349): Also Known As Ceres CDNA ID no. 23704869
  misc_feature (1)..(349): Also Known As Ceres GEMINI ID 555C4
  misc_feature (148)..(202): Pfam Name: bZIP_2 Pfam Description: Basic region leucine zipper
  misc_feature 370821:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (41)..(41): Xaa is any aa, unknown, or other
MISPNPPLRLRHTAAFCPVTLVPWPLTPRNTRPFSRASSTXACAAVAMTRGSLAKSQDPSPFSDGGSQPTNPSLVGSQTTSKGSIPSGNDQSKLQDKDINAPVGIPSIPAIQKKPAVAIRPSTSGSSREQSDDEDIEGETSMNDNTDPADVKRVRRMLSNRESARRSRRRKQAHLTDLETQVSQLRGENSTLLKRLTDVSQKYSDSAVDNRVLKADVETLRAKVKMAEETVKRITGLNPMPHAMSDISSLGLPSFDGRSPSDTSADASVPVQDDPHHHFYQPTLNNPIPSHDPIVNNGLGGISSIENVQQQNAAAVVGGNKIGQTASLQRVASLEHLQKRIRGGPPSEQ

SEQ ID NO: 3339 - DNA, 1302 bp, Populus balsamifera subsp. trichocarpa
  misc_feature (1)..(1302): Ceres ANNOT ID no. 1469521
  misc_feature 370917:<222: Transcription Factor
  misc_feature: Phenotype: Activates expression of the gene endogenous to the AtHMGS (SEQ ID NO 4144) regalutory region Useful for modulating Terpenoid Biosynthesis
atggagagggtattttcagtggaggataacattactgagcttttttggtcaccaccaccaccaccacctgaagacttgtccaaaatgaaccggtctgagtctgaatgggctttcgaaagattccttcaagaagcctctgctgtaacccttgatgacaacacttcttctaattcttctgctgataaaactgacgttgttcaaatcaaagatcatggtaatagtaataacaacgctacaagtaagtgttcctttagtaatgggacctgtgccactgctgcttcctcctttgctgctccggcgattattccggtggaatctgacgattatcatgcgtttttgaagagtaaactcaatttggcttgtgctgctgttgctttgactcgggcatcttttgtaaagcctctagattctcctgccgcagctgaaagtggatcacaggcttcaaatacttcacaattgggatcacatgctccttctaaaggagctggatatgatttaccgatatcccaagataaagatgctaatgagcctcttggaactccctccttaccttccatgcaaaggaaatctgcagttactgtgaagccaacaactagtgtatcatccagagaactgtcagaggatgatgaaaatgaagcagaaactgaattaactgaaaatatgcaacctgctgatgcaaagcgtgtaaggagaatgctttcaaatagagagtcagctcggcgatcaagaagtagaaagcaggcccatttgactgagcttgagacacaggttgctcaattgagggttgaaaattcatctctactgaagagcctcactgacataagtcagaagtacaatgagtcagctgttgacaacagagttttaaaagctgatgttgaaacactgagagcgaaggtgaagatggctgaagagacagtcaaaagatttactgggttgaacactatgttccatgccttgcctgatatatccacaatgagtatgtcatcatttgatggaagcccctctgacactgcagatgctgctgttcctgtaaaggatgacccaaagcatcacttttataaagctccaaacaatcctataacaactcatgactccaggcccagaggcaataatgtgttggcagatatatcttcagttgaaaatgtgcagccaaatcctgtaccagcagcaggagtatcagggaacaagatggggcgaacaccttccttgcagcgagtagctagcttggagcatttgcagaaacggattcgtgggggtgcaagtccttgcgggccccagtccaatggggagcaggcaaaatga

SEQ ID NO: 3340 - protein, 405 aa, Populus balsamifera subsp. trichocarpa
  misc_feature (1)..(405): Ceres ANNOT ID no. 1469521
  misc_feature (195)..(252): Pfam Name: bZIP_2 Pfam Description: Basic region leucine zipper
  misc_feature: SWISSPROT Homolog: CPRF2_PETCR Light-inducible protein CPRF-2 with e-value of 5.4e-91 and BLAST sequence identity of 58.2
  misc_feature: SWISSPROT Homolog: OP2_MAIZE Regulatory protein opaque-2 with e-value of 1.1e-30 and BLAST sequence identity of 35.5
  misc_feature: SWISSPROT Homolog: OCS1_MAIZE Ocs element-binding factor 1 (OCSBF-1) with e-value of 1.1e-12 and BLAST sequence identity of 37.8
  misc_feature: SWISSPROT Homolog: HY5_ARATH Transcription factor HY5 (Protein LONG HYPOCOL5) (AtbZIP56) with e-value of 4.0e-10 and BLAST sequence identity of 32.1
  misc_feature: SWISSPROT Homolog: HBP1A_WHEAT Transcription factor HBP-1a (Histone-specific transcription factor HBP1) with e-value of 2.0e-08 and BLAST sequence identity of 29.3
  misc_feature 371030:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(405): Functional Homolog of  Ceres CLONE ID no. 674157 at SEQ ID NO. 3385 with e-value of 3.89E-96 and BLAST sequence identity of 64.6
MNRSESEWAFERFLQEASAVTLDDNTSSNSSADKTDVVQIKDHGNSNNNATSKCSFSNGTCATAASSFAAPAIIPVESDDYHAFLKSKLNLACAAVALTRASFVKPLDSPAAAESGSQASNTSQLGSHAPSKGAGYDLPISQDKDANEPLGTPSLPSMQRKSAVTVKPTTSVSSRELSEDDENEAETELTENMQPADAKRVRRMLSNRESARRSRSRKQAHLTELETQVAQLRVENSSLLKSLTDISQKYNESAVDNRVLKADVETLRAKVKMAEETVKRFTGLNTMFHALPDISTMSMSSFDGSPSDTADAAVPVKDDPKHHFYKAPNNPITTHDSRPRGNNVLADISSVENVQPNPVPAAGVSGNKMGRTPSLQRVASLEHLQKRIRGGASPCGPQSNGEQAK

SEQ ID NO: 3341 - DNA, 1305 bp, Populus balsamifera subsp. trichocarpa
  misc_feature (1)..(1305): Ceres ANNOT ID no. 1488782
  misc_feature 371141:<222: Transcription Factor
  misc_feature: Phenotype: Activates expression of the gene endogenous to the AtHMGS (SEQ ID NO 4144) regalutory region Useful for modulating Terpenoid Biosynthesis
atgtcacacagaccaatcctggtgtctagcacaggccacaaacaccaattgtccaaaatgaaccggtctgaatctgaatgggcttttcaaagatttcttcaagaagcctctgctgcaacctttgatgacaacactcccaattcttcagctgataaaactgacgttgttcatatcaatgattatggatataataataacaacgctacaagtaagagttgtgataataattataaagataatgccatgcccttgagtaatggggcctgtgccactgctgcttcatcgtcgcttggagctccggcggatattcctgtggaatctgaggattatcatgcgtttttgaagagtaaactcaatatggcttgtgctgctgttgctttgtctcgggcatattttgtaaaacctctaaaatctcctgctacagctgaaagtggatcacaggcttcaagtacttcacatttgggatcccatgctccttctaaaggagctgggcatgatttatctaggtcccgagataaagatgctaatgagccacttggaactccctccttgccttccatgcaaaagaaacttgcagtttctggtaagccaacaacaagtggatcatccagagaactgtcggaagatgatgaaaatgaagcagaaactgaaataactgagaatatgcaccctgctgatgcaaaacgtgtaaggagaatgctttcgaatagagagtcagctagacgatcaagaagaagaaagcaggcccatttgactgagcttgagacccaggttgctcaattgagggttgaaaactcttctctgctgaagcggctcgccgacacaagtcagaagtacaatgagtctgctgttgacaacagagttttaaaagctgacattgaaacgctgagagcaaaggtgaggatggctgaagagacggtcaaaagatttactgggttgaaccatatgttccatgccatgccttatatatccgcaatgagtatgccatcgtttgatggatgcccctctgacacatcagcagatgctgctgtccctgtcaaggatgatccaaagcatcacttctatcaggctcctaacaatcctatatcaactcatgactccaggcccagagtcaactttgtgttggccgatatatcttcagttgaaaatgtgcagccaaattctggaacagcggcaggagtatcagggaacaagttggggcgaacagcttctttgcagcgagtggctagcttggagcgtttgcagaaacggattcgtggggttgcaagtccttgtggacctcagtccaatggggagcagtcgtaa

SEQ ID NO: 3342 - protein, 353 aa, Populus balsamifera subsp. trichocarpa
  misc_feature (1)..(353): Ceres ANNOT ID no. 1488782
  misc_feature (143)..(197): Pfam Name: bZIP_2 Pfam Description: Basic region leucine zipper
  misc_feature: SWISSPROT Homolog: CPRF2_PETCR Light-inducible protein CPRF-2 with e-value of 5.4e-91 and BLAST sequence identity of 58.2
  misc_feature: SWISSPROT Homolog: OP2_MAIZE Regulatory protein opaque-2 with e-value of 1.1e-30 and BLAST sequence identity of 35.5
  misc_feature: SWISSPROT Homolog: OCS1_MAIZE Ocs element-binding factor 1 (OCSBF-1) with e-value of 1.1e-12 and BLAST sequence identity of 37.8
  misc_feature: SWISSPROT Homolog: HY5_ARATH Transcription factor HY5 (Protein LONG HYPOCOL5) (AtbZIP56) with e-value of 4.0e-10 and BLAST sequence identity of 32.1
  misc_feature: SWISSPROT Homolog: HBP1A_WHEAT Transcription factor HBP-1a (Histone-specific transcription factor HBP1) with e-value of 2.0e-08 and BLAST sequence identity of 29.3
  misc_feature 371254:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(353): Functional Homolog of  Ceres CLONE ID no. 674157 at SEQ ID NO. 3385 with e-value of 1.00E-95 and BLAST sequence identity of 64.0
MPLSNGACATAASSSLGAPADIPVESEDYHAFLKSKLNMACAAVALSRAYFVKPLKSPATAESGSQASSTSHLGSHAPSKGAGHDLSRSRDKDANEPLGTPSLPSMQKKLAVSGKPTTSGSSRELSEDDENEAETEITENMHPADAKRVRRMLSNRESARRSRRRKQAHLTELETQVAQLRVENSSLLKRLADTSQKYNESAVDNRVLKADIETLRAKVRMAEETVKRFTGLNHMFHAMPYISAMSMPSFDGCPSDTSADAAVPVKDDPKHHFYQAPNNPISTHDSRPRVNFVLADISSVENVQPNSGTAAGVSGNKLGRTASLQRVASLERLQKRIRGVASPCGPQSNGEQS

SEQ ID NO: 3343 - DNA, 1074 bp, Populus balsamifera subsp. trichocarpa
  misc_feature (1)..(1074): Ceres ANNOT ID no. 1542209
  misc_feature 371356:<222: Transcription Factor
  misc_feature: Phenotype: Activates expression of the gene endogenous to the AtHMGS (SEQ ID NO 4144) regalutory region Useful for modulating Terpenoid Biosynthesis
atgtcacacagaccaatcctggtgtctagcacaggccacaaacaccaattgtccaaaatgaaccggtctgaatctgaatgggcttttcaaagatttcttcaagaagcctctgctagtaaactcaatatggcttgtgctgctgttgctttgtctcgggcatattttgtaaaacctctaaaatctcctgctacagctgaaagtggatcacaggcttcaagtacttcacatttgggatcccatgctccttctaaaggagctgggcatgatttatctaggtcccgagataaagatgctaatgagccacttggaactccctccttgccttccatgcaaaagaaacttgcagtttctggtaagccaacaacaagtggatcatccagagaactgtcggaagatgatgaaaatgaagcagaaactgaaataactgagaatatgcaccctgctgatgcaaaacgtgtaaggagaatgctttcgaatagagagtcagctagacgatcaagaagaagaaagcaggcccatttgactgagcttgagacccaggttgctcaattgagggttgaaaactcttctctgctgaagcggctcgccgacacaagtcagaagtacaatgagtctgctgttgacaacagagttttaaaagctgacattgaaacgctgagagcaaaggtgaggatggctgaagagacggtcaaaagatttactgggttgaaccatatgttccatgccatgccttatatatccgcaatgagtatgccatcgtttgatggatgcccctctgacacatcagcagatgctgctgtccctgtcaaggatgatccaaagcatcacttctatcaggctcctaacaatcctatatcaactcatgactccaggcccagagtcaactttgtgttggccgatatatcttcagttgaaaatgtgcagccaaattctggaacagcggcaggagtatcagggaacaagttggggcgaacagcttctttgcagcgagtggctagcttggagcgtttgcagaaacggattcgtggggttgcaagtccttgtggacctcagtccaatggggagcagtcgtaa

SEQ ID NO: 3344 - protein, 338 aa, Populus balsamifera subsp. trichocarpa
  misc_feature (1)..(338): Ceres ANNOT ID no. 1542209
  misc_feature (128)..(182): Pfam Name: bZIP_2 Pfam Description: Basic region leucine zipper
  misc_feature: SWISSPROT Homolog: CPRF2_PETCR Light-inducible protein CPRF-2 with e-value of 5.4e-91 and BLAST sequence identity of 58.2
  misc_feature: SWISSPROT Homolog: OP2_MAIZE Regulatory protein opaque-2 with e-value of 1.1e-30 and BLAST sequence identity of 35.5
  misc_feature: SWISSPROT Homolog: OCS1_MAIZE Ocs element-binding factor 1 (OCSBF-1) with e-value of 1.1e-12 and BLAST sequence identity of 37.8
  misc_feature: SWISSPROT Homolog: HY5_ARATH Transcription factor HY5 (Protein LONG HYPOCOL5) (AtbZIP56) with e-value of 4.0e-10 and BLAST sequence identity of 32.1
  misc_feature: SWISSPROT Homolog: HBP1A_WHEAT Transcription factor HBP-1a (Histone-specific transcription factor HBP1) with e-value of 2.0e-08 and BLAST sequence identity of 29.3
  misc_feature 371461:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(338): Functional Homolog of  Ceres CLONE ID no. 674157 at SEQ ID NO. 3385 with e-value of 5.60E-95 and BLAST sequence identity of 65.7
MNRSESEWAFQRFLQEASASKLNMACAAVALSRAYFVKPLKSPATAESGSQASSTSHLGSHAPSKGAGHDLSRSRDKDANEPLGTPSLPSMQKKLAVSGKPTTSGSSRELSEDDENEAETEITENMHPADAKRVRRMLSNRESARRSRRRKQAHLTELETQVAQLRVENSSLLKRLADTSQKYNESAVDNRVLKADIETLRAKVRMAEETVKRFTGLNHMFHAMPYISAMSMPSFDGCPSDTSADAAVPVKDDPKHHFYQAPNNPISTHDSRPRVNFVLADISSVENVQPNSGTAAGVSGNKLGRTASLQRVASLERLQKRIRGVASPCGPQSNGEQS

SEQ ID NO: 3345 - protein, 184 aa, Glycine max
  misc_feature (1)..(184): Ceres CLONE ID no. 681088
  misc_feature (25)..(88): Pfam Name: AP2 Pfam Description: AP2 domain
  misc_feature: Phenotype: ROSETTE LEAVES - Curled 1 Useful for making ornamental plants with altered leaf shape
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
MDHQPPPCPAAASATDNPRGGTRHPMYRGVRKRRWGKWVSEIREPRKKNRIWLGSFPVPEMAARAYDVAAYCLKGRKAQLNFPDDVDSLPLPSSRTARDIQTAAAQAARMMKASGNDEKSGIASDDGDSGCDDFWGEIELPELMDGECYWGCPAGASSWTSSGDLAEWPEEELSPQQPSFMACL

SEQ ID NO: 3346 - DNA, 597 bp, Populus balsamifera subsp. trichocarpa
  misc_feature (1)..(597): Ceres ANNOT ID no. 1471330
  misc_feature 371638:<222: Transcription Factor
  misc_feature: Phenotype: ROSETTE LEAVES - Curled 1 Useful for making ornamental plants with altered leaf shape
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
atggagcaaccaccatacactgaagatgacccgaccacaaactctccagaggcagccaccgccaaaacccaccaaaattctgagactccacggggcagcggcactcgaaatcctgtctatcgcggtgtccgaaaacggaggtgggggaaatgggtgtctgaaattagagagccacgcaagaaatcacgtatctggctaggctcatttcctgtgccagaaatggcagccaaggcatatgatgtggcagcgtattgtcttaaaggttgtaaagcgcagcttaattttcccgacgaagtggatgacttgcctagaccgtccacgtgtacggccagggacatccaagcagcagcagcaaaggcagcacattcagtgctgcttccaacgaaaaagagcatcgaaacaaatagtgataatagtgttgacggagaagttgccgatgatgatttctggggcgagatagaattgccggaattgttgacgagtaacagtgggtgctgttggaattcttgtggatggagtactacttttgcaagtgatagttcaacgtggcagcaggatggagagggtctaccacagttcatggcatgtctttattag

SEQ ID NO: 3347 - protein, 198 aa, Populus balsamifera subsp. trichocarpa
  misc_feature (1)..(198): Ceres ANNOT ID no. 1471330
  misc_feature (38)..(101): Pfam Name: AP2 Pfam Description: AP2 domain
  misc_feature: SWISSPROT Homolog: TINY_ARATH Transcriptional factor TINY with e-value of 4.0e-31 and BLAST sequence identity of 49.7
  misc_feature: SWISSPROT Homolog: DRE1B_ARATH Dehydration-responsive element-binding protein 1B with e-value of 1.1e-26 and BLAST sequence identity of 56.0
  misc_feature: SWISSPROT Homolog: DRE1B_ARATH DREB1B protein (C-repeat-binding factor 1) C-repeat/dehydration-responsive element-binding factor 1 (CRT/DRE-binding factor 1)
  misc_feature: SWISSPROT Homolog: DRE1A_ARATH Dehydration-responsive element-binding protein 1A with e-value of 6.3e-26 and BLAST sequence identity of 52.5
  misc_feature: SWISSPROT Homolog: DRE1A_ARATH DREB1A protein (C-repeat-binding factor 3) C-repeat/dehydration-responsive element-binding factor 3) (CRT/DRE-binding factor 3)
  misc_feature: SWISSPROT Homolog: DRE1D_ARATH Dehydration-responsive element-binding protein 1D with e-value of 8.0e-26 and BLAST sequence identity of 47.8
  misc_feature: SWISSPROT Homolog: DRE1D_ARATH DREB1D protein (C-repeat-binding factor 4) C-repeat/dehydration-responsive element-binding factor 4) (CRT/DRE-binding factor 4)
  misc_feature: SWISSPROT Homolog: DRE1C_ARATH Dehydration-responsive element-binding protein 1C with e-value of 4.4e-25 and BLAST sequence identity of 57.4
  misc_feature: SWISSPROT Homolog: DRE1C_ARATH DREB1C protein (C-repeat-binding factor 2) (C-repeat/dehydration-responsive element-binding factor 2) (CRT/DRE-binding factor 2)
  misc_feature 371774:<222: Transcription Factor
  misc_feature: Phenotype: ROSETTE LEAVES - Curled 1 Useful for making ornamental plants with altered leaf shape
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature (1)..(198): Functional Homolog of  Ceres CLONE ID no. 681088 at SEQ ID NO. 3392 with e-value of 4.20E-51 and BLAST sequence identity of 64.5
MEQPPYTEDDPTTNSPEAATAKTHQNSETPRGSGTRNPVYRGVRKRRWGKWVSEIREPRKKSRIWLGSFPVPEMAAKAYDVAAYCLKGCKAQLNFPDEVDDLPRPSTCTARDIQAAAAKAAHSVLLPTKKSIETNSDNSVDGEVADDDFWGEIELPELLTSNSGCCWNSCGWSTTFASDSSTWQQDGEGLPQFMACLY

SEQ ID NO: 3348 - DNA, 534 bp, Populus balsamifera subsp. trichocarpa
  misc_feature (1)..(534): Ceres ANNOT ID no. 1444437
  misc_feature 371860:<222: Transcription Factor
  misc_feature: Phenotype: ROSETTE LEAVES - Curled 1 Useful for making ornamental plants with altered leaf shape
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
atgacccgactacaaattcccgatactacccggggaagcggcacccgacaccccgcctaccgcggtgtccgaaaacggaggtggggaaaatgggtgtctgaaattagagagccacgcaagaaatcacgcatttggctaggctcatttcctgtgccagaaatggcagccaaggcatatgatgtggcagcgtattgtcttaaaggtcgcaaagcgcagctcaattttccagaagaagccgatgacttgcctataccgtccacgtgtacggccagggatattcaagcagcagcagcaaaggctgcacattcggtactgattccaatgaaaaagagcagcgaaactaacaatgatggtggcggtgacggtgaagttgctggtgatgatttctggggcgagattgaattgccggaattgctgctgagtaatagcgggtacagttgggattcttgtggatggaatactactcttgcaagtgataattcaacgtggcagccggatggagagggtctacagccatccatggcatgtctttaa

SEQ ID NO: 3349 - protein, 177 aa, Populus balsamifera subsp. trichocarpa
  misc_feature (1)..(177): Ceres ANNOT ID no. 1444437
  misc_feature (18)..(81): Pfam Name: AP2 Pfam Description: AP2 domain
  misc_feature: SWISSPROT Homolog: TINY_ARATH Transcriptional factor TINY with e-value of 4.0e-31 and BLAST sequence identity of 49.7
  misc_feature: SWISSPROT Homolog: DRE1B_ARATH Dehydration-responsive element-binding protein 1B with e-value of 1.1e-26 and BLAST sequence identity of 56.0
  misc_feature: SWISSPROT Homolog: DRE1B_ARATH DREB1B protein (C-repeat-binding factor 1) C-repeat/dehydration-responsive element-binding factor 1 (CRT/DRE-binding factor 1)
  misc_feature: SWISSPROT Homolog: DRE1A_ARATH Dehydration-responsive element-binding protein 1A with e-value of 6.3e-26 and BLAST sequence identity of 52.5
  misc_feature: SWISSPROT Homolog: DRE1A_ARATH DREB1A protein (C-repeat-binding factor 3) C-repeat/dehydration-responsive element-binding factor 3) (CRT/DRE-binding factor 3)
  misc_feature: SWISSPROT Homolog: DRE1D_ARATH Dehydration-responsive element-binding protein 1D with e-value of 8.0e-26 and BLAST sequence identity of 47.8
  misc_feature: SWISSPROT Homolog: DRE1D_ARATH DREB1D protein (C-repeat-binding factor 4) C-repeat/dehydration-responsive element-binding factor 4) (CRT/DRE-binding factor 4)
  misc_feature: SWISSPROT Homolog: DRE1C_ARATH Dehydration-responsive element-binding protein 1C with e-value of 4.4e-25 and BLAST sequence identity of 57.4
  misc_feature: SWISSPROT Homolog: DRE1C_ARATH DREB1C protein (C-repeat-binding factor 2) (C-repeat/dehydration-responsive element-binding factor 2) (CRT/DRE-binding factor 2)
  misc_feature 371994:<222: Transcription Factor
  misc_feature: Phenotype: ROSETTE LEAVES - Curled 1 Useful for making ornamental plants with altered leaf shape
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature (1)..(177): Functional Homolog of  Ceres CLONE ID no. 681088 at SEQ ID NO. 3392 with e-value of 1.29E-49 and BLAST sequence identity of 66.4
MTRLQIPDTTRGSGTRHPAYRGVRKRRWGKWVSEIREPRKKSRIWLGSFPVPEMAAKAYDVAAYCLKGRKAQLNFPEEADDLPIPSTCTARDIQAAAAKAAHSVLIPMKKSSETNNDGGGDGEVAGDDFWGEIELPELLLSNSGYSWDSCGWNTTLASDNSTWQPDGEGLQPSMACL

SEQ ID NO: 3350 - DNA, 534 bp, Populus balsamifera subsp. trichocarpa
  misc_feature (1)..(534): Ceres ANNOT ID no. 1444439
  misc_feature 372077:<222: Transcription Factor
  misc_feature: Phenotype: ROSETTE LEAVES - Curled 1 Useful for making ornamental plants with altered leaf shape
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
atgacccgactacaaattcccgatactacccggggaagcggcaaccgacaccccgcctaccgcggtgtccgaaaacggaggtggggaaaatgggtgtctgaaattagagagccacgcaagaaatcacgcatttggctaggctcatttcctgtgccagaaatggcagccaaggcatacgatgtggcagcgtattgtcttaaaggtcgcaaagcgcagctcaattttcctgaagaagtcgatgacttgcctataccgtccacgtgtacggccagggctattcaagcagcagcagcaaaggctgcacattcggtactgattccaatgaaaaagagcagcgaaacaaacaatggtggtggcagtgacggtgaagttgctggtgatgatttctggggcgagattgaattgccggagttgctgctgagtaatagcgggtacagttgggattcttgtggatggaatactactcttgcaagtgataattcaacgtggcagccggatggagagggtctacagccatccatggcatgtctttaa

SEQ ID NO: 3351 - protein, 177 aa, Populus balsamifera subsp. trichocarpa
  misc_feature (1)..(177): Ceres ANNOT ID no. 1444439
  misc_feature (18)..(81): Pfam Name: AP2 Pfam Description: AP2 domain
  misc_feature: SWISSPROT Homolog: TINY_ARATH Transcriptional factor TINY with e-value of 4.0e-31 and BLAST sequence identity of 49.7
  misc_feature: SWISSPROT Homolog: DRE1B_ARATH Dehydration-responsive element-binding protein 1B with e-value of 1.1e-26 and BLAST sequence identity of 56.0
  misc_feature: SWISSPROT Homolog: DRE1B_ARATH DREB1B protein (C-repeat-binding factor 1) C-repeat/dehydration-responsive element-binding factor 1 (CRT/DRE-binding factor 1)
  misc_feature: SWISSPROT Homolog: DRE1A_ARATH Dehydration-responsive element-binding protein 1A with e-value of 6.3e-26 and BLAST sequence identity of 52.5
  misc_feature: SWISSPROT Homolog: DRE1A_ARATH DREB1A protein (C-repeat-binding factor 3) C-repeat/dehydration-responsive element-binding factor 3) (CRT/DRE-binding factor 3)
  misc_feature: SWISSPROT Homolog: DRE1D_ARATH Dehydration-responsive element-binding protein 1D with e-value of 8.0e-26 and BLAST sequence identity of 47.8
  misc_feature: SWISSPROT Homolog: DRE1D_ARATH DREB1D protein (C-repeat-binding factor 4) C-repeat/dehydration-responsive element-binding factor 4) (CRT/DRE-binding factor 4)
  misc_feature: SWISSPROT Homolog: DRE1C_ARATH Dehydration-responsive element-binding protein 1C with e-value of 4.4e-25 and BLAST sequence identity of 57.4
  misc_feature: SWISSPROT Homolog: DRE1C_ARATH DREB1C protein (C-repeat-binding factor 2) (C-repeat/dehydration-responsive element-binding factor 2) (CRT/DRE-binding factor 2)
  misc_feature 372211:<222: Transcription Factor
  misc_feature: Phenotype: ROSETTE LEAVES - Curled 1 Useful for making ornamental plants with altered leaf shape
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature (1)..(177): Functional Homolog of  Ceres CLONE ID no. 681088 at SEQ ID NO. 3392 with e-value of 9.00E-49 and BLAST sequence identity of 65.8
MTRLQIPDTTRGSGNRHPAYRGVRKRRWGKWVSEIREPRKKSRIWLGSFPVPEMAAKAYDVAAYCLKGRKAQLNFPEEVDDLPIPSTCTARAIQAAAAKAAHSVLIPMKKSSETNNGGGSDGEVAGDDFWGEIELPELLLSNSGYSWDSCGWNTTLASDNSTWQPDGEGLQPSMACL

SEQ ID NO: 3352 - DNA, 567 bp, Populus balsamifera subsp. trichocarpa
  misc_feature (1)..(567): Ceres ANNOT ID no. 1486891
  misc_feature 372294:<222: Transcription Factor
  misc_feature: Phenotype: ROSETTE LEAVES - Curled 1 Useful for making ornamental plants with altered leaf shape
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
atggaaggaagaaccagggacggccatccggggattagtcagccaagatatcgaggtgtacgacagcgaaaatgggggaaatgggtgtccgaaatccgggagcctggtaagaagacaagaatttggcttgggagttatgagatgcctgaaatggccgcggcggcatatgatgtggcagcattacaccttagaggacgtggggctcaactaaactttccagaaatggtggatagtttgccccggccggcgagctctagcactgaggatgtgcaaatggcagcacaagaggcggctttgctgtttcggagaccgataaaatgttcagagggagtaggtggtagctctagtggcggcgggggcagtttaggtcctgttagggttgggttgtcaccaagccaaattcaagctataaatgaggcaccactggactcaccaaaaatgtggatggagttagctggggctcttctgttggatgagcctgtggctatgggtgatgatattgatgtcgaactcagtgatgagtggggtgaaatggagcatgagcatgactccatttgggattattaa

SEQ ID NO: 3353 - protein, 188 aa, Populus balsamifera subsp. trichocarpa
  misc_feature (1)..(188): Ceres ANNOT ID no. 1486891
  misc_feature (15)..(78): Pfam Name: AP2 Pfam Description: AP2 domain
  misc_feature: SWISSPROT Homolog: TINY_ARATH Transcriptional factor TINY with e-value of 4.0e-31 and BLAST sequence identity of 49.7
  misc_feature: SWISSPROT Homolog: DRE1B_ARATH Dehydration-responsive element-binding protein 1B with e-value of 1.1e-26 and BLAST sequence identity of 56.0
  misc_feature: SWISSPROT Homolog: DRE1B_ARATH DREB1B protein (C-repeat-binding factor 1) C-repeat/dehydration-responsive element-binding factor 1 (CRT/DRE-binding factor 1)
  misc_feature: SWISSPROT Homolog: DRE1A_ARATH Dehydration-responsive element-binding protein 1A with e-value of 6.3e-26 and BLAST sequence identity of 52.5
  misc_feature: SWISSPROT Homolog: DRE1A_ARATH DREB1A protein (C-repeat-binding factor 3) C-repeat/dehydration-responsive element-binding factor 3) (CRT/DRE-binding factor 3)
  misc_feature: SWISSPROT Homolog: DRE1D_ARATH Dehydration-responsive element-binding protein 1D with e-value of 8.0e-26 and BLAST sequence identity of 47.8
  misc_feature: SWISSPROT Homolog: DRE1D_ARATH DREB1D protein (C-repeat-binding factor 4) C-repeat/dehydration-responsive element-binding factor 4) (CRT/DRE-binding factor 4)
  misc_feature: SWISSPROT Homolog: DRE1C_ARATH Dehydration-responsive element-binding protein 1C with e-value of 4.4e-25 and BLAST sequence identity of 57.4
  misc_feature: SWISSPROT Homolog: DRE1C_ARATH DREB1C protein (C-repeat-binding factor 2) (C-repeat/dehydration-responsive element-binding factor 2) (CRT/DRE-binding factor 2)
  misc_feature 372430:<222: Transcription Factor
  misc_feature: Phenotype: ROSETTE LEAVES - Curled 1 Useful for making ornamental plants with altered leaf shape
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature (1)..(188): Functional Homolog of  Ceres CLONE ID no. 681088 at SEQ ID NO. 3392 with e-value of 1.49E-31 and BLAST sequence identity of 65.2
MEGRTRDGHPGISQPRYRGVRQRKWGKWVSEIREPGKKTRIWLGSYEMPEMAAAAYDVAALHLRGRGAQLNFPEMVDSLPRPASSSTEDVQMAAQEAALLFRRPIKCSEGVGGSSSGGGGSLGPVRVGLSPSQIQAINEAPLDSPKMWMELAGALLLDEPVAMGDDIDVELSDEWGEMEHEHDSIWDY

SEQ ID NO: 3354 - DNA, 558 bp, Populus balsamifera subsp. trichocarpa
  misc_feature (1)..(558): Ceres ANNOT ID no. 1479637
  misc_feature 372513:<222: Transcription Factor
  misc_feature: Phenotype: ROSETTE LEAVES - Curled 1 Useful for making ornamental plants with altered leaf shape
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
atggaaggaagaatcagggacggccatcttgggattagtccgccgcgatatagaggtgtacgacaacggaaatgggggaaatgggtgtccgaaatccgggagcctggcaagaagacaagaatttggctcgggagttatgagatgcctgaaatggcggcggccgcatacgacgttgcagcattgcaccttagaggacgtggggcgcaactaaattttcctgagatggtggatattttgccccagccagcgagctctagcgcggaggatgtgcaaatggcggcacaagaggcggctttgatgtttcggagaccaatgaaatgctcggaggctgtaagcggcgattccagtgttggtggtggtttaggtcctgttagggttgggttgtcaccgagccaaattcaagctataaacgaggcaccattggactcaccaaaaatgtggatggagttagctggggctcttctgctggaagagcctatgatcatgagtgatgatattgatgttgcgtatagagatgagaggggagaaatgcagcatgattccatttgggattattaa

SEQ ID NO: 3355 - protein, 185 aa, Populus balsamifera subsp. trichocarpa
  misc_feature (1)..(185): Ceres ANNOT ID no. 1479637
  misc_feature (15)..(78): Pfam Name: AP2 Pfam Description: AP2 domain
  misc_feature: SWISSPROT Homolog: TINY_ARATH Transcriptional factor TINY with e-value of 4.0e-31 and BLAST sequence identity of 49.7
  misc_feature: SWISSPROT Homolog: DRE1B_ARATH Dehydration-responsive element-binding protein 1B with e-value of 1.1e-26 and BLAST sequence identity of 56.0
  misc_feature: SWISSPROT Homolog: DRE1B_ARATH DREB1B protein (C-repeat-binding factor 1) C-repeat/dehydration-responsive element-binding factor 1 (CRT/DRE-binding factor 1)
  misc_feature: SWISSPROT Homolog: DRE1A_ARATH Dehydration-responsive element-binding protein 1A with e-value of 6.3e-26 and BLAST sequence identity of 52.5
  misc_feature: SWISSPROT Homolog: DRE1A_ARATH DREB1A protein (C-repeat-binding factor 3) C-repeat/dehydration-responsive element-binding factor 3) (CRT/DRE-binding factor 3)
  misc_feature: SWISSPROT Homolog: DRE1D_ARATH Dehydration-responsive element-binding protein 1D with e-value of 8.0e-26 and BLAST sequence identity of 47.8
  misc_feature: SWISSPROT Homolog: DRE1D_ARATH DREB1D protein (C-repeat-binding factor 4) C-repeat/dehydration-responsive element-binding factor 4) (CRT/DRE-binding factor 4)
  misc_feature: SWISSPROT Homolog: DRE1C_ARATH Dehydration-responsive element-binding protein 1C with e-value of 4.4e-25 and BLAST sequence identity of 57.4
  misc_feature: SWISSPROT Homolog: DRE1C_ARATH DREB1C protein (C-repeat-binding factor 2) (C-repeat/dehydration-responsive element-binding factor 2) (CRT/DRE-binding factor 2)
  misc_feature 372649:<222: Transcription Factor
  misc_feature: Phenotype: ROSETTE LEAVES - Curled 1 Useful for making ornamental plants with altered leaf shape
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature (1)..(185): Functional Homolog of  Ceres CLONE ID no. 681088 at SEQ ID NO. 3392 with e-value of 4.59E-29 and BLAST sequence identity of 60.0
MEGRIRDGHLGISPPRYRGVRQRKWGKWVSEIREPGKKTRIWLGSYEMPEMAAAAYDVAALHLRGRGAQLNFPEMVDILPQPASSSAEDVQMAAQEAALMFRRPMKCSEAVSGDSSVGGGLGPVRVGLSPSQIQAINEAPLDSPKMWMELAGALLLEEPMIMSDDIDVAYRDERGEMQHDSIWDY

SEQ ID NO: 3356 - DNA, 570 bp, Populus balsamifera subsp. trichocarpa
  misc_feature (1)..(570): Ceres ANNOT ID no. 1446530
  misc_feature 372732:<222: Transcription Factor
  misc_feature: Phenotype: ROSETTE LEAVES - Curled 1 Useful for making ornamental plants with altered leaf shape
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
atggaaggaagaagcagggacgcccatggtgatcagattagtactccgagatatcgaggtattcggcaaagaaaatgggggacatgggtgtccgaaatccgggagcctggtcagaaaacaagaatttggctcggaagttacgagaagcctgaaatggctgcggtcgcgtatgatgtggcagcattgcaccttaggggacgtggggcacagctgaattttcctgaaatggaagatagcctcccccggccagccagttctagagcggaggacgtgcaagcggcagcacgggaggcagctttgctgtttagtactggaccagtaaaatgctcggatattgtaagctgtggctctattactagtgatggtggttttggtcctgttagagtggggttgtcaccgagccaaattcaagctattaacgaagcaccactggactcgccaaaaatgtggacggagtacttggctgagtctcttttgacgggagagccgatggctatggagaacgatattggtgtcggatatagtgaatgggaggaaattcaacaagaatccatttggggttactactaa

SEQ ID NO: 3357 - protein, 189 aa, Populus balsamifera subsp. trichocarpa
  misc_feature (1)..(189): Ceres ANNOT ID no. 1446530
  misc_feature (16)..(79): Pfam Name: AP2 Pfam Description: AP2 domain
  misc_feature: SWISSPROT Homolog: TINY_ARATH Transcriptional factor TINY with e-value of 4.0e-31 and BLAST sequence identity of 49.7
  misc_feature: SWISSPROT Homolog: DRE1B_ARATH Dehydration-responsive element-binding protein 1B with e-value of 1.1e-26 and BLAST sequence identity of 56.0
  misc_feature: SWISSPROT Homolog: DRE1B_ARATH DREB1B protein (C-repeat-binding factor 1) C-repeat/dehydration-responsive element-binding factor 1 (CRT/DRE-binding factor 1)
  misc_feature: SWISSPROT Homolog: DRE1A_ARATH Dehydration-responsive element-binding protein 1A with e-value of 6.3e-26 and BLAST sequence identity of 52.5
  misc_feature: SWISSPROT Homolog: DRE1A_ARATH DREB1A protein (C-repeat-binding factor 3) C-repeat/dehydration-responsive element-binding factor 3) (CRT/DRE-binding factor 3)
  misc_feature: SWISSPROT Homolog: DRE1D_ARATH Dehydration-responsive element-binding protein 1D with e-value of 8.0e-26 and BLAST sequence identity of 47.8
  misc_feature: SWISSPROT Homolog: DRE1D_ARATH DREB1D protein (C-repeat-binding factor 4) C-repeat/dehydration-responsive element-binding factor 4) (CRT/DRE-binding factor 4)
  misc_feature: SWISSPROT Homolog: DRE1C_ARATH Dehydration-responsive element-binding protein 1C with e-value of 4.4e-25 and BLAST sequence identity of 57.4
  misc_feature: SWISSPROT Homolog: DRE1C_ARATH DREB1C protein (C-repeat-binding factor 2) (C-repeat/dehydration-responsive element-binding factor 2) (CRT/DRE-binding factor 2)
  misc_feature 372868:<222: Transcription Factor
  misc_feature: Phenotype: ROSETTE LEAVES - Curled 1 Useful for making ornamental plants with altered leaf shape
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature (1)..(189): Functional Homolog of  Ceres CLONE ID no. 681088 at SEQ ID NO. 3392 with e-value of 7.69E-27 and BLAST sequence identity of 55.2
MEGRSRDAHGDQISTPRYRGIRQRKWGTWVSEIREPGQKTRIWLGSYEKPEMAAVAYDVAALHLRGRGAQLNFPEMEDSLPRPASSRAEDVQAAAREAALLFSTGPVKCSDIVSCGSITSDGGFGPVRVGLSPSQIQAINEAPLDSPKMWTEYLAESLLTGEPMAMENDIGVGYSEWEEIQQESIWGYY

SEQ ID NO: 3358 - protein, 177 aa, Glycine max
  misc_feature (1)..(177): Ceres CLONE ID no. 681222
  misc_feature (31)..(94): Pfam Name: AP2 Pfam Description: AP2 domain
  misc_feature: Phenotype: ROSETTE LEAVES - Curled 2 Useful for making ornamental plants with altered leaf shape
  misc_feature: Phenotype: ROSETTE LEAVES - Curled 4 Useful for making ornamental plants with altered leaf shape
  misc_feature: Phenotype: ROSETTE LEAVES - Lanceolate Shaped Useful for making plants with increased biomass and foliage
MEGEGRRREGGERETATAAATRKVVEGADQRRYKGIRMRKWGKWVAEIREPNKRSRIWLGSYSTPVAAARAYDTAVFYLRGPSARLNFPELLIGEGAAALTGGCDMSAASIRKKASEVGARVDALQATLHHHHHHVVPPRQLLSASCGGGSGDFAVRVVDLNKMPEPESSDCEWNVN

SEQ ID NO: 3359 - DNA, 549 bp, Populus balsamifera subsp. trichocarpa
  misc_feature (1)..(549): Ceres ANNOT ID no. 1456923
  misc_feature 373029:<222: Transcription Factor
  misc_feature: Phenotype: ROSETTE LEAVES - Curled 2 Useful for making ornamental plants with altered leaf shape
  misc_feature: Phenotype: ROSETTE LEAVES - Curled 4 Useful for making ornamental plants with altered leaf shape
  misc_feature: Phenotype: ROSETTE LEAVES - Lanceolate Shaped Useful for making plants with increased biomass and foliage
atggaaagtggagtagacaaggatatggcaacaagaaagagaggagggatggaaagtgagaggcaatacaaggggataaggatgaggaagtggggaaaatgggtggctgagataagagagcccaacaaaaggtcaaggatttggcttggttcctactcaacaccagtagcggcggctcgtgcttatgacaccgccgttttttatttgagagggccatcggcgaggctcaattttcctgaagttttggctgcagagggttttggtggcggtggatcatgcggggacatgtcagctgcttctataaggaaaagagcaactgaggttggagctcatgttgacgctatcgagacagcgttaaaccaccaccaccaccaccaccaccaccaccttcatcatgatgaccgtcaaagaaacagtaataatagtagcagtagtaatgataataatgaaacggtcgttgatagtagagagttgaagccacggccggttgacttgaataaggtgcctgacccagaggattccgatggagatgagtggaagaggagttaa

SEQ ID NO: 3360 - protein, 174 aa, Populus balsamifera subsp. trichocarpa
  misc_feature (1)..(174): Ceres ANNOT ID no. 1456923
  misc_feature (13)..(76): Pfam Name: AP2 Pfam Description: AP2 domain
  misc_feature: SWISSPROT Homolog: ERF13_ARATH Ethylene-responsive transcription factor 13 EREBP-13 (AtERF13) with e-value of 3.2e-18 and BLAST sequence identity of 58.1
  misc_feature: SWISSPROT Homolog: ERF5_ARATH Ethylene-responsive transcription factor 5 EREBP-5 (AtERF5) with e-value of 9.1e-18 and BLAST sequence identity of 52.5
  misc_feature: SWISSPROT Homolog: TINY_ARATH Transcriptional factor TINY with e-value of 2.4e-17 and BLAST sequence identity of 61.0
  misc_feature: SWISSPROT Homolog: ERF4_ARATH Ethylene-responsive transcription factor 4 Related to APETALA-2 protein 5 (EREBP-4) (AtERF4) with e-value of 8.2e-17 and BLAST sequence identity of 40.0
  misc_feature: SWISSPROT Homolog: DRE2C_ARATH Dehydration-responsive element-binding protein 2C (DREB2C protein) with e-value of 9.0e-17 and BLAST sequence identity of 47.3
  misc_feature 373133:<222: Transcription Factor
  misc_feature: Phenotype: ROSETTE LEAVES - Curled 2 Useful for making ornamental plants with altered leaf shape
  misc_feature: Phenotype: ROSETTE LEAVES - Curled 4 Useful for making ornamental plants with altered leaf shape
  misc_feature: Phenotype: ROSETTE LEAVES - Lanceolate Shaped Useful for making plants with increased biomass and foliage
  misc_feature (1)..(174): Functional Homolog of  Ceres CLONE ID no. 681222 at SEQ ID NO. 3405 with e-value of 1.69E-47 and BLAST sequence identity of 71.4
MATRKRGGMESERQYKGIRMRKWGKWVAEIREPNKRSRIWLGSYSTPVAAARAYDTAVFYLRGPSARLNFPEVLAAEGFGGGGSCGDMSAASIRKRATEVGAHVDAIETALNHHHHHHHHHLHHDDRQRNSNNSSSSNDNNETVVDSRELKPRPVDLNKVPDPEDSDGDEWKRS

SEQ ID NO: 3361 - protein, 214 aa, Glycine max
  misc_feature (1)..(214): Ceres CLONE ID no. 708342
  misc_feature (20)..(83): Pfam Name: AP2 Pfam Description: AP2 domain
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
MVKPKSVEKPAEEQQQRSVSSYRGVRKRKWGKYVSEIRLPNSRQRIWLGSYDSAEKAARAFDAAMFCLRGSGAKFNFPSDPPNIAGGGNMTSSQIQIAAARFANSEPRNERSDQPVESLTSDEETASFPVISDTDTSSPPLSDVTFQNDAELVTGSFPDMFSDFGSGDFVPDFSDFPSFDDFSRDFFLHELPGFNFGEENLDGLIIQDSFLWNF

SEQ ID NO: 3362 - DNA, 630 bp, Populus balsamifera subsp. trichocarpa; identical to SEQ ID NO: 3157
  misc_feature (1)..(630): Ceres ANNOT ID no. 1538185
  misc_feature 373311:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage

SEQ ID NO: 3363 - protein, 209 aa, Populus balsamifera subsp. trichocarpa; identical to SEQ ID NO: 3158
  misc_feature (1)..(209): Ceres ANNOT ID no. 1538185
  misc_feature (16)..(79): Pfam Name: AP2 Pfam Description: AP2 domain
  misc_feature: SWISSPROT Homolog: TINY_ARATH Transcriptional factor TINY with e-value of 5.4e-20 and BLAST sequence identity of 35.3
  misc_feature: SWISSPROT Homolog: DRE2F_ARATH Dehydration-responsive element-binding protein 2F (DREB2F protein) with e-value of 3.5e-17 and BLAST sequence identity of 52.4
  misc_feature: SWISSPROT Homolog: ERF7_ARATH Ethylene-responsive transcription factor 7 EREBP-7 (AtERF7) with e-value of 5.7e-17 and BLAST sequence identity of 59.3
  misc_feature: SWISSPROT Homolog: ERF5_ARATH Ethylene-responsive transcription factor 5 EREBP-5 (AtERF5) with e-value of 1.0e-16 and BLAST sequence identity of 54.5
  misc_feature: SWISSPROT Homolog: AP23_ARATH AP2 domain transcription factor RAP2.3 (Related to AP2 protein 3) (Cadmium-induced protein AS30) with e-value of 5.8e-16 and BLAST sequence identity of 36.8
  misc_feature 373431:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature (1)..(209): Functional Homolog of  Ceres CLONE ID no. 708342 at SEQ ID NO. 3408 with e-value of 2.89E-52 and BLAST sequence identity of 61.8

SEQ ID NO: 3364 - protein, 259 aa, Brassica napus
  misc_feature (1)..(259): Ceres CLONE ID no. 942964
  misc_feature (1)..(259): Also Known As Ceres CDNA ID no. 23421865
  misc_feature (1)..(259): Also Known As Ceres GEMINI ID 552A2
  misc_feature (64)..(89): Pfam Name: zf-C2H2 Pfam Description: Zinc finger, C2H2 type
  misc_feature 373554:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (154)..(154): Xaa is any aa, unknown, or other
  misc_feature (210)..(210): Xaa is any aa, unknown, or other
MAMGMAELGFPYWNPLRRRFPPDSPFFASGNVERELLAKQVALDFTEDEINNLQIIVETESRRISCPIVGCPERLKSLDNFEDHYKARHTASCSVCSRVYPTSRLLSIHISEAHDSFFQAKVARGYDMYECLVEGCGLKFKNYKARHRHLVDKXKFPTTFEFFKRTQLSKKRREKLQKQRVPKLKHEEDKEEASSDAMEVEDKASLDGLXSALSTLTTSDTTPSNVSFGRRHGRGLTFVPRSVHREKPTNSSSTPGPKT

SEQ ID NO: 3365 - DNA, 771 bp, Populus balsamifera subsp. trichocarpa
  misc_feature (1)..(771): Ceres ANNOT ID no. 1440785
  misc_feature 373649:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggcgatgcttgtagatatagacaccaaaaccgagttagggtttccgtactggaaaccgattcgtcgtcgttttggccccgaatctcctttcttctcttctggcaacatcgagagagaactcctcgccaaacaggttgcgttagatttaagtgaagatgaaaagcataggctgcaggatttgattaacgaggatggaagggaggtggtttgtccgattgttggttgtggtgcacacttgatatccttggaacactttgaagatcattataatggacggcacactgcgtcgtgttcggtttgctccagagtttacccaacgtcgctcctgctcagcattcatgtgtctgaagcacatgactctttctttcaggcaaaagttgcacgcggttatgccatgtatgaatgtctggtggaaggttgtggtttaaaattcaagaattacaagggtaggcaacagcatctggtagataaacacaagttccctagttcatttgaattcttcaagaaagcccacctatccaagaaagcaagacagaagcaacatcgcaaacaagctattcatagaagcgaggaaacttccagcaaaatggacatagaaggcgaaaccattgatggccttgtttcagcagtatctaagttaagcacttcagattcctctccttcttcaatcagctttggccgccgcaacactcgtggcctcacatttgtccctcgagcggttcagcgagagaaaagggcagattctgtgccaacaggagggaagcaatag

SEQ ID NO: 3366 - protein, 254 aa, Populus balsamifera subsp. trichocarpa
  misc_feature (1)..(254): Ceres ANNOT ID no. 1440785
  misc_feature (132)..(157): Pfam Name: zf-C2H2 Pfam Description: Zinc finger, C2H2 type
  misc_feature: SWISSPROT Homolog: ZN511_HUMAN Zinc finger protein 511 with e-value of 1.6e-22 and BLAST sequence identity of 35.7
  misc_feature: SWISSPROT Homolog: L2K1_DROME Protein lethal(2)k10201 (Wunen region protein B) with e-value of 2.5e-12 and BLAST sequence identity of 30.7
  misc_feature 373730:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(254): Functional Homolog of  Ceres CLONE ID no. 942964 at SEQ ID NO. 3411 with e-value of 3.49E-86 and BLAST sequence identity of 68.7
MLVDIDTKTELGFPYWKPIRRRFGPESPFFSSGNIERELLAKQVALDLSEDEKHRLQDLINEDGREVVCPIVGCGAHLISLEHFEDHYNGRHTASCSVCSRVYPTSLLLSIHVSEAHDSFFQAKVARGYAMYECLVEGCGLKFKNYKGRQQHLVDKHKFPSSFEFFKKAHLSKKARQKQHRKQAIHRSEETSSKMDIEGETIDGLVSAVSKLSTSDSSPSSISFGRRNTRGLTFVPRAVQREKRADSVPTGGKQ

SEQ ID NO: 3367 - protein, 206 aa, Brassica napus
  misc_feature (1)..(206): Ceres CLONE ID no. 952275
  misc_feature (1)..(206): Also Known As Ceres CDNA ID no. 23420963
  misc_feature (1)..(206): Also Known As Ceres GEMINI ID 552F6
  misc_feature (108)..(172): Pfam Name: AP2 Pfam Description: AP2 domain
  misc_feature 373840:<222: Transcription Factor
  misc_feature: Phenotype: Activates expression of the gene endogenous to the PsBBE (SEQ ID NO 4160) regalutory region Useful for modulating Alkaloid Biosynthesis
  misc_feature (163)..(163): Xaa is any aa, unknown, or other
  misc_feature (168)..(168): Xaa is any aa, unknown, or other
  misc_feature (174)..(174): Xaa is any aa, unknown, or other
  misc_feature (180)..(180): Xaa is any aa, unknown, or other
  misc_feature (187)..(187): Xaa is any aa, unknown, or other
  misc_feature (189)..(189): Xaa is any aa, unknown, or other
  misc_feature (200)..(200): Xaa is any aa, unknown, or other
MAAFEESSDLDAIQEHLLEDFLVADGFMGDFDFNASFVSGLWCIEPVMNQVPKQEPDSPVLDPDSFVREFLQVEAESSSEQNSSPHETDQSVSPRKEAKRLEEEEEPRHYRGVRRRPWGKFAAEIRDPAKKGSRIWLGTFESNVDAARAYDCAAFKLRGRKAXLNFPXDAGKYXAPVNLXRKRKRSXVXEELQRSQSNSXSSSSDL

SEQ ID NO: 3368 - DNA, 714 bp, Populus balsamifera subsp. trichocarpa
  misc_feature (1)..(714): Ceres ANNOT ID no. 1438399
  misc_feature 373939:<222: Transcription Factor
  misc_feature: Phenotype: Activates expression of the gene endogenous to the PsBBE (SEQ ID NO 4160) regalutory region Useful for modulating Alkaloid Biosynthesis
atggcaaccccagaagaatcctccacgttagaactcataagacaacatcttctcggagacttcacctccacagatgagttcatcagtaatcttgagtgcactgtagccagtatatctgttaaactagagaactccctatctgggtctgaatccaactccccagtatcagaccaaagttactatagcacccaagaaacctgtagctttgaaataaaatctgaaatcatagatttgacacctcctgaacccatgttttcagattcaagtaatcagtccccaccacctgaactcgtaaagatgacagatagagaagagacaatattaaggcattacagaggggtccgaagaaggccatggggaaagtttgcggcggagatccgtgacccaaccaggaagggtagtcgggtttggttaggtacttttgacagtgatatcgatgccgcaagagcttatgactgtgctgcattcaaaatgaggggcaggaaagcaatcctgaattttcctttggaggctggactgtccagctcgcctccggccacgggcaggaagaggagaagagtgaagagagaggaggtgctgccagaatctgttgatgtctcgccggaaaattgggatgtagagtggagtggagaggaagtggagggcttttctgacgaggagcaactgtcaccgttatctcgaaagccagttttgctttacgtgtcagtagattag

SEQ ID NO: 3369 - protein, 237 aa, Populus balsamifera subsp. trichocarpa
  misc_feature (1)..(237): Ceres ANNOT ID no. 1438399
  misc_feature (109)..(173): Pfam Name: AP2 Pfam Description: AP2 domain
  misc_feature: SWISSPROT Homolog: ERF5_TOBAC Ethylene-responsive transcription factor 5 EREBP-4 (NtERF4) with e-value of 1.9e-28 and BLAST sequence identity of 46.9
  misc_feature: SWISSPROT Homolog: ERF5_NICSY Ethylene-responsive transcription factor 5 EREBP-4 (NsERF4) with e-value of 1.9e-28 and BLAST sequence identity of 48.9
  misc_feature: SWISSPROT Homolog: ERF1_TOBAC Ethylene-responsive transcription factor 1 EREBP-1 (NtERF1) with e-value of 9.0e-27 and BLAST sequence identity of 41.2
  misc_feature: SWISSPROT Homolog: ERF5_ARATH Ethylene-responsive transcription factor 5 EREBP-5 (AtERF5) with e-value of 1.5e-26 and BLAST sequence identity of 60.9
  misc_feature: SWISSPROT Homolog: ERF6_ARATH Ethylene-responsive transcription factor 6 EREBP-6 (AtERF6) with e-value of 3.5e-25 and BLAST sequence identity of 59.8
  misc_feature 374034:<222: Transcription Factor
  misc_feature: Phenotype: Activates expression of the gene endogenous to the PsBBE (SEQ ID NO 4160) regalutory region Useful for modulating Alkaloid Biosynthesis
  misc_feature (1)..(237): Functional Homolog of  Ceres CLONE ID no. 952275 at SEQ ID NO. 3414 with e-value of 1.89E-39 and BLAST sequence identity of 50.0
MATPEESSTLELIRQHLLGDFTSTDEFISNLECTVASISVKLENSLSGSESNSPVSDQSYYSTQETCSFEIKSEIIDLTPPEPMFSDSSNQSPPPELVKMTDREETILRHYRGVRRRPWGKFAAEIRDPTRKGSRVWLGTFDSDIDAARAYDCAAFKMRGRKAILNFPLEAGLSSSPPATGRKRRRVKREEVLPESVDVSPENWDVEWSGEEVEGFSDEEQLSPLSRKPVLLYVSVD

SEQ ID NO: 3370 - DNA, 705 bp, Populus balsamifera subsp. trichocarpa
  misc_feature (1)..(705): Ceres ANNOT ID no. 1484559
  misc_feature 374112:<222: Transcription Factor
  misc_feature: Phenotype: Activates expression of the gene endogenous to the PsBBE (SEQ ID NO 4160) regalutory region Useful for modulating Alkaloid Biosynthesis
atggcaaccccggaagaatcctcaacattagaactcataagacaacatcttcttggagacttcatctccacagacgagtttatcagtaatcttgagtccagtatagccagtgtctctgtcaaactagagagctccctttctgggtcagaacccaactccccaatatccgaccaaagttaccatagtaccccagaaacctatagctttgaaataaaacctgaaatcatagacttcacacctcctgagcccgtgttttcaggttcaagtaatcagtacccaccacctgagcctgtaaagatgacagataaaggagaaacagtaaggcattacaggggggtccgaagaaggccatggggcaagtttgcagcagagatccgtgaccctacccggaagggaagtcgggtttggttgggtacttttgacagtgatactgatgctgcaaaagcttatgactgtgctgcattcaaaatgaggggcaggaaagcaatcctgaattttccttcggaggctggactatccatcccgccgccagccacaggcaggaagagaagaagatcgaagggagaagaggtgctgccggaatctgttgatgtgtcaacggaaaattggaatttaaagtggagtggagaagtagaggagggtgtttcagatgaggagcaactgtcaccgttaacccaagaaaccatgttggcaaggctttcttaa

SEQ ID NO: 3371 - protein, 234 aa, Populus balsamifera subsp. trichocarpa
  misc_feature (1)..(234): Ceres ANNOT ID no. 1484559
  misc_feature (108)..(172): Pfam Name: AP2 Pfam Description: AP2 domain
  misc_feature: SWISSPROT Homolog: ERF5_TOBAC Ethylene-responsive transcription factor 5 EREBP-4 (NtERF4) with e-value of 1.9e-28 and BLAST sequence identity of 46.9
  misc_feature: SWISSPROT Homolog: ERF5_NICSY Ethylene-responsive transcription factor 5 EREBP-4 (NsERF4) with e-value of 1.9e-28 and BLAST sequence identity of 48.9
  misc_feature: SWISSPROT Homolog: ERF1_TOBAC Ethylene-responsive transcription factor 1 EREBP-1 (NtERF1) with e-value of 9.0e-27 and BLAST sequence identity of 41.2
  misc_feature: SWISSPROT Homolog: ERF5_ARATH Ethylene-responsive transcription factor 5 EREBP-5 (AtERF5) with e-value of 1.5e-26 and BLAST sequence identity of 60.9
  misc_feature: SWISSPROT Homolog: ERF6_ARATH Ethylene-responsive transcription factor 6 EREBP-6 (AtERF6) with e-value of 3.5e-25 and BLAST sequence identity of 59.8
  misc_feature 374207:<222: Transcription Factor
  misc_feature: Phenotype: Activates expression of the gene endogenous to the PsBBE (SEQ ID NO 4160) regalutory region Useful for modulating Alkaloid Biosynthesis
  misc_feature (1)..(234): Functional Homolog of  Ceres CLONE ID no. 952275 at SEQ ID NO. 3414 with e-value of 5.79E-38 and BLAST sequence identity of 47.6
MATPEESSTLELIRQHLLGDFISTDEFISNLESSIASVSVKLESSLSGSEPNSPISDQSYHSTPETYSFEIKPEIIDFTPPEPVFSGSSNQYPPPEPVKMTDKGETVRHYRGVRRRPWGKFAAEIRDPTRKGSRVWLGTFDSDTDAAKAYDCAAFKMRGRKAILNFPSEAGLSIPPPATGRKRRRSKGEEVLPESVDVSTENWNLKWSGEVEEGVSDEEQLSPLTQETMLARLS

SEQ ID NO: 3372 - protein, 301 aa, Brassica napus
  misc_feature (1)..(301): Ceres CLONE ID no. 955048
  misc_feature (1)..(301): Also Known As Ceres CDNA ID no. 23420635
  misc_feature (1)..(301): Also Known As Ceres GEMINI ID 537E8
  misc_feature (19)..(288): Pfam Name: mTERF Pfam Description: mTERF
  misc_feature 374305:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (188)..(188): Xaa is any aa, unknown, or other
  misc_feature (202)..(202): Xaa is any aa, unknown, or other
  misc_feature (244)..(244): Xaa is any aa, unknown, or other
  misc_feature (266)..(266): Xaa is any aa, unknown, or other
  misc_feature (282)..(282): Xaa is any aa, unknown, or other
  misc_feature (296)..(296): Xaa is any aa, unknown, or other
MSAALSSSLYISPKKPSSPQLSQSTKPTTIKTTLHTHPLFSVADQAVTLQMKEKILCLELMGIDSGKALSLNPFLRSASLDSVEAVLNFLQSKGIYPNDLPRILGMCPKILTSDIRTELNPVFTFLSSDLHVPDNAFRRVVKKCPRLLISTVEDQLKPALFYLQRLGFKDLDALAYQDPVLLVSSVEXTLIPKLRFLESIGXSRSEAIGMILRCPALFTFSIENNFKPKLDYFMCEIKGKLENXKEFPQYFAFSLEKRIKPRHLKXMERGLELPLALMLKSXDEEFEQLLLQTEPXPVVNV

SEQ ID NO: 3373 - DNA, 984 bp, Populus balsamifera subsp. trichocarpa
  misc_feature (1)..(984): Ceres ANNOT ID no. 1466002
  misc_feature 374417:<222: Transcription Factor
  misc_feature: Phenotype: Activates expression of the gene endogenous to the AtATTPS3 (SEQ ID NO 4165) regalutory region Useful for modulating Terpenoid Biosynthesis
atgagattagattgtggcaatagagttcccctcctcctcctactgtctctctgtcggtctttcaccatgccgctaccaccaccagcagcagcagcgttacactcttctttgtgtttttcttctccgaagcagacaccccaaccctcaatttctcagcaaccaaacatccagttatcggtaaagtccaaaagcctccttcacaagcacccactgtacacaccagcccacacaaatatctcctttgaaatcaaagaaaagattctgtgtcttgaaataatgggagttgactctggcaaagcattatcccaaaacccttctctccacaccgcctctctagactccattcagtccataatcttctttctccaatccaaaggaatccaccaaaaggacttgcctaggatatttggcatgtgtccaaaagttctcacttctaacatcagaactgaccttaaacctgttttcaacttcctatcccaagacttaaaagtcccagacaataacttcagaaaggccatcaacaagtgcccaagattgctagtttctagcgtgagagaccagctcaaaccatgcttgttttatcttcaacggcttgggtttgaggatttggaagccttggcttatcaagaccctgtgctgttggtttctaatgttcaaaacaccttaattcctaaattgaagtacttggagagcataggtttttcaagagatgaagctgtggctatggttttaaggtgtccagcattgtttacttttagtgtcgagaataacttcaagccaaagtttgattactttgccgaggagatgaaggggaagttgacagagttgaaggggtttcctcaatattttgctttcagtttggataagcgaattaagccaaggcacgtcgaggttgtgcaaagtggggtcaaaattcctctgcgactgatgctcaagagcaccgatgaagagtttggggagatgataaggccaggggctggataa

SEQ ID NO: 3374 - protein, 305 aa, Populus balsamifera subsp. trichocarpa
  misc_feature (1)..(305): Ceres ANNOT ID no. 1466002
  misc_feature (43)..(114): Pfam Name: mTERF Pfam Description: mTERF
  misc_feature 374482:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(305): Functional Homolog of  Ceres CLONE ID no. 955048 at SEQ ID NO. 3419 with e-value of 1.10E-100 and BLAST sequence identity of 65.3
MPLPPPAAAALHSSLCFSSPKQTPQPSISQQPNIQLSVKSKSLLHKHPLYTPAHTNISFEIKEKILCLEIMGVDSGKALSQNPSLHTASLDSIQSIIFFLQSKGIHQKDLPRIFGMCPKVLTSNIRTDLKPVFNFLSQDLKVPDNNFRKAINKCPRLLVSSVRDQLKPCLFYLQRLGFEDLEALAYQDPVLLVSNVQNTLIPKLKYLESIGFSRDEAVAMVLRCPALFTFSVENNFKPKFDYFAEEMKGKLTELKGFPQYFAFSLDKRIKPRHVEVVQSGVKIPLRLMLKSTDEEFGEMIRPGAG

SEQ ID NO: 3375 - DNA, 846 bp, Populus balsamifera subsp. trichocarpa
  misc_feature (1)..(846): Ceres ANNOT ID no. 1450256
  misc_feature 374575:<222: Transcription Factor
  misc_feature: Phenotype: Activates expression of the gene endogenous to the AtATTPS3 (SEQ ID NO 4165) regalutory region Useful for modulating Terpenoid Biosynthesis
atgctttactctctctccctgccatcctcctctccctcctatccaccggcgaaacccctaaaaccccgtcatctctctccctctccccacccttcccattatatcaaattccgcacagctcaccatgaaaacctcaggtacctcaaagccattggtgttattggtcccaacagcaaatctcgccaattccctacccctgatgccatatctcacatccttgccaccctcaaattttttgagtccaaaggcttcttggagaccgactttgctaggctcacatttctatgcccagaacttttatctctcaactttgacatcactgacattgagcctgtgttccaattcttgaccgacgatttacatgcttctgttcaagaatcgaggggtttggtcatcaagtgtcctcgactactcttctctgatgtggaatatttccttaggcctactcttaattacctgaggcaattaggggtgaataagttgaatgttcctagtaatttgaatgcacatcttttgaacatccgcgtagagaaaatgcaagtgaggttcgagtttttacgaagcataggtttttcacatgatgaggctgcaaatatttgtggaagattgcctgcaatatttgggtacagcattgaaaacaatctgagacccaaagttgagtatttggtggatgagatgaagaggagtttggatgagctgaaggagtttcctcaatattttgctttcagtttggaaaagaagataatgccaaggcacttgcatctgaagagaaggaatgtcaagatcaaattgaacaggatgctgttgtggagtgatggaagattctatggaaaatggaaacgatga

SEQ ID NO: 3376 - protein, 281 aa, Populus balsamifera subsp. trichocarpa
  misc_feature (1)..(281): Ceres ANNOT ID no. 1450256
  misc_feature (18)..(277): Pfam Name: mTERF Pfam Description: mTERF
  misc_feature 374636:<222: Transcription Factor
  misc_feature: Phenotype: Activates expression of the gene endogenous to the AtATTPS3 (SEQ ID NO 4165) regalutory region Useful for modulating Terpenoid Biosynthesis
  misc_feature (1)..(281): Functional Homolog of  Ceres CLONE ID no. 955048 at SEQ ID NO. 3419 with e-value of 9.10E-40 and BLAST sequence identity of 39.4
MLYSLSLPSSSPSYPPAKPLKPRHLSPSPHPSHYIKFRTAHHENLRYLKAIGVIGPNSKSRQFPTPDAISHILATLKFFESKGFLETDFARLTFLCPELLSLNFDITDIEPVFQFLTDDLHASVQESRGLVIKCPRLLFSDVEYFLRPTLNYLRQLGVNKLNVPSNLNAHLLNIRVEKMQVRFEFLRSIGFSHDEAANICGRLPAIFGYSIENNLRPKVEYLVDEMKRSLDELKEFPQYFAFSLEKKIMPRHLHLKRRNVKIKLNRMLLWSDGRFYGKWKR

SEQ ID NO: 3377 - protein, 131 aa, Brassica napus
  misc_feature (1)..(131): Ceres CLONE ID no. 957981
  misc_feature (1)..(131): Also Known As Ceres CDNA ID no. 23420310
  misc_feature (1)..(131): Also Known As Ceres GEMINI ID 537C8
  misc_feature (28)..(63): Pfam Name: GATA Pfam Description: GATA zinc finger
  misc_feature 374743:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
MLDHSEEEYSETMKRRAGDAIEQNKKTCADCGTSKTPLWRGGPAGPKSLCNACGIRNRKKRRGAEDKKQKKTNSGGGDLKRSPKFGESMKQRIMDLGMTKRSTVEKQLRKLGEEEQAAVLLMALSYGSVYA

SEQ ID NO: 3378 - DNA, 693 bp, Populus balsamifera subsp. trichocarpa
  misc_feature (1)..(693): Ceres ANNOT ID no. 1515625
  misc_feature 374803:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
atgggttccatcttgcttgactcgaaaaccctcctccctccctccctccatgccacctctggcgccaacatttatttcctttccttcaccgagacaaaaacattttttggcgccccgccctttttgttcattttcagagacactttgttccttgttggcgggtggctattgctattcaacacccatttgaggaagtgggttgtcttgtcttcagatctcaagttgaggagttgcttagttacaatgctggatccatgtgagagacagggatcagagtctgaagaaatgagtagcaaatcactagaaaccgagagcccacagaagaagacttgtgctgattgtggcacttcaaagactccactttggagaggtggtccagctggccctaagtcactgtgtaatgcttgtgggattaggagcaggaagaagaagagggatatattagggttgaataagggaggggcagcagcaaatgacaagagagccaagaaagggagcactaacaatggctcaagtaattataataacaataacaagcaattaggtgatgggttaaagcagagattactggctctgggtagagaagtcttggtgcaaggatcaacagtggagaggcgaaggaggaagctaggtgaagaagagcaagctgcagtgttattgatggccttatcttatggctctgtttatgcttga

SEQ ID NO: 3379 - protein, 149 aa, Populus balsamifera subsp. trichocarpa
  misc_feature (1)..(149): Ceres ANNOT ID no. 1515625
  misc_feature (30)..(65): Pfam Name: GATA Pfam Description: GATA zinc finger
  misc_feature: SWISSPROT Homolog: GAT23_ARATH Putative GATA transcription factor 23 with e-value of 4.0e-47 and BLAST sequence identity of 74.8
  misc_feature: SWISSPROT Homolog: GAT16_ARATH GATA transcription factor 16 with e-value of 1.4e-35 and BLAST sequence identity of 64.4
  misc_feature: SWISSPROT Homolog: GAT17_ARATH GATA transcription factor 17 with e-value of 2.4e-28 and BLAST sequence identity of 49.4
  misc_feature: SWISSPROT Homolog: GAT24_ARATH GATA transcription factor 24 with e-value of 4.1e-18 and BLAST sequence identity of 74.4
  misc_feature: SWISSPROT Homolog: GAT20_ARATH Putative GATA transcription factor 20 with e-value of 3.8e-17 and BLAST sequence identity of 74.4
  misc_feature 374901:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature (1)..(149): Functional Homolog of  Ceres CLONE ID no. 957981 at SEQ ID NO. 3424 with e-value of 1.99E-35 and BLAST sequence identity of 64.8
MLDPCERQGSESEEMSSKSLETESPQKKTCADCGTSKTPLWRGGPAGPKSLCNACGIRSRKKKRDILGLNKGGAAANDKRAKKGSTNNGSSNYNNNNKQLGDGLKQRLLALGREVLVQGSTVERRRRKLGEEEQAAVLLMALSYGSVYA

SEQ ID NO: 3380 - DNA, 417 bp, Populus balsamifera subsp. trichocarpa
  misc_feature (1)..(417): Ceres ANNOT ID no. 1489205
  misc_feature 374972:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
atgttggatccagctaacaaaggatcagagtctgaagaaatgagtagcaattcacaagaaacagagagcccactaaaaaagacttgtgctgattgtggtacttcaaagactccactttggagaggtggtccagctggtccaaagtcgctgtgtaatgcttgtgggattagaagcagaaagaagaagagggatattttagggttgaataaaggggcagcaaatgacaagagagcaaaaaagggaagcaataataatggctcaagcaataacaacaacaacaagcagttaggtgatggatcaaagcagagattattggcactgggcagagaagttttgatgcaaagaagaaagctgggtgaagaagagcaagctgcagtgttgttgatggcgttgtcttatgggtctgtttatgcttaa

SEQ ID NO: 3381 - protein, 138 aa, Populus balsamifera subsp. trichocarpa
  misc_feature (1)..(138): Ceres ANNOT ID no. 1489205
  misc_feature (29)..(64): Pfam Name: GATA Pfam Description: GATA zinc finger
  misc_feature: SWISSPROT Homolog: GAT23_ARATH Putative GATA transcription factor 23 with e-value of 4.0e-47 and BLAST sequence identity of 74.8
  misc_feature: SWISSPROT Homolog: GAT16_ARATH GATA transcription factor 16 with e-value of 1.4e-35 and BLAST sequence identity of 64.4
  misc_feature: SWISSPROT Homolog: GAT17_ARATH GATA transcription factor 17 with e-value of 2.4e-28 and BLAST sequence identity of 49.4
  misc_feature: SWISSPROT Homolog: GAT24_ARATH GATA transcription factor 24 with e-value of 4.1e-18 and BLAST sequence identity of 74.4
  misc_feature: SWISSPROT Homolog: GAT20_ARATH Putative GATA transcription factor 20 with e-value of 3.8e-17 and BLAST sequence identity of 74.4
  misc_feature 375060:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature (1)..(138): Functional Homolog of  Ceres CLONE ID no. 957981 at SEQ ID NO. 3424 with e-value of 1.50E-32 and BLAST sequence identity of 62.9
MLDPANKGSESEEMSSNSQETESPLKKTCADCGTSKTPLWRGGPAGPKSLCNACGIRSRKKKRDILGLNKGAANDKRAKKGSNNNGSSNNNNNKQLGDGSKQRLLALGREVLMQRRKLGEEEQAAVLLMALSYGSVYA

SEQ ID NO: 3382 - protein, 110 aa, Brassica napus
  misc_feature (1)..(110): Ceres CLONE ID no. 960560
  misc_feature (1)..(110): Also Known As Ceres CDNA ID no. 23460392
  misc_feature (1)..(110): Also Known As Ceres GEMINI ID 537F8
  misc_feature (2)..(71): Pfam Name: RRM_1 Pfam Description: RNA recognition motif. (a.k.a. RRM RBD, or RNP domain)
  misc_feature 375149:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
MVRNLPFSTSEDFLQKEFSAFGEIAEVKLVKDESMKRSKGYAFIQYMSQDDAFLAIETMDRRMYNGRMIYIEIAKPGKRDFQQQPRTSGPPEKLQVPEEPASNEVADCWY

SEQ ID NO: 3383 - DNA, 393 bp, Populus balsamifera subsp. trichocarpa
  misc_feature (1)..(393): Ceres ANNOT ID no. 1446751
  misc_feature 375196:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
atggagaagagaaactatttctacggtccaagctctttctttctagtggatctcttgtgtgtattctttaattttgatataggacattctatcagtgaagctactttgcaaaaggaattttcaaattttggtgaaatagctgaagtgaagcttgtgaaggatgaaaccattaaaaggtccaaaccatatgcatttattcaatacacttctcaggatgatgccatccttgccctggaaaatatggaccgtaagactcttgatggcaggttaatttttgttgatcttgccaaacctgggaaagaccggtttagaggatacatgaaaacttgtggacctccaaagaagcagcaggtgcaggacacgcaagatgaggttgcagattgctggtactga

SEQ ID NO: 3384 - protein, 130 aa, Populus balsamifera subsp. trichocarpa
  misc_feature (1)..(130): Ceres ANNOT ID no. 1446751
  misc_feature (26)..(93): Pfam Name: RRM_1 Pfam Description: RNA recognition motif. (a.k.a. RRM RBD, or RNP domain)
  misc_feature: SWISSPROT Homolog: SFRS2_CHICK Splicing factor, arginine/serine-rich 2 (Splicing factor SC35) SC-35  (Splicing component, 35 kDa) (PR264 protein) with e-value of 1.5e-10 and BLAST sequence identity of 30.4
  misc_feature: SWISSPROT Homolog: SFRS2_HUMAN Splicing factor, arginine/serine-rich 2 (Splicing factor SC35) SC-35  (Splicing component, 35 kDa) (PR264 protein) with e-value of 1.5e-10 and BLAST sequence identity of 30.4
  misc_feature: SWISSPROT Homolog: SFRS2_MOUSE Splicing factor, arginine/serine-rich 2 (Splicing factor SC35) with e-value of 1.5e-10 and BLAST sequence identity of 30.4
  misc_feature: SWISSPROT Homolog: SFRS2_MOUSE Splicing component, 35 kDa PR264 protein Putative myelin regulatory factor 1 (MRF-1)
  misc_feature: SWISSPROT Homolog: SFRS2_PANTR Splicing factor, arginine/serine-rich 2 (Splicing factor SC35) (Splicing component, 35 kDa) with e-value of 1.5e-10 and BLAST sequence identity of 30.4
  misc_feature: SWISSPROT Homolog: SFRS2_RAT Splicing factor, arginine/serine-rich 2 (Splicing factor SC35) (Splicing component, 35 kDa) with e-value of 1.5e-10 and BLAST sequence identity of 30.4
  misc_feature 375291:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (1)..(130): Functional Homolog of  Ceres CLONE ID no. 960560 at SEQ ID NO. 3429 with e-value of 1.50E-30 and BLAST sequence identity of 65.3
MEKRNYFYGPSSFFLVDLLCVFFNFDIGHSISEATLQKEFSNFGEIAEVKLVKDETIKRSKPYAFIQYTSQDDAILALENMDRKTLDGRLIFVDLAKPGKDRFRGYMKTCGPPKKQQVQDTQDEVADCWY

SEQ ID NO: 3385 - protein, 214 aa, Brassica napus
  misc_feature (1)..(214): Ceres CLONE ID no. 965028
  misc_feature (1)..(214): Also Known As Ceres CDNA ID no. 23419606
  misc_feature (1)..(214): Also Known As Ceres GEMINI ID 537G6
  misc_feature (64)..(128): Pfam Name: AP2 Pfam Description: AP2 domain
  misc_feature 375372:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature (165)..(165): Xaa is any aa, unknown, or other
  misc_feature (195)..(195): Xaa is any aa, unknown, or other
  misc_feature (197)..(197): Xaa is any aa, unknown, or other
  misc_feature (201)..(201): Xaa is any aa, unknown, or other
  misc_feature (206)..(206): Xaa is any aa, unknown, or other
  misc_feature (209)..(209): Xaa is any aa, unknown, or other
MASSQDQSALDLITQHLLTDFPSLETFVSSIHQSTTSTLSQRKPSLATISVPTTAPVVQEDDHRHYRGVRRRPWGKYAAEIRDPNKKGVRVWLGTFDTAVEAARGYDRAAFKLRGSKAILNFPLEAGKHEDNNTVALKSKRKRPETQDENHGRNLISHKAVIREXTEAQGEACPLTPSSWMGFWDGVDGIGTGLXSXPPLXPYPSXGHXQLGVK

SEQ ID NO: 3386 - DNA, 864 bp, Populus balsamifera subsp. trichocarpa; identical to SEQ ID NO: 2059
  misc_feature (1)..(864): Ceres ANNOT ID no. 1438401
  misc_feature 375484:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis

SEQ ID NO: 3387 - protein, 263 aa, Populus balsamifera subsp. trichocarpa; identical to SEQ ID NO: 3008
  misc_feature (1)..(263): Ceres ANNOT ID no. 1438401
  misc_feature (104)..(168): Pfam Name: AP2 Pfam Description: AP2 domain
  misc_feature: SWISSPROT Homolog: ERF5_TOBAC Ethylene-responsive transcription factor 5 EREBP-4 (NtERF4) with e-value of 7.3e-46 and BLAST sequence identity of 51.8
  misc_feature: SWISSPROT Homolog: ERF5_NICSY Ethylene-responsive transcription factor 5 EREBP-4 (NsERF4) with e-value of 5.7e-41 and BLAST sequence identity of 47.3
  misc_feature: SWISSPROT Homolog: ERF5_ARATH Ethylene-responsive transcription factor 5 EREBP-5 (AtERF5) with e-value of 4.8e-37 and BLAST sequence identity of 48.5
  misc_feature: SWISSPROT Homolog: ERF6_ARATH Ethylene-responsive transcription factor 6 EREBP-6 (AtERF6) with e-value of 1.1e-33 and BLAST sequence identity of 46.9
  misc_feature: SWISSPROT Homolog: ERF2_ARATH Ethylene-responsive transcription factor 2 EREBP-2 (AtERF2) with e-value of 1.6e-27 and BLAST sequence identity of 47.8
  misc_feature 375600:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature (1)..(263): Functional Homolog of  Ceres CLONE ID no. 965028 at SEQ ID NO. 3432 with e-value of 3.20E-44 and BLAST sequence identity of 59.7

SEQ ID NO: 3388 - protein, 166 aa, Brassica napus
  misc_feature (1)..(166): Ceres CLONE ID no. 965175
  misc_feature (46)..(166): Pfam Name: Response_reg Pfam Description: Response regulator receiver domain
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
MSTFLTQFTIFFRIQNHCSKKKKPKMATTSTGDIEKTKSVEVKKKLNVLIVDDDPVIRKLHEIIIKSIGGISQTAKNGEEAVNIHRDGNASFDLILMDKEMPERDGLSATKKLREMKVTSMIIGVTTLADNEEERKAFMEAGLNHCLAKPLSKAKILPLINNLMDA

SEQ ID NO: 3389 - DNA, 417 bp, Populus balsamifera subsp. trichocarpa; identical to SEQ ID NO: 648
  misc_feature (1)..(417): Ceres ANNOT ID no. 1479013
  misc_feature 375781:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size

SEQ ID NO: 3390 - protein, 133 aa, Populus balsamifera subsp. trichocarpa; identical to SEQ ID NO: 649
  misc_feature (1)..(133): Ceres ANNOT ID no. 1479013
  misc_feature (15)..(123): Pfam Name: Response_reg Pfam Description: Response regulator receiver domain
  misc_feature: SWISSPROT Homolog: ARR22_ARATH Two-component response regulator ARR22 with e-value of 2.7e-57 and BLAST sequence identity of 82.4
  misc_feature: SWISSPROT Homolog: RCSC_SALTI Sensor protein rcsC (EC 2.7.13.3) (Capsular synthesis regulator component C) with e-value of 3.7e-13 and BLAST sequence identity of 33.9
  misc_feature: SWISSPROT Homolog: RCSC_SALTY Sensor protein rcsC (EC 2.7.13.3) (Capsular synthesis regulator component C) with e-value of 3.7e-13 and BLAST sequence identity of 33.9
  misc_feature: SWISSPROT Homolog: RCSC_ECOLI Sensor kinase protein rcsC (EC 2.7.13.3) (Capsular synthesis regulator component C) with e-value of 4.7e-13 and BLAST sequence identity of 33.9
  misc_feature: SWISSPROT Homolog: RESD_BACSU Transcriptional regulatory protein resD with e-value of 2.6e-11 and BLAST sequence identity of 32.5
  misc_feature 375885:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Short Petioles Useful for modulating plant size
  misc_feature (1)..(133): Functional Homolog of  Ceres CLONE ID no. 965175 at SEQ ID NO. 3435 with e-value of 7.69E-27 and BLAST sequence identity of 57.0

SEQ ID NO: 3391 - protein, 190 aa, Brassica napus
  misc_feature (1)..(190): Ceres CLONE ID no. 968026
  misc_feature (1)..(190): Also Known As Ceres CDNA ID no. 23419225
  misc_feature (1)..(190): Also Known As Ceres GEMINI ID 553C6
  misc_feature (25)..(157): Pfam Name: Response_reg Pfam Description: Response regulator receiver domain
  misc_feature 375986:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (190)..(190): Xaa is any aa, unknown, or other
MAEVMLPMKMEMANDPSKFTSPDLLHVLAVDDSHVDRKFIERLLKVSSCKVTVVDSATRALQYLGLDVNEKPIGCKDLKVNLIMTDYSMPGMTGYELLKKIKESSAFRDVPVVVMSSENILSRIDRCLEEGAEDFLLKPVKLSDVRRIRDSLIKVEDLSFTKSINKRELETENVYSLDSSVPLQLKRTKX

SEQ ID NO: 3392 - DNA, 672 bp, Populus balsamifera subsp. trichocarpa
  misc_feature (1)..(672): Ceres ANNOT ID no. 1473516
  misc_feature 376052:<222: Transcription Factor
  misc_feature: Phenotype: Activates expression of the gene endogenous to the AtPES (SEQ ID NO 4142) regalutory region Useful for modulating Terpenoid Biosynthesis
atggcaacggccggcgagatcttaaggagaagtttgacggaagaagttggattttctaaagggtctgtttctggttcagaggagttgcatgttcttgctgtagatgatagctttgtagacaggaaggttatagagaggttgcttaagatatcatcttgtaaagtgactgttgtagagagtgggagtagagctttgcagtatcttggattggatggagagaagagctctgttgggttcaatgatttgaaaatcaatctcatcatgaccgattactccatgccggggatgacaggatatgagctgcttaaaaagattaaggaatcatcagctttcagagagattcctgtagtgatcatgtcatctgagaacatcttggctcgtattgataggtgtttagaagaaggggcagaagaatacatacttaagccagtgaaattgtcagatgtgaaacgaattaaagatgttataatgggaggcgatggagagcaaaagaaaaggagaagtgttaggaagagaggaagggaagattgtttctattcattatcacaaccacagcttgtacaatcatcctcgtcccctgcttttgattttctgccgtccgaacttcagtcttcatcaccattttctactttgagtttgtcaaagaggcctaaattgcaaaccagagactaa

SEQ ID NO: 3393 - protein, 223 aa, Populus balsamifera subsp. trichocarpa
  misc_feature (1)..(223): Ceres ANNOT ID no. 1473516
  misc_feature (29)..(160): Pfam Name: Response_reg Pfam Description: Response regulator receiver domain
  misc_feature: SWISSPROT Homolog: ARR6_ARATH Two-component response regulator ARR6 with e-value of 2.2e-78 and BLAST sequence identity of 85.2
  misc_feature: SWISSPROT Homolog: ARR5_ARATH Two-component response regulator ARR5 (Response reactor 2) with e-value of 2.1e-66 and BLAST sequence identity of 72.1
  misc_feature: SWISSPROT Homolog: ARR7_ARATH Two-component response regulator ARR7 with e-value of 4.4e-50 and BLAST sequence identity of 60.4
  misc_feature: SWISSPROT Homolog: ARR15_ARATH Two-component response regulator ARR15 with e-value of 3.5e-48 and BLAST sequence identity of 59.3
  misc_feature: SWISSPROT Homolog: ARR4_ARATH Two-component response regulator ARR4 (Response regulator 1) with e-value of 9.3e-48 and BLAST sequence identity of 67.1
  misc_feature 376144:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(223): Functional Homolog of  Ceres CLONE ID no. 968026 at SEQ ID NO. 3438 with e-value of 2.89E-52 and BLAST sequence identity of 71.7
MATAGEILRRSLTEEVGFSKGSVSGSEELHVLAVDDSFVDRKVIERLLKISSCKVTVVESGSRALQYLGLDGEKSSVGFNDLKINLIMTDYSMPGMTGYELLKKIKESSAFREIPVVIMSSENILARIDRCLEEGAEEYILKPVKLSDVKRIKDVIMGGDGEQKKRRSVRKRGREDCFYSLSQPQLVQSSSSPAFDFLPSELQSSSPFSTLSLSKRPKLQTRD

SEQ ID NO: 3394 - DNA, 660 bp, Populus balsamifera subsp. trichocarpa
  misc_feature (1)..(660): Ceres ANNOT ID no. 1526929
  misc_feature 376219:<222: Transcription Factor
  misc_feature: Phenotype: Activates expression of the gene endogenous to the AtPES (SEQ ID NO 4142) regalutory region Useful for modulating Terpenoid Biosynthesis
atggcaacggccggcgagatcttaaggagaagtttgacggaagaagttggattttctaaagggtctgtttctggttcagaggagttgcatgttcttgctgtagatgatagctttgtagacaggaaggttatagagaggttgcttaagatatcatcttgtaaagagagtgggagtagagctttgcagtatcttggattggatggagagaagagctctgttgggttcaatgatttgaaaatcaatctcatcatgaccgattactccatgccggggatgacaggatatgagctgcttaaaaagattaaggaatcatcagctttcagagagattcctgtagtgatcatgtcatctgagaacatcttggctcgtattgataggtgtttagaagaaggggcagaagaatacatacttaagccagtgaaattgtcagatgtgaaacgaattaaagatgttataatgggaggcgatggagagcaaaagaaaaggagaagtgttaggaagagaggaagggaagattgtttctattcattatcacaaccacagcttgtacaatcatcctcgtcccctgcttttgattttctgccgtccgaacttcagtcttcatcaccattttctactttgagtttgtcaaagaggcctaaattgcaaaccagagactaa

SEQ ID NO: 3395 - protein, 219 aa, Populus balsamifera subsp. trichocarpa
  misc_feature (1)..(219): Ceres ANNOT ID no. 1526929
  misc_feature (29)..(156): Pfam Name: Response_reg Pfam Description: Response regulator receiver domain
  misc_feature: SWISSPROT Homolog: ARR6_ARATH Two-component response regulator ARR6 with e-value of 2.2e-78 and BLAST sequence identity of 85.2
  misc_feature: SWISSPROT Homolog: ARR5_ARATH Two-component response regulator ARR5 (Response reactor 2) with e-value of 2.1e-66 and BLAST sequence identity of 72.1
  misc_feature: SWISSPROT Homolog: ARR7_ARATH Two-component response regulator ARR7 with e-value of 4.4e-50 and BLAST sequence identity of 60.4
  misc_feature: SWISSPROT Homolog: ARR15_ARATH Two-component response regulator ARR15 with e-value of 3.5e-48 and BLAST sequence identity of 59.3
  misc_feature: SWISSPROT Homolog: ARR4_ARATH Two-component response regulator ARR4 (Response regulator 1) with e-value of 9.3e-48 and BLAST sequence identity of 67.1
  misc_feature 376311:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(219): Functional Homolog of  Ceres CLONE ID no. 968026 at SEQ ID NO. 3438 with e-value of 6.99E-49 and BLAST sequence identity of 70.9
MATAGEILRRSLTEEVGFSKGSVSGSEELHVLAVDDSFVDRKVIERLLKISSCKESGSRALQYLGLDGEKSSVGFNDLKINLIMTDYSMPGMTGYELLKKIKESSAFREIPVVIMSSENILARIDRCLEEGAEEYILKPVKLSDVKRIKDVIMGGDGEQKKRRSVRKRGREDCFYSLSQPQLVQSSSSPAFDFLPSELQSSSPFSTLSLSKRPKLQTRD

SEQ ID NO: 3396 - DNA, 777 bp, Populus balsamifera subsp. trichocarpa
  misc_feature (1)..(777): Ceres ANNOT ID no. 1513366
  misc_feature 376386:<222: Transcription Factor
  misc_feature: Phenotype: Activates expression of the gene endogenous to the AtPES (SEQ ID NO 4142) regalutory region Useful for modulating Terpenoid Biosynthesis
atgagttcgaacagcatagcttcgaatcgttggatgtcggagaagatggacggcttcgatccctctcccaattccaattcagataacgaagaggagggagttcatgtactggcagtggatgatagtcttgttgatcgcaaagtcatcgagcgtttgctcaagatttcttcttgtaaagtgacagcagtggacagtggatggagagctctaaaattgcttggattattagacgaagaagacaagagcagcagctcctcctcctcctcatctgctggttttgatgtgttgaaggtggatctaattattactgactactgtatgcctggaatgacaggatatgagttgctcaagaaaatcaaggaatcaactactttcagagaaatcccagttgtaattatgtcatcagagaacgtggtggctcgaatcgaccgatgtttggaggaaggagctgaggatttcatagtgaagccagtgaaattatcagacgttaaacgtataagagattacatggcaagcagagaggtcagatcagttcaaaaccaggaggagagaagcagcagcaatatcaacaagagaaaattacaagagtgttttgatctatctttatcttcatcgccaccctctatttcatcatcctcatcatcctcgttatcatatccctcacggtctccgtctctgacgccatctccaccatcgttgttttcttcatcagcgccgtgttctccctcgtcgttagattctccgactagacggctcaaaatgacgggcttcgattag

SEQ ID NO: 3397 - protein, 243 aa, Populus balsamifera subsp. trichocarpa
  misc_feature (1)..(243): Ceres ANNOT ID no. 1513366
  misc_feature (19)..(159): Pfam Name: Response_reg Pfam Description: Response regulator receiver domain
  misc_feature: SWISSPROT Homolog: ARR6_ARATH Two-component response regulator ARR6 with e-value of 2.2e-78 and BLAST sequence identity of 85.2
  misc_feature: SWISSPROT Homolog: ARR5_ARATH Two-component response regulator ARR5 (Response reactor 2) with e-value of 2.1e-66 and BLAST sequence identity of 72.1
  misc_feature: SWISSPROT Homolog: ARR7_ARATH Two-component response regulator ARR7 with e-value of 4.4e-50 and BLAST sequence identity of 60.4
  misc_feature: SWISSPROT Homolog: ARR15_ARATH Two-component response regulator ARR15 with e-value of 3.5e-48 and BLAST sequence identity of 59.3
  misc_feature: SWISSPROT Homolog: ARR4_ARATH Two-component response regulator ARR4 (Response regulator 1) with e-value of 9.3e-48 and BLAST sequence identity of 67.1
  misc_feature 376480:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(243): Functional Homolog of  Ceres CLONE ID no. 968026 at SEQ ID NO. 3438 with e-value of 3.59E-45 and BLAST sequence identity of 66.0
MDGFDPSPNSNSDNEEEGVHVLAVDDSLVDRKVIERLLKISSCKVTAVDSGWRALKLLGLLDEEDKSSSSSSSSSAGFDVLKVDLIITDYCMPGMTGYELLKKIKESTTFREIPVVIMSSENVVARIDRCLEEGAEDFIVKPVKLSDVKRIRDYMASREVRSVQNQEERSSSNINKRKLQECFDLSLSSSPPSISSSSSSSLSYPSRSPSLTPSPPSLFSSSAPCSPSSLDSPTRRLKMTGFD

SEQ ID NO: 3398 - DNA, 732 bp, Populus balsamifera subsp. trichocarpa
  misc_feature (1)..(732): Ceres ANNOT ID no. 1460097
  misc_feature 376561:<222: Transcription Factor
  misc_feature: Phenotype: Activates expression of the gene endogenous to the AtPES (SEQ ID NO 4142) regalutory region Useful for modulating Terpenoid Biosynthesis
atggacggcttcgatccctctcccaattccaattcagataacgaagaggagggagttcatgtactggcagtggatgatagtcttgttgatcgcaaagtcatcgagcgtttgctcaagatttcttcttgtaaagtgacagcagtggacagtggatggagagctctaaaattgcttggattattagacgaagaagacaagagcagcagctcctcctcctcctcatctgctggttttgatgtgttgaaggtggatctaattattactgactactgtatgcctggaatgacaggatatgagttgctcaagaaaatcaaggaatcaactactttcagagaaatcccagttgtaattatgtcatcagagaacgtggtggctcgaatcgaccgatgtttggaggaaggagctgaggatttcatagtgaagccagtgaaattatcagacgttaaacgtataagagattacatggcaagcagagaggtcagatcagttcaaaaccaggaggagagaagcagcagcaatatcaacaagagaaaattacaagagtgttttgatctatctttatcttcatcgccaccctctatttcatcatcctcatcatcctcgttatcatatccctcacggtctccgtctctgacgccatctccaccatcgttgttttcttcatcagcgccgtgttctccctcgtcgttagattctccgactagacggctcaaaatgacgggcttcgattag

SEQ ID NO: 3399 - protein, 243 aa, Populus balsamifera subsp. trichocarpa; identical to SEQ ID NO: 3397
  misc_feature (1)..(243): Ceres ANNOT ID no. 1460097
  misc_feature (19)..(159): Pfam Name: Response_reg Pfam Description: Response regulator receiver domain
  misc_feature: SWISSPROT Homolog: ARR6_ARATH Two-component response regulator ARR6 with e-value of 2.2e-78 and BLAST sequence identity of 85.2
  misc_feature: SWISSPROT Homolog: ARR5_ARATH Two-component response regulator ARR5 (Response reactor 2) with e-value of 2.1e-66 and BLAST sequence identity of 72.1
  misc_feature: SWISSPROT Homolog: ARR7_ARATH Two-component response regulator ARR7 with e-value of 4.4e-50 and BLAST sequence identity of 60.4
  misc_feature: SWISSPROT Homolog: ARR15_ARATH Two-component response regulator ARR15 with e-value of 3.5e-48 and BLAST sequence identity of 59.3
  misc_feature: SWISSPROT Homolog: ARR4_ARATH Two-component response regulator ARR4 (Response regulator 1) with e-value of 9.3e-48 and BLAST sequence identity of 67.1
  misc_feature 376655:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(243): Functional Homolog of  Ceres CLONE ID no. 968026 at SEQ ID NO. 3438 with e-value of 3.59E-45 and BLAST sequence identity of 66.0

SEQ ID NO: 3400 - DNA, 744 bp, Populus balsamifera subsp. trichocarpa
  misc_feature (1)..(744): Ceres ANNOT ID no. 1459838
  misc_feature 376736:<222: Transcription Factor
  misc_feature: Phenotype: Activates expression of the gene endogenous to the AtPES (SEQ ID NO 4142) regalutory region Useful for modulating Terpenoid Biosynthesis
atgggttctaacagtattgtttcaaatcgttggatgtcagagaagatgaactgcctcgatctctcacccaattctaactcagataatgaagaggaagaagttcatgtactggcagtggatgatagttttgttgaccgcaaagtcatcgagcgtttgctcaaaatttcatcttgtaaagtgacagcggtggacagtggatggggagctctaaaactgcttggattattagacgacgaagaagaagacaagagcagctcctcctcctcctcctcctcatctgctggttttgaggggttgaaggtggatctaataattactgactactgtatgcctggaatgacaggatatgagttgctcaagaaaatcaaggaatcatctagtttcagagaaataccggttgtgattatgtcatcggagaacgtgatggctcgaatcgaccgatgtttggaggaaggagctgaggagttcatagcgaaaccagtgaaattgtcagacgttaaacgactgagagattactacatggcaaccagagagatcagatcagttcaaagcagcagcaatgttaacaagagaaaattacaggagagttttgatgtatctacatcttcatcgccaccctctatctcaccgtctccttcgccttcctctgcgtctccaccatcactgttctcatcatcagcgccgtgctctccctcgtctttagattctccgactagacggatcaaaatgacgagcttcgattag

SEQ ID NO: 3401 - protein, 232 aa, Populus balsamifera subsp. trichocarpa
  misc_feature (1)..(232): Ceres ANNOT ID no. 1459838
  misc_feature (19)..(162): Pfam Name: Response_reg Pfam Description: Response regulator receiver domain
  misc_feature: SWISSPROT Homolog: ARR6_ARATH Two-component response regulator ARR6 with e-value of 2.2e-78 and BLAST sequence identity of 85.2
  misc_feature: SWISSPROT Homolog: ARR5_ARATH Two-component response regulator ARR5 (Response reactor 2) with e-value of 2.1e-66 and BLAST sequence identity of 72.1
  misc_feature: SWISSPROT Homolog: ARR7_ARATH Two-component response regulator ARR7 with e-value of 4.4e-50 and BLAST sequence identity of 60.4
  misc_feature: SWISSPROT Homolog: ARR15_ARATH Two-component response regulator ARR15 with e-value of 3.5e-48 and BLAST sequence identity of 59.3
  misc_feature: SWISSPROT Homolog: ARR4_ARATH Two-component response regulator ARR4 (Response regulator 1) with e-value of 9.3e-48 and BLAST sequence identity of 67.1
  misc_feature 376830:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(232): Functional Homolog of  Ceres CLONE ID no. 968026 at SEQ ID NO. 3438 with e-value of 1.20E-44 and BLAST sequence identity of 58.9
MNCLDLSPNSNSDNEEEEVHVLAVDDSFVDRKVIERLLKISSCKVTAVDSGWGALKLLGLLDDEEEDKSSSSSSSSSSAGFEGLKVDLIITDYCMPGMTGYELLKKIKESSSFREIPVVIMSSENVMARIDRCLEEGAEEFIAKPVKLSDVKRLRDYYMATREIRSVQSSSNVNKRKLQESFDVSTSSSPPSISPSPSPSSASPPSLFSSSAPCSPSSLDSPTRRIKMTSFD

SEQ ID NO: 3402 - DNA, 684 bp, Populus balsamifera subsp. trichocarpa
  misc_feature (1)..(684): Ceres ANNOT ID no. 1474764
  misc_feature 376908:<222: Transcription Factor
  misc_feature: Phenotype: Activates expression of the gene endogenous to the AtPES (SEQ ID NO 4142) regalutory region Useful for modulating Terpenoid Biosynthesis
atggcaataacaggggattcactctcccagtttcatgttttagctgttgatgacagcttaatagatagaaagctgattgagaggcttctcaagacatcatcctatcaagttactacagttgattctggtagcaaagccttgaaatttctgggattacaagaagatgaacaaagcaacccagacacaccttatgtttctcctaacaatcatcaggaaatggaagtgaatcttattattacagattactgtatgcctggcatgacaggctatgatttgctcaagaaagtaaaggaatcatcatctctcagaaacatacctgtagtgatcatgtcatctgaaaatgttccttcaaggatcaccagatgtttggaggagggagccgaggaatttttcttgaagccagtaagactatcagatttgaataggcttaaacctcacatgatgaaaactaagatcaagaaccaaaaacaagaagagcaagaagagcttgaaataccagctattcagtcagaagagcagaaacaaccagtgcagcagccatcatcacagccacagcctgagtcacaaccacaaccatcagcactactactacagcccaacaataacaagaggaaggctatggaagaagggctttcaccagatagaaccagacctagatacaatggcatcactactatggtctga

SEQ ID NO: 3403 - protein, 227 aa, Populus balsamifera subsp. trichocarpa
  misc_feature (1)..(227): Ceres ANNOT ID no. 1474764
  misc_feature (11)..(152): Pfam Name: Response_reg Pfam Description: Response regulator receiver domain
  misc_feature: SWISSPROT Homolog: ARR6_ARATH Two-component response regulator ARR6 with e-value of 2.2e-78 and BLAST sequence identity of 85.2
  misc_feature: SWISSPROT Homolog: ARR5_ARATH Two-component response regulator ARR5 (Response reactor 2) with e-value of 2.1e-66 and BLAST sequence identity of 72.1
  misc_feature: SWISSPROT Homolog: ARR7_ARATH Two-component response regulator ARR7 with e-value of 4.4e-50 and BLAST sequence identity of 60.4
  misc_feature: SWISSPROT Homolog: ARR15_ARATH Two-component response regulator ARR15 with e-value of 3.5e-48 and BLAST sequence identity of 59.3
  misc_feature: SWISSPROT Homolog: ARR4_ARATH Two-component response regulator ARR4 (Response regulator 1) with e-value of 9.3e-48 and BLAST sequence identity of 67.1
  misc_feature 377000:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(227): Functional Homolog of  Ceres CLONE ID no. 968026 at SEQ ID NO. 3438 with e-value of 4.89E-41 and BLAST sequence identity of 56.9
MAITGDSLSQFHVLAVDDSLIDRKLIERLLKTSSYQVTTVDSGSKALKFLGLQEDEQSNPDTPYVSPNNHQEMEVNLIITDYCMPGMTGYDLLKKVKESSSLRNIPVVIMSSENVPSRITRCLEEGAEEFFLKPVRLSDLNRLKPHMMKTKIKNQKQEEQEELEIPAIQSEEQKQPVQQPSSQPQPESQPQPSALLLQPNNNKRKAMEEGLSPDRTRPRYNGITTMV

SEQ ID NO: 3404 - DNA, 702 bp, Populus balsamifera subsp. trichocarpa
  misc_feature (1)..(702): Ceres ANNOT ID no. 1453555
  misc_feature 377078:<222: Transcription Factor
  misc_feature: Phenotype: Activates expression of the gene endogenous to the AtPES (SEQ ID NO 4142) regalutory region Useful for modulating Terpenoid Biosynthesis
atgacaataacgggagattcacactcacagtttcatgttttagctgttgatgacagcatgatagatagaaagctgattgagaggctcctcaagacatcatcatatcaagttactgcagttgattctggtagtaaagctttaaaatttctgggattacatgaagaagatgaccatagcaacccagatacagtaccttctgtttctcctaacgatcatcgggaagtggaagtgaatcttatcattacagattactgtatgcccggcatgacaggctatgatttgctcaagaaagtaaaggaatcgtcatctctcagggacatacctgtggtcatcatgtcatctgaaaatgtcccttcaaggatcaccagatgtttagaggaaggagcagaggaatttttcttgaagccagtacgactagctgatttgaataggcttaaacctcacatgatgaaaaccaaaattaagaacgaaaaacaagaagatcaagaaaagcttgaaaattcagaaattcagtcagaacagcagccacagccaccatcacagccacagccacagccacagccacagctagagtcacaatcacaaccacaaccatcaccactactacaacaacccaacaataacaaaaggaaagctatggaagaagggctttcaccagatagaactagacctagatacaatggcattactaccatggtctga

SEQ ID NO: 3405 - protein, 233 aa, Populus balsamifera subsp. trichocarpa
  misc_feature (1)..(233): Ceres ANNOT ID no. 1453555
  misc_feature (11)..(142): Pfam Name: Response_reg Pfam Description: Response regulator receiver domain
  misc_feature: SWISSPROT Homolog: ARR6_ARATH Two-component response regulator ARR6 with e-value of 2.2e-78 and BLAST sequence identity of 85.2
  misc_feature: SWISSPROT Homolog: ARR5_ARATH Two-component response regulator ARR5 (Response reactor 2) with e-value of 2.1e-66 and BLAST sequence identity of 72.1
  misc_feature: SWISSPROT Homolog: ARR7_ARATH Two-component response regulator ARR7 with e-value of 4.4e-50 and BLAST sequence identity of 60.4
  misc_feature: SWISSPROT Homolog: ARR15_ARATH Two-component response regulator ARR15 with e-value of 3.5e-48 and BLAST sequence identity of 59.3
  misc_feature: SWISSPROT Homolog: ARR4_ARATH Two-component response regulator ARR4 (Response regulator 1) with e-value of 9.3e-48 and BLAST sequence identity of 67.1
  misc_feature 377170:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(233): Functional Homolog of  Ceres CLONE ID no. 968026 at SEQ ID NO. 3438 with e-value of 2.39E-39 and BLAST sequence identity of 55.7
MTITGDSHSQFHVLAVDDSMIDRKLIERLLKTSSYQVTAVDSGSKALKFLGLHEEDDHSNPDTVPSVSPNDHREVEVNLIITDYCMPGMTGYDLLKKVKESSSLRDIPVVIMSSENVPSRITRCLEEGAEEFFLKPVRLADLNRLKPHMMKTKIKNEKQEDQEKLENSEIQSEQQPQPPSQPQPQPQPQLESQSQPQPSPLLQQPNNNKRKAMEEGLSPDRTRPRYNGITTMV

SEQ ID NO: 3406 - DNA, 582 bp, Populus balsamifera subsp. trichocarpa
  misc_feature (1)..(582): Ceres ANNOT ID no. 1448253
  misc_feature 377248:<222: Transcription Factor
  misc_feature: Phenotype: Activates expression of the gene endogenous to the AtPES (SEQ ID NO 4142) regalutory region Useful for modulating Terpenoid Biosynthesis
atggctactttggctactctggctaccgagactcagtttcatgttctggctgttgatgatagccttattgacagaaagttgattgaaaggctcctcaaaacctcttcttatcaggtcacagcagtggattcaggaagcaaggccttggagtttttgggtttgagcggggatgatgagcagagagattcaaacccttcctctgtttcccctgaccatcatcatcaacacattgaaattaacatgatcattacagattactgtatgccaggaatgacaggctacgatctcctaaaaaagatcaaggaatccaagtatttcaaggatatcccagttgtgatcatgtcctcagagaatgtcccctcaagaatcaatagatgcttggaagaaggagcagaagagttcttcttgaagccagttcaattatccgatgtcaacaaacttagaccccatctgatgaagggaagatgcaaggaagaagatcaacctaacaacaaaaggaaaggcatggaagaaattgtcaactctcctggcagaacaagatcaagatacagcgagggcttggaagtggtcttatcccaatag

SEQ ID NO: 3407 - protein, 193 aa, Populus balsamifera subsp. trichocarpa
  misc_feature (1)..(193): Ceres ANNOT ID no. 1448253
  misc_feature (13)..(155): Pfam Name: Response_reg Pfam Description: Response regulator receiver domain
  misc_feature: SWISSPROT Homolog: ARR6_ARATH Two-component response regulator ARR6 with e-value of 2.2e-78 and BLAST sequence identity of 85.2
  misc_feature: SWISSPROT Homolog: ARR5_ARATH Two-component response regulator ARR5 (Response reactor 2) with e-value of 2.1e-66 and BLAST sequence identity of 72.1
  misc_feature: SWISSPROT Homolog: ARR7_ARATH Two-component response regulator ARR7 with e-value of 4.4e-50 and BLAST sequence identity of 60.4
  misc_feature: SWISSPROT Homolog: ARR15_ARATH Two-component response regulator ARR15 with e-value of 3.5e-48 and BLAST sequence identity of 59.3
  misc_feature: SWISSPROT Homolog: ARR4_ARATH Two-component response regulator ARR4 (Response regulator 1) with e-value of 9.3e-48 and BLAST sequence identity of 67.1
  misc_feature 377336:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(193): Functional Homolog of  Ceres CLONE ID no. 968026 at SEQ ID NO. 3438 with e-value of 1.00E-38 and BLAST sequence identity of 59.6
MATLATLATETQFHVLAVDDSLIDRKLIERLLKTSSYQVTAVDSGSKALEFLGLSGDDEQRDSNPSSVSPDHHHQHIEINMIITDYCMPGMTGYDLLKKIKESKYFKDIPVVIMSSENVPSRINRCLEEGAEEFFLKPVQLSDVNKLRPHLMKGRCKEEDQPNNKRKGMEEIVNSPGRTRSRYSEGLEVVLSQ

SEQ ID NO: 3408 - DNA, 600 bp, Populus balsamifera subsp. trichocarpa
  misc_feature (1)..(600): Ceres ANNOT ID no. 1437849
  misc_feature 377408:<222: Transcription Factor
  misc_feature: Phenotype: Activates expression of the gene endogenous to the AtPES (SEQ ID NO 4142) regalutory region Useful for modulating Terpenoid Biosynthesis
atggctctggctactaccatggctactgagactcagtttcatgttcttgctgttgacgactgccttattgacagaaagttgattgaaaggctccttaaaacctcttcttatcaagtcacggcagtggattcaggaagcaaggccttggagtttttgggcttgaatggagaaaatgagctgagagattcaaaacctgcctctgtttcccctgacccctatcatcagcacattgaaattaatatgatcattacagattactgtatgccaggaatgacaggctatgatcttctaaaaaagatcaaggaatctaaatatttcaaggacatcccagttgtgatcatgtcctcagagaatgtcccatcaagaatcaacagatgcctaaaagaaggagctgaagagttcttcctgaagccagttcaattatcagatgtcaacaagcttagaccccatctaatgaagggaagatgcaaggaagaagaagaagaagaagaagaagaagaagaagatcaacccaataacaagagaaagggcatggaagaaattgttaactctccagatcgaacaagaacaagatacaatgatggcttggaagttgtctga

SEQ ID NO: 3409 - protein, 193 aa, Populus balsamifera subsp. trichocarpa
  misc_feature (1)..(193): Ceres ANNOT ID no. 1437849
  misc_feature (7)..(149): Pfam Name: Response_reg Pfam Description: Response regulator receiver domain
  misc_feature: SWISSPROT Homolog: ARR6_ARATH Two-component response regulator ARR6 with e-value of 2.2e-78 and BLAST sequence identity of 85.2
  misc_feature: SWISSPROT Homolog: ARR5_ARATH Two-component response regulator ARR5 (Response reactor 2) with e-value of 2.1e-66 and BLAST sequence identity of 72.1
  misc_feature: SWISSPROT Homolog: ARR7_ARATH Two-component response regulator ARR7 with e-value of 4.4e-50 and BLAST sequence identity of 60.4
  misc_feature: SWISSPROT Homolog: ARR15_ARATH Two-component response regulator ARR15 with e-value of 3.5e-48 and BLAST sequence identity of 59.3
  misc_feature: SWISSPROT Homolog: ARR4_ARATH Two-component response regulator ARR4 (Response regulator 1) with e-value of 9.3e-48 and BLAST sequence identity of 67.1
  misc_feature 377498:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(193): Functional Homolog of  Ceres CLONE ID no. 968026 at SEQ ID NO. 3438 with e-value of 5.79E-38 and BLAST sequence identity of 65.1
MATETQFHVLAVDDCLIDRKLIERLLKTSSYQVTAVDSGSKALEFLGLNGENELRDSKPASVSPDPYHQHIEINMIITDYCMPGMTGYDLLKKIKESKYFKDIPVVIMSSENVPSRINRCLKEGAEEFFLKPVQLSDVNKLRPHLMKGRCKEEEEEEEEEEEDQPNNKRKGMEEIVNSPDRTRTRYNDGLEVV

SEQ ID NO: 3410 - DNA, 732 bp, Populus balsamifera subsp. trichocarpa
  misc_feature (1)..(732): Ceres ANNOT ID no. 1443270
  misc_feature 377570:<222: Transcription Factor
  misc_feature: Phenotype: Activates expression of the gene endogenous to the AtPES (SEQ ID NO 4142) regalutory region Useful for modulating Terpenoid Biosynthesis
atggagatcatggaatcaggtgctgttgatacacaacatcaggaagaagagaaacatcagcaacaaaaggaagaagaaggagaagagaaacataagcaacaaagggatcaggagggggaagaagaagagaaacattttcatgtcctggcagtggatgatagttttattgacaggaagcttttagaaaggctgcttaaagtatcttcataccaagtgacatttgtggactctggggataaggctttggaatatttaggtctccttgatagcatagacaatgtcaatgcaacctcttcttcttcgtcgtcccaatcaccacaacaagaggggatgaaagtaaatttgatcatgactgattactgcatgcctggaatgagcggttatgatttactcaaacgagtcaagggatcttattggaaagatgttccagtggtggttatgtcctcagagaatataccttccagaattagaatgtgcttggaagaaggagcagaggagttcttattgaagccacttcaattatcagatgttgaaaaacttcagactcaccttctaaagtcgcttgacaagtactcttccaaaaggattgatgacaacagttttaatactgacagcagcaacattactgttagcaacaagagcaacagcaacaatattgttagcaagaggaaggcattgtctccagagattgaggacagaagacctaaaatgaaaggattggctgttgtatag

SEQ ID NO: 3411 - protein, 240 aa, Populus balsamifera subsp. trichocarpa
  misc_feature (1)..(240): Ceres ANNOT ID no. 1443270
  misc_feature (43)..(186): Pfam Name: Response_reg Pfam Description: Response regulator receiver domain
  misc_feature: SWISSPROT Homolog: ARR6_ARATH Two-component response regulator ARR6 with e-value of 2.2e-78 and BLAST sequence identity of 85.2
  misc_feature: SWISSPROT Homolog: ARR5_ARATH Two-component response regulator ARR5 (Response reactor 2) with e-value of 2.1e-66 and BLAST sequence identity of 72.1
  misc_feature: SWISSPROT Homolog: ARR7_ARATH Two-component response regulator ARR7 with e-value of 4.4e-50 and BLAST sequence identity of 60.4
  misc_feature: SWISSPROT Homolog: ARR15_ARATH Two-component response regulator ARR15 with e-value of 3.5e-48 and BLAST sequence identity of 59.3
  misc_feature: SWISSPROT Homolog: ARR4_ARATH Two-component response regulator ARR4 (Response regulator 1) with e-value of 9.3e-48 and BLAST sequence identity of 67.1
  misc_feature 377664:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(240): Functional Homolog of  Ceres CLONE ID no. 968026 at SEQ ID NO. 3438 with e-value of 4.10E-37 and BLAST sequence identity of 60.5
MESGAVDTQHQEEEKHQQQKEEEGEEKHKQQRDQEGEEEEKHFHVLAVDDSFIDRKLLERLLKVSSYQVTFVDSGDKALEYLGLLDSIDNVNATSSSSSSQSPQQEGMKVNLIMTDYCMPGMSGYDLLKRVKGSYWKDVPVVVMSSENIPSRIRMCLEEGAEEFLLKPLQLSDVEKLQTHLLKSLDKYSSKRIDDNSFNTDSSNITVSNKSNSNNIVSKRKALSPEIEDRRPKMKGLAVV

SEQ ID NO: 3412 - DNA, 657 bp, Populus balsamifera subsp. trichocarpa
  misc_feature (1)..(657): Ceres ANNOT ID no. 1496190
  misc_feature 377745:<222: Transcription Factor
  misc_feature: Phenotype: Activates expression of the gene endogenous to the AtPES (SEQ ID NO 4142) regalutory region Useful for modulating Terpenoid Biosynthesis
atggagatcatggaatcaggtgctgttgatacacaacatcaggaagaagagaaacatcagcaacaaaaggaagaagaaggagaagagaaacataagcaacaaagggatcaggagggggaagaagaagagaaacattttcatgtcctggcagtggatgatagttttattgacaggaagcttttagaaaggctgcttaaagtatcttcataccaagtgacatttgtggactctggggataaggctttggaatatttaggtctccttgatagcatagacaatgtcaatgcaacctcttcttcttcgtcgtcccaatcaccacaacaagaggggatgaaagtaaatttgatcatgactgattactgcatgcctggaatgagcggttatgatttactcaaacgagtcaagggatcttattggaaagatgttccagtggtggttatgtcctcagagaatataccttccagaattagaatgtgcttggaagaaggagcagaggagttcttattgaagccacttcaattatcagatgttgaaaaacttcagactcaccttctaaagtcgcttgacaagtgcaagtgcttgcgctgcaatggaaactctaaagccattgccttctggactgctgaaagtaaaaaaaaaaaagaacaacaaaagtga

SEQ ID NO: 3413 - protein, 215 aa, Populus balsamifera subsp. trichocarpa
  misc_feature (1)..(215): Ceres ANNOT ID no. 1496190
  misc_feature (43)..(186): Pfam Name: Response_reg Pfam Description: Response regulator receiver domain
  misc_feature: SWISSPROT Homolog: ARR6_ARATH Two-component response regulator ARR6 with e-value of 2.2e-78 and BLAST sequence identity of 85.2
  misc_feature: SWISSPROT Homolog: ARR5_ARATH Two-component response regulator ARR5 (Response reactor 2) with e-value of 2.1e-66 and BLAST sequence identity of 72.1
  misc_feature: SWISSPROT Homolog: ARR7_ARATH Two-component response regulator ARR7 with e-value of 4.4e-50 and BLAST sequence identity of 60.4
  misc_feature: SWISSPROT Homolog: ARR15_ARATH Two-component response regulator ARR15 with e-value of 3.5e-48 and BLAST sequence identity of 59.3
  misc_feature: SWISSPROT Homolog: ARR4_ARATH Two-component response regulator ARR4 (Response regulator 1) with e-value of 9.3e-48 and BLAST sequence identity of 67.1
  misc_feature 377835:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(215): Functional Homolog of  Ceres CLONE ID no. 968026 at SEQ ID NO. 3438 with e-value of 5.99E-36 and BLAST sequence identity of 65.6
MESGAVDTQHQEEEKHQQQKEEEGEEKHKQQRDQEGEEEEKHFHVLAVDDSFIDRKLLERLLKVSSYQVTFVDSGDKALEYLGLLDSIDNVNATSSSSSSQSPQQEGMKVNLIMTDYCMPGMSGYDLLKRVKGSYWKDVPVVVMSSENIPSRIRMCLEEGAEEFLLKPLQLSDVEKLQTHLLKSLDKCKCLRCNGNSKAIAFWTAESKKKKEQQK

SEQ ID NO: 3414 - protein, 253 aa, Brassica napus
  misc_feature (1)..(253): Ceres CLONE ID no. 982869
  misc_feature (1)..(253): Also Known As Ceres CDNA ID no. 23417641
  misc_feature (1)..(253): Also Known As Ceres GEMINI ID 552A7
  misc_feature (29)..(78): Pfam Name: Myb_DNA-binding Pfam Description: Myb-like DNA-binding domain
  misc_feature 377930:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (155)..(155): Xaa is any aa, unknown, or other
  misc_feature (192)..(192): Xaa is any aa, unknown, or other
  misc_feature (193)..(193): Xaa is any aa, unknown, or other
  misc_feature (197)..(197): Xaa is any aa, unknown, or other
METLNPLSHVPISDHRFVGQDMMSLQSPSSIWTKEENKMFERALAIYPEDSPDRWFKIASMIPGKTVFDVMKQYSKLEEDVFDIEEGRVPIPGYPSPLGLAQDTYRKRPNGARGSDHDRKKGVPWTEEEHRRFLLGLLKYGKGDWRNISRNFVVXKTPTQVASHAQKYYQRQLSGAKDKRRPSIHDITTGNXXNANXNRSFSDHRDILPDLVFIEKDNAEGLMCMSPNLFSPSSAPFDDAFNFAGVNAFSAGA

SEQ ID NO: 3415 - DNA, 1050 bp, Populus balsamifera subsp. trichocarpa
  misc_feature (1)..(1050): Ceres ANNOT ID no. 1458219
  misc_feature 378032:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atgtcgaatccaatttgtgttgcccaaaccacagagtggaccaaagaggagaacaagatgtttgagagagctttggcgatatttgatgagcatgagcctgatagatggctgaaggtggcagctatgataccaggaaagacagttaatgatgtgatcaagcaatacaagaagctggaagaggatgtttgtgatatagaagcagggagggttccggttccaggttatcttagctcatctttcacgtccgagttggttgatgatagcacttttgatgcgtataggaagaggcctttgaatatcaagagtgctgatcagcagagaaagaaaggtgtgccatggacagaagaggagcacaggcggttcctgatggggcttctaaagcatggcaaaggagactggaggaacatctctcgcaattttgtaggctccaagactccaactcaagtggcaagccatgcacagaagtattttataaggcagcagctttcgggagtgaaggataagagaagaccaagcatccatgacatcacaactctcaatctcgcagatgctactactccgtcagatggtgacgaaccttcctcgctagatcaatctgatttgcttttatcgcagcaaaagccagcagggatgcagaaagtgttgattgactgggacgaagcaaaggatggatcgattatggtctttgattcaactcatgaagacttgtttaagtcatctccatatgagataccttcgaacggtctaaaatttcaggggcaaaatctgtgtgtcggtgctcatcatggggctcgtatcaacccccataacatggtggtgaaaatgaaatgcagggctcaagaagggaaagctagtttcaggaggctttcttctagtaatggaaaccttcttctcaagtctccccttcagtgcagactaaatctcgatgattctgactcacccggcactctgtttgaaattccgcggtatctgattgcctgccttatctcgaagctaagaaccttggagcaatcgttagctttatgtggtcctccaaaatggccaagttga

SEQ ID NO: 3416 - protein, 349 aa, Populus balsamifera subsp. trichocarpa
  misc_feature (1)..(349): Ceres ANNOT ID no. 1458219
  misc_feature (10)..(59): Pfam Name: Myb_DNA-binding Pfam Description: Myb-like DNA-binding domain
  misc_feature: SWISSPROT Homolog: ZRF1_HUMAN Zuotin-related factor 1 (M-phase phosphoprotein 11) with e-value of 1.9e-07 and BLAST sequence identity of 40.3
  misc_feature 378116:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(349): Functional Homolog of  Ceres CLONE ID no. 982869 at SEQ ID NO. 3461 with e-value of 3.09E-62 and BLAST sequence identity of 75.6
MSNPICVAQTTEWTKEENKMFERALAIFDEHEPDRWLKVAAMIPGKTVNDVIKQYKKLEEDVCDIEAGRVPVPGYLSSSFTSELVDDSTFDAYRKRPLNIKSADQQRKKGVPWTEEEHRRFLMGLLKHGKGDWRNISRNFVGSKTPTQVASHAQKYFIRQQLSGVKDKRRPSIHDITTLNLADATTPSDGDEPSSLDQSDLLLSQQKPAGMQKVLIDWDEAKDGSIMVFDSTHEDLFKSSPYEIPSNGLKFQGQNLCVGAHHGARINPHNMVVKMKCRAQEGKASFRRLSSSNGNLLLKSPLQCRLNLDDSDSPGTLFEIPRYLIACLISKLRTLEQSLALCGPPKWPS

SEQ ID NO: 3417 - DNA, 1017 bp, Populus balsamifera subsp. trichocarpa
  misc_feature (1)..(1017): Ceres ANNOT ID no. 1464757
  misc_feature 378224:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggaaactctgaatccatcttggtacatgtcgaattcgaattggtttacccaaaccacagagtggactagagaggagaacaaggagtttgagatagctttggcgatatttgatgagcatgagcctgataggtggctaaaggtggcagctatgatacctggaaagacagtttatgatgtgatcaagcaatacaaggagctggaagaggatgttagtgatatagaagcagggagggttccggttccgggttaccttagctcgtctttcactttccagttggttggcaatagcaattttgatgcgtataggaagaggtctttgactgccaagagtgctgatcagcagagaaagaaaggtgtgccatggacagaagatgagcacaggcggttccttatggggcttctaaagcatggaaaaggggactggaggaacatctctcgcaattttgtagtttccaagactccaactcaagtggcgagccatgcacagaagtatttcatacggcagcagctttccggagtgaaggataagagaagacctagcatccatgacattacaactgtcaatctcgcagatgctactactccgtcagatggtgacgaaccttcctcgctagatcaatctgatttgcttttatcgcagcaaaagccagcagggatgcagaaagtgttgattgactgggacgaagcaaaggatggatcgattatggtctttgattcaactcatgaagacttgtttaagtcatctccatatgagataccttcgaacggtctaaaatttcaggggcaaaatctgtgtgtcggtgctcatcatggggctcgtatcaacccccataacatggtggtgaaaatgaaatgcagggctcaagaagggaaagctagtttcaggaggctttcttctagtaatggaaaccttcttctcaagtctccccttcagtgcagactaaatctcgatgattgtaaaatccgtacttcgatttatgttggcgttgtgctgaactcaagatcagcagtataa

SEQ ID NO: 3418 - protein, 338 aa, Populus balsamifera subsp. trichocarpa
  misc_feature (1)..(338): Ceres ANNOT ID no. 1464757
  misc_feature (19)..(68): Pfam Name: Myb_DNA-binding Pfam Description: Myb-like DNA-binding domain
  misc_feature: SWISSPROT Homolog: ZRF1_HUMAN Zuotin-related factor 1 (M-phase phosphoprotein 11) with e-value of 1.9e-07 and BLAST sequence identity of 40.3
  misc_feature 378306:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(338): Functional Homolog of  Ceres CLONE ID no. 982869 at SEQ ID NO. 3461 with e-value of 7.49E-61 and BLAST sequence identity of 69.7
METLNPSWYMSNSNWFTQTTEWTREENKEFEIALAIFDEHEPDRWLKVAAMIPGKTVYDVIKQYKELEEDVSDIEAGRVPVPGYLSSSFTFQLVGNSNFDAYRKRSLTAKSADQQRKKGVPWTEDEHRRFLMGLLKHGKGDWRNISRNFVVSKTPTQVASHAQKYFIRQQLSGVKDKRRPSIHDITTVNLADATTPSDGDEPSSLDQSDLLLSQQKPAGMQKVLIDWDEAKDGSIMVFDSTHEDLFKSSPYEIPSNGLKFQGQNLCVGAHHGARINPHNMVVKMKCRAQEGKASFRRLSSSNGNLLLKSPLQCRLNLDDCKIRTSIYVGVVLNSRSAV

SEQ ID NO: 3419 - protein, 207 aa, Arabidopsis thaliana [sequence omitted]

SEQ ID NO: 3420 - DNA, 624 bp, Populus balsamifera subsp. trichocarpa; identical to SEQ ID NO: 70
  misc_feature (1)..(624): Ceres ANNOT ID no. 1475043
  misc_feature 378537:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: INFLORESCENCE - Strong Useful for making stronger plants
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: CAULINE LEAVES - Serrate Margins Useful for making plants with increased biomass and foliage

SEQ ID NO: 3421 - protein, 207 aa, Populus balsamifera subsp. trichocarpa; identical to SEQ ID NO: 71
  misc_feature (1)..(207): Ceres ANNOT ID no. 1475043
  misc_feature (54)..(207): Pfam Name: Ribosomal_S7 Pfam Description: Ribosomal protein S7p/S5e
  misc_feature: SWISSPROT Homolog: RS5A_ARATH 40S ribosomal protein S5-1 with e-value of 2.4e-104 and BLAST sequence identity of 100.0
  misc_feature: SWISSPROT Homolog: RS5B_ARATH 40S ribosomal protein S5-2 with e-value of 3.3e-100 and BLAST sequence identity of 94.7
  misc_feature: SWISSPROT Homolog: RS5_CICAR 40S ribosomal protein S5 (Fragment) with e-value of 1.6e-91 and BLAST sequence identity of 92.6
  misc_feature: SWISSPROT Homolog: RS5_BOVIN 40S ribosomal protein S5 with e-value of 6.5e-79 and BLAST sequence identity of 79.2
  misc_feature: SWISSPROT Homolog: RS5_HUMAN 40S ribosomal protein S5 with e-value of 6.5e-79 and BLAST sequence identity of 79.2
  misc_feature 378682:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: INFLORESCENCE - Strong Useful for making stronger plants
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: CAULINE LEAVES - Serrate Margins Useful for making plants with increased biomass and foliage
  misc_feature (1)..(207): Functional Homolog of  Ceres CLONE ID no. 1001432 at SEQ ID NO. 3466 with e-value of 3.39E-88 and BLAST sequence identity of 89.6

SEQ ID NO: 3422 - DNA, 627 bp, Populus balsamifera subsp. trichocarpa; identical to SEQ ID NO: 68
  misc_feature (1)..(627): Ceres ANNOT ID no. 1454586
  misc_feature 378810:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: INFLORESCENCE - Strong Useful for making stronger plants
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: CAULINE LEAVES - Serrate Margins Useful for making plants with increased biomass and foliage

SEQ ID NO: 3423 - protein, 208 aa, Populus balsamifera subsp. trichocarpa; identical to SEQ ID NO: 69
  misc_feature (1)..(208): Ceres ANNOT ID no. 1454586
  misc_feature (55)..(208): Pfam Name: Ribosomal_S7 Pfam Description: Ribosomal protein S7p/S5e
  misc_feature: SWISSPROT Homolog: RS5A_ARATH 40S ribosomal protein S5-1 with e-value of 2.4e-104 and BLAST sequence identity of 100.0
  misc_feature: SWISSPROT Homolog: RS5B_ARATH 40S ribosomal protein S5-2 with e-value of 3.3e-100 and BLAST sequence identity of 94.7
  misc_feature: SWISSPROT Homolog: RS5_CICAR 40S ribosomal protein S5 (Fragment) with e-value of 1.6e-91 and BLAST sequence identity of 92.6
  misc_feature: SWISSPROT Homolog: RS5_BOVIN 40S ribosomal protein S5 with e-value of 6.5e-79 and BLAST sequence identity of 79.2
  misc_feature: SWISSPROT Homolog: RS5_HUMAN 40S ribosomal protein S5 with e-value of 6.5e-79 and BLAST sequence identity of 79.2
  misc_feature 378955:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: INFLORESCENCE - Strong Useful for making stronger plants
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: CAULINE LEAVES - Serrate Margins Useful for making plants with increased biomass and foliage
  misc_feature (1)..(208): Functional Homolog of  Ceres CLONE ID no. 1001432 at SEQ ID NO. 3466 with e-value of 1.20E-87 and BLAST sequence identity of 88.9

SEQ ID NO: 3424 - DNA, 579 bp, Populus balsamifera subsp. trichocarpa; identical to SEQ ID NO: 72
  misc_feature (1)..(579): Ceres ANNOT ID no. 1507756
  misc_feature 379086:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: INFLORESCENCE - Strong Useful for making stronger plants
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: CAULINE LEAVES - Serrate Margins Useful for making plants with increased biomass and foliage

SEQ ID NO: 3425 - protein, 192 aa, Populus balsamifera subsp. trichocarpa; identical to SEQ ID NO: 73
  misc_feature (1)..(192): Ceres ANNOT ID no. 1507756
  misc_feature (123)..(192): Pfam Name: Ribosomal_S7 Pfam Description: Ribosomal protein S7p/S5e
  misc_feature: SWISSPROT Homolog: RS5A_ARATH 40S ribosomal protein S5-1 with e-value of 2.4e-104 and BLAST sequence identity of 100.0
  misc_feature: SWISSPROT Homolog: RS5B_ARATH 40S ribosomal protein S5-2 with e-value of 3.3e-100 and BLAST sequence identity of 94.7
  misc_feature: SWISSPROT Homolog: RS5_CICAR 40S ribosomal protein S5 (Fragment) with e-value of 1.6e-91 and BLAST sequence identity of 92.6
  misc_feature: SWISSPROT Homolog: RS5_BOVIN 40S ribosomal protein S5 with e-value of 6.5e-79 and BLAST sequence identity of 79.2
  misc_feature: SWISSPROT Homolog: RS5_HUMAN 40S ribosomal protein S5 with e-value of 6.5e-79 and BLAST sequence identity of 79.2
  misc_feature 379229:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: INFLORESCENCE - Strong Useful for making stronger plants
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: CAULINE LEAVES - Serrate Margins Useful for making plants with increased biomass and foliage
  misc_feature (1)..(192): Functional Homolog of  Ceres CLONE ID no. 1001432 at SEQ ID NO. 3466 with e-value of 3.70E-75 and BLAST sequence identity of 87.9

SEQ ID NO: 3426 - DNA, 564 bp, Populus balsamifera subsp. trichocarpa; identical to SEQ ID NO: 74
  misc_feature (1)..(564): Ceres ANNOT ID no. 1469708
  misc_feature 379357:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: INFLORESCENCE - Strong Useful for making stronger plants
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: CAULINE LEAVES - Serrate Margins Useful for making plants with increased biomass and foliage

SEQ ID NO: 3427 - protein, 187 aa, Populus balsamifera subsp. trichocarpa; identical to SEQ ID NO: 75
  misc_feature (1)..(187): Ceres ANNOT ID no. 1469708
  misc_feature (53)..(80): Pfam Name: Ribosomal_S7 Pfam Description: Ribosomal protein S7p/S5e
  misc_feature: SWISSPROT Homolog: RS5A_ARATH 40S ribosomal protein S5-1 with e-value of 2.4e-104 and BLAST sequence identity of 100.0
  misc_feature: SWISSPROT Homolog: RS5B_ARATH 40S ribosomal protein S5-2 with e-value of 3.3e-100 and BLAST sequence identity of 94.7
  misc_feature: SWISSPROT Homolog: RS5_CICAR 40S ribosomal protein S5 (Fragment) with e-value of 1.6e-91 and BLAST sequence identity of 92.6
  misc_feature: SWISSPROT Homolog: RS5_BOVIN 40S ribosomal protein S5 with e-value of 6.5e-79 and BLAST sequence identity of 79.2
  misc_feature: SWISSPROT Homolog: RS5_HUMAN 40S ribosomal protein S5 with e-value of 6.5e-79 and BLAST sequence identity of 79.2
  misc_feature 379500:<222: Transcription Factor
  misc_feature: Phenotype: ROSETTE LEAVES - Curled 2 Useful for making ornamental plants with altered leaf shape
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: INFLORESCENCE - Strong Useful for making stronger plants
  misc_feature: Phenotype: WHOLE PLANT - High Anthocyanin Useful for modulating anthocyanin content
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: CAULINE LEAVES - Serrate Margins Useful for making plants with increased biomass and foliage
  misc_feature (1)..(187): Functional Homolog of  Ceres CLONE ID no. 1001432 at SEQ ID NO. 3466 with e-value of 9.80E-43 and BLAST sequence identity of 59.7

SEQ ID NO: 3428 - protein, 357 aa, Arabidopsis thaliana
  misc_feature (1)..(357): Ceres CLONE ID no. 1002819
  misc_feature (98)..(162): Pfam Name: RRM_1 Pfam Description: RNA recognition motif. (a.k.a. RRM RBD, or RNP domain)
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MKPVFCGNFEYDARESDLERLFRKYGKVERVDMKAGFAFVYMEDERDAEDAIRALDRFEYGRTGRRLRVEWTKNDRGGAGRSGGSRRSSSGLRPSKTLFVINFDAQNTRTRDLERHFEPYGKIVNVRIRRNFAFIQYEAQEDATRALDATNSSKLMDKVISVEYAVKDDDSRGNGYSPERRRDRSPDRRRRSPSPYRRERGSPDYGRGASPVAHKRERTSPDYGRGRRSPSPYKRARLSPDYKRDDRRRERVASPENGAVRNRSPRKGRGESRSPPPYEKRRESRSPPPYEKRRESRSPPPYEKRRERSRSRSKSSPENGQVESPGQIMEVEAGRGYDGADSPIRESSPSRSPPAEE

SEQ ID NO: 3429 - DNA, 1206 bp, Populus balsamifera subsp. trichocarpa
  misc_feature (1)..(1206): Ceres ANNOT ID no. 1474290
  misc_feature 379779:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgaggccaatcttttgtgggaactttgagtatgatgcaagacagactgagctggaacggcttttcaaacgatacgggagagttgaacgggtggatatgaagtctggatttgcttttatctatatggaagatgagagagatgctgaggatgctattcgaggacttgatcgtgtagaatttggtcgcaagggccgcagacttcgtgttgaatggacaaagcaagaacgtgggattagaaggcctggtggcacatcaagaagatcaactaatacaaggccttctaagacgctatttgtcatcaactttgatccacatcatacaaggaccaaggatttggagaggcactttgaaccttatgggaggatagtgagcgtaaggataagaagaaattttgcatttgttcagtatgaagcacaagaggatgccaccaaagcactggacgccacaaacttaagcaagctgctggatcgagtgatttcagtggaatatgcagttcgagatgatgatgaaaggaaagatggatacagtcctgatagaagtcgtgataggtcaccagataggcgaggacatgataggaggcgctctccaagtccttaccggagagagaggggaagccctgattacggccgtggccctagtccatatcgcaaggagaggggtagcccagattatggtcgtcgccgcagccctagcccctataggagagatagggctagccctgactatggccggggcacaagccgtagtccttataggagagagagggctggcagtgatcatggccatggccccagccgtagtccttaccgcagggacaaggctagtcctgtcaatggtagtccttaccgcagggacaaggctagtcctgtcaatggtcatggccccagtgatagtccttatcaaagggaagaaaggattagccctgaaaatggtcgtggtccaagccgtagtccatatcgaagagaaaggtctaaccaaggccatggtcgtggttccagccatagtccatatggaagagaaaggcctaacccagacaatggacgtggttccagccgaagccccactgaaagagatggagatagccctgaaaatggtcaactaagaagcccgagctccattcctgatgagagggacagtccaaatggaggagctgaaagccccatgcgagggagataccgcagccaatcacccccagctgatgaatga

SEQ ID NO: 3430 - protein, 401 aa, Populus balsamifera subsp. trichocarpa
  misc_feature (1)..(401): Ceres ANNOT ID no. 1474290
  misc_feature (97)..(161): Pfam Name: RRM_1 Pfam Description: RNA recognition motif. (a.k.a. RRM RBD, or RNP domain)
  misc_feature: SWISSPROT Homolog: RSP41_ARATH Arginine/serine-rich splicing factor RSP41 with e-value of 3.4e-192 and BLAST sequence identity of 99.7
  misc_feature: SWISSPROT Homolog: RSP40_ARATH Arginine/serine-rich splicing factor RSP40 with e-value of 1.1e-133 and BLAST sequence identity of 75.1
  misc_feature: SWISSPROT Homolog: RSP31_ARATH Arginine/serine-rich splicing factor RSP31 with e-value of 3.0e-74 and BLAST sequence identity of 57.0
  misc_feature: SWISSPROT Homolog: SFRS4_MOUSE Splicing factor, arginine/serine-rich 4 with e-value of 3.8e-26 and BLAST sequence identity of 30.2
  misc_feature: SWISSPROT Homolog: SFRS4_HUMAN Splicing factor, arginine/serine-rich 4 (Pre-mRNA-splicing factor SRP75) (SRP001LB) with e-value of 4.0e-26 and BLAST sequence identity of 29.5
  misc_feature 379945:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(401): Functional Homolog of  Ceres CLONE ID no. 1002819 at SEQ ID NO. 3475 with e-value of 2.09E-111 and BLAST sequence identity of 68.75
MRPIFCGNFEYDARQTELERLFKRYGRVERVDMKSGFAFIYMEDERDAEDAIRGLDRVEFGRKGRRLRVEWTKQERGIRRPGGTSRRSTNTRPSKTLFVINFDPHHTRTKDLERHFEPYGRIVSVRIRRNFAFVQYEAQEDATKALDATNLSKLLDRVISVEYAVRDDDERKDGYSPDRSRDRSPDRRGHDRRRSPSPYRRERGSPDYGRGPSPYRKERGSPDYGRRRSPSPYRRDRASPDYGRGTSRSPYRRERAGSDHGHGPSRSPYRRDKASPVNGSPYRRDKASPVNGHGPSDSPYQREERISPENGRGPSRSPYRRERSNQGHGRGSSHSPYGRERPNPDNGRGSSRSPTERDGDSPENGQLRSPSSIPDERDSPNGGAESPMRGRYRSQSPPADE

SEQ ID NO: 3431 - DNA, 1095 bp, Populus balsamifera subsp. trichocarpa
  misc_feature (1)..(1095): Ceres ANNOT ID no. 1522314
  misc_feature 380112:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgaggtctatcttttgtgggaactttgagtatgatgcaaggcagactgagctagaacggctattcaaacgatatgggagagttgaacgggtggatatgaaagctggatttgcttttatttatatggaagatgagagagatgctgaggatgcaattcgaggacttgatcgtgtagaatttggtcgcaagggccgcagacttcatgttgaatggacaaagcaagaacgtggggctagacagcctggtggctcatcaagaaaatctgctaacacaaggccatctaagactttatttgttatcaactttgaccctcatcatactaggactaaggatttggagaggcactttgagccatatgggaggatagtgagtgtaaggataagaagaaattttgcatttgttcagtatgaagcacaggaggatgccactaaagcactggatgcaacaaacatgagcaagctgctgtatcgagttatttcagtggaatatgctgctcgagatgatggtgaaaggaaggatggacacagtcctgatagaagtcgtgataggtcacctgataggcgaggacatgataggaggcgttctccaagtccttaccgaagagaaaggggaagcactgattatggccatggccctagtccttatcgcaaagagagggttagcccagattctggatgtcgccgcagccctagcccctataggagagatagggctagccctgactatggccggggttcaactcgtagtccttccaggagagagagggctggcagtgaccatggccatggccccagccgtggtccttaccgcaaggacaaggctagtcctgtcaatggtaatggccctagtgatagtccttatcaaagggaagaaaagcttagccctgaaaatggtcgtgtcccgagccgtagtccatatggaagagaaaggcctaacccagacaaaggccgtacctccagccatagtccctctgaaagagatgggtctagccctgaaaatggtcaatggagaagcccaagctccaatcctgacaagagggacagtgcaattggaagagttgaaagccctagacatgagagataccacaggatctag

SEQ ID NO: 3432 - protein, 364 aa, Populus balsamifera subsp. trichocarpa
  misc_feature (1)..(364): Ceres ANNOT ID no. 1522314
  misc_feature (97)..(161): Pfam Name: RRM_1 Pfam Description: RNA recognition motif. (a.k.a. RRM RBD, or RNP domain)
  misc_feature: SWISSPROT Homolog: RSP41_ARATH Arginine/serine-rich splicing factor RSP41 with e-value of 3.4e-192 and BLAST sequence identity of 99.7
  misc_feature: SWISSPROT Homolog: RSP40_ARATH Arginine/serine-rich splicing factor RSP40 with e-value of 1.1e-133 and BLAST sequence identity of 75.1
  misc_feature: SWISSPROT Homolog: RSP31_ARATH Arginine/serine-rich splicing factor RSP31 with e-value of 3.0e-74 and BLAST sequence identity of 57.0
  misc_feature: SWISSPROT Homolog: SFRS4_MOUSE Splicing factor, arginine/serine-rich 4 with e-value of 3.8e-26 and BLAST sequence identity of 30.2
  misc_feature: SWISSPROT Homolog: SFRS4_HUMAN Splicing factor, arginine/serine-rich 4 (Pre-mRNA-splicing factor SRP75) (SRP001LB) with e-value of 4.0e-26 and BLAST sequence identity of 29.5
  misc_feature 380274:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(364): Functional Homolog of  Ceres CLONE ID no. 1002819 at SEQ ID NO. 3475 with e-value of 4.99E-103 and BLAST sequence identity of 69.9
MRSIFCGNFEYDARQTELERLFKRYGRVERVDMKAGFAFIYMEDERDAEDAIRGLDRVEFGRKGRRLHVEWTKQERGARQPGGSSRKSANTRPSKTLFVINFDPHHTRTKDLERHFEPYGRIVSVRIRRNFAFVQYEAQEDATKALDATNMSKLLYRVISVEYAARDDGERKDGHSPDRSRDRSPDRRGHDRRRSPSPYRRERGSTDYGHGPSPYRKERVSPDSGCRRSPSPYRRDRASPDYGRGSTRSPSRRERAGSDHGHGPSRGPYRKDKASPVNGNGPSDSPYQREEKLSPENGRVPSRSPYGRERPNPDKGRTSSHSPSERDGSSPENGQWRSPSSNPDKRDSAIGRVESPRHERYHRI

SEQ ID NO: 3433 - DNA, 828 bp, Populus balsamifera subsp. trichocarpa
  misc_feature (1)..(828): Ceres ANNOT ID no. 1497147
  misc_feature 380432:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgaaggctatattttgcggcaatcttgattacgacgcgcgccagtctgatgtcgagcgtctttttagaagatatgggaggattgatagggtggatatgaagtctggatttgcttttgtctatatggaggatgaaagagatgccgaggatgccatccgtaggcttgaccaaacagaatttgggagaaaaggacgtcgtctacgtgttgagtggactaagcaagaacgtgacagtaagcctgctggttcaagaagatcatcagctaatatgactccatcaaaaactttgtttgtcattaattttgatccaattcatacccgaactagggatctggagaggcactttgatccttatggaaaaatattgagcacaaggattaggaggaattttgcattcgttcagtatgagttacaggaagatgctactaaggcattggaagcaactaatatgagcaagttgatggaccgggtcatttcagtggaatatgctgctcgagatgatgatgaaagaaggaacgggtacagtcctgagagaagaggccgtgacagatctcctgacagaaattatagtcgtgaacgatccccaagtccatatcgtagagataggggtagcccagactacggccatggacagaatacaaatgccagacctcaaagaggaaatcatgcttatgaaaaagctgaagccgttccccaccatctcgggaaaggtcacgctcttgagaaaaagcagaagagattttggtgcgatctttctcaagtcacattcttggtcctagtgcggttctggatgagtgcaaataaagctgggacttggaatgttgaatag

SEQ ID NO: 3434 - protein, 275 aa, Populus balsamifera subsp. trichocarpa
  misc_feature (1)..(275): Ceres ANNOT ID no. 1497147
  misc_feature (96)..(160): Pfam Name: RRM_1 Pfam Description: RNA recognition motif. (a.k.a. RRM RBD, or RNP domain)
  misc_feature: SWISSPROT Homolog: RSP41_ARATH Arginine/serine-rich splicing factor RSP41 with e-value of 3.4e-192 and BLAST sequence identity of 99.7
  misc_feature: SWISSPROT Homolog: RSP40_ARATH Arginine/serine-rich splicing factor RSP40 with e-value of 1.1e-133 and BLAST sequence identity of 75.1
  misc_feature: SWISSPROT Homolog: RSP31_ARATH Arginine/serine-rich splicing factor RSP31 with e-value of 3.0e-74 and BLAST sequence identity of 57.0
  misc_feature: SWISSPROT Homolog: SFRS4_MOUSE Splicing factor, arginine/serine-rich 4 with e-value of 3.8e-26 and BLAST sequence identity of 30.2
  misc_feature: SWISSPROT Homolog: SFRS4_HUMAN Splicing factor, arginine/serine-rich 4 (Pre-mRNA-splicing factor SRP75) (SRP001LB) with e-value of 4.0e-26 and BLAST sequence identity of 29.5
  misc_feature 380584:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(275): Functional Homolog of  Ceres CLONE ID no. 1002819 at SEQ ID NO. 3475 with e-value of 1.09E-84 and BLAST sequence identity of 71.8
MKAIFCGNLDYDARQSDVERLFRRYGRIDRVDMKSGFAFVYMEDERDAEDAIRRLDQTEFGRKGRRLRVEWTKQERDSKPAGSRRSSANMTPSKTLFVINFDPIHTRTRDLERHFDPYGKILSTRIRRNFAFVQYELQEDATKALEATNMSKLMDRVISVEYAARDDDERRNGYSPERRGRDRSPDRNYSRERSPSPYRRDRGSPDYGHGQNTNARPQRGNHAYEKAEAVPHHLGKGHALEKKQKRFWCDLSQVTFLVLVRFWMSANKAGTWNVE

SEQ ID NO: 3435 - DNA, 750 bp, Populus balsamifera subsp. trichocarpa
  misc_feature (1)..(750): Ceres ANNOT ID no. 1471045
  misc_feature 380727:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgaaggctatattttgcgggaatcttgattatgacgcgcggcagtctgatttggagcgtctttttagaagatatgggagaattgatagggtggatatgaagtctggatttgcttttgtctatatggaggatgaaagagatgctgaggatgctatccgtaggcttgaccgagctgaatttgggagaaaagggcgccgtcttcgtgttgagtggactaagcaagaacgtgaaagtagaaggcctgctggttcaagaagatcatcgactaacacgactccatcaaaaactttgtttgtcattaattttgatccagttcatacccgaactagggatctggagaggcactttgatcctcatggaaaaatattgagcacaaggattaggagaaattttgcgttcgttcagtatgaattacaggaagatgctactaaggcattggaggcaactgacatgagcaagttcatggatcgggtcatttcggtggaatatgctgctcgagatgatgaaagaaggaatggttacagtcctgagagaagagatcgtgacagatctcctgacagaaactataatcgtgaacgatccccgagtccagatcgtagagataggggcagcccggactacggtcatagatcaaaaactaattccagacctgaaccaagaggaaatcataattacgataaagctgaaagtcctgaaaatgaaagataccgcagccgtaccccaccatctcgagaaaggtctcgttcttga

SEQ ID NO: 3436 - protein, 249 aa, Populus balsamifera subsp. trichocarpa
  misc_feature (1)..(249): Ceres ANNOT ID no. 1471045
  misc_feature (4)..(69): Pfam Name: RRM_1 Pfam Description: RNA recognition motif. (a.k.a. RRM RBD, or RNP domain)
  misc_feature: SWISSPROT Homolog: RSP41_ARATH Arginine/serine-rich splicing factor RSP41 with e-value of 3.4e-192 and BLAST sequence identity of 99.7
  misc_feature: SWISSPROT Homolog: RSP40_ARATH Arginine/serine-rich splicing factor RSP40 with e-value of 1.1e-133 and BLAST sequence identity of 75.1
  misc_feature: SWISSPROT Homolog: RSP31_ARATH Arginine/serine-rich splicing factor RSP31 with e-value of 3.0e-74 and BLAST sequence identity of 57.0
  misc_feature: SWISSPROT Homolog: SFRS4_MOUSE Splicing factor, arginine/serine-rich 4 with e-value of 3.8e-26 and BLAST sequence identity of 30.2
  misc_feature: SWISSPROT Homolog: SFRS4_HUMAN Splicing factor, arginine/serine-rich 4 (Pre-mRNA-splicing factor SRP75) (SRP001LB) with e-value of 4.0e-26 and BLAST sequence identity of 29.5
  misc_feature 380877:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(249): Functional Homolog of  Ceres CLONE ID no. 1002819 at SEQ ID NO. 3475 with e-value of 1.39E-82 and BLAST sequence identity of 66.9
MKAIFCGNLDYDARQSDLERLFRRYGRIDRVDMKSGFAFVYMEDERDAEDAIRRLDRAEFGRKGRRLRVEWTKQERESRRPAGSRRSSTNTTPSKTLFVINFDPVHTRTRDLERHFDPHGKILSTRIRRNFAFVQYELQEDATKALEATDMSKFMDRVISVEYAARDDERRNGYSPERRDRDRSPDRNYNRERSPSPDRRDRGSPDYGHRSKTNSRPEPRGNHNYDKAESPENERYRSRTPPSRERSRS

SEQ ID NO: 3437 - protein, 119 aa, Arabidopsis thaliana
  misc_feature (1)..(119): Ceres CLONE ID no. 1006934
  misc_feature (2)..(119): Pfam Name: GATase_2 Pfam Description: Glutamine amidotransferases class-II
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
MCGIFAYLNFHANKERRYILDVLFNGLRRLEYRGYDSAGIAIDNSSPSSSPLVFRQAGNIESLVNSVNEEITNTDLNLDEVFYFHAGIAHTRWATHGEPAPRNSHPQSSGPGDDFLVVH

SEQ ID NO: 3438 - DNA, 2007 bp, Populus balsamifera subsp. trichocarpa
  misc_feature (1)..(2007): Ceres ANNOT ID no. 1532963
  misc_feature 381115:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atgtgtgggatatttgcgtatttgaattacaacgtcaatagggagaggagatttattctccaaattctcttcaacggactcaggcgtcttgaatatagaggatatgattccgccggggtttccattgatcacaaccaacctcttgttttccgtcaggaaggaaacatcgaatcccttgtcaaatctgtctatcaagatttggaagaatccttttgtgtccatgctggaatagcacacacccgctgggctactcatggagagcctgctccaaggaatagccatccacaaacatctggtgatggaaatgaattccttgttgttcacaatggcgtcataactaattatcaggtgttaaaggaaacacttattcgacatgggttcacctttgaatctgaaaccgacacagaagtaataccaaagcttgcaaaatttgtctttgacaaagcaaatgaaggagaaggttctcatactgtcacatttagtgaagttgtgcttgaagtcatgaggcatcttgaaggagcctatgccctcatttttaagagcctacattatccaaatgagttaattgcatgcaaacgtggaagtccattgctcttgggtgttaaagaattaaatgaagagtttaacagcggaccaacatttcatgattctaaattcctctcaaataatgaccatccaaaagagctgtttctgtccagtgatgctcatgctattgttgagcacacaaaaaaggtcttggtgattgaggatggtgaagtagttcatcttaaggatggaaatgtgtcaatcctgaagtttgacaatgacaagggaagacatggaggttccctctctagacctgcatcagtgcaacgtgcattatctgttcttgagatggaagttgaacaaataaacaaaggaaactatgaacattacatgcagaaagaaatccatgaacagccagaatctctaaaaaccaccatgagggggaggcttatacgtggaggctcctgcaaagccaagactgttcttttaggtggactcaaggatcactttaaaacaattagaaggagtcgacgtattgttttcattggttgtggtacaagctataatgctgctctagctgctagacccatcctggaagaactttctggtgtccctgtcactatggaaattgcaagtgatctgttggatcgtcaaggtcctatatacagagaagatacagcagtctttgtcagccagtctggtgaaactgcagatacattaaatgcgttggaatatgctttagaaaatggtgcattgtgtgtaggcataacaaacactgttggcagtgcaatagctaggcgtacacattgtggtgttcatataaatgcaggcgccgaaataggcgtggcaagcaccaaggcatacacaagtcagatagtagtgatggccatgttagccctagcaatcggaggtgatgcaatttctagtcaaacgagaagagaggctataatagatggtctatttgacttgccaaacaaggtcagggaggtcctgaagcttgaccaggaaatgaaggatcttgcaaaacttttgattgcggagcagtctcttcttgtgtttgggagaggttacaactatgcaacggctttggagggtgccttaaaggttaaggaagtagcacttatgcacagtgaaggaatgcttgctggtgaaatgaaacatggtcctttggcattagttgatgagaatcttactattattgtcattgctactcgcgattcctgcttcagcaagcaacagtcagtcattcagcaacttcatgcccgcaaaggtcgcttaatagtcatgtgttcaaaaggtgatgctgtgtctgcatgccctggaggatttggtagagtaattgaagttccacaggttgaggattgtcttcaacctgtaattaatatagttcctttgcagttactggcatatcatctgactgttctaaggggttacaatgttgaccagccacgcaatctggcgaagagcgtgacgacacagtaa

SEQ ID NO: 3439 - protein, 668 aa, Populus balsamifera subsp. trichocarpa
  misc_feature (1)..(668): Ceres ANNOT ID no. 1532963
  misc_feature (2)..(235): Pfam Name: GATase_2 Pfam Description: Glutamine amidotransferases class-II
  misc_feature (516)..(654): Pfam Name: SIS Pfam Description: SIS domain
  misc_feature: SWISSPROT Homolog: GFA1_YEAST Glucosamine--fructose-6-phosphate aminotransferase [isomerizing] with e-value of 5.4e-27 and BLAST sequence identity of 51.7
  misc_feature: SWISSPROT Homolog: GFA1_YEAST EC 2.6.1.16 (Hexosephosphate aminotransferase) D-fructose-6-phosphate amidotransferase (GFAT)
  misc_feature: SWISSPROT Homolog: GFPT1_HUMAN Glucosamine--fructose-6-phosphate aminotransferase [isomerizing] 1 with e-value of 1.1e-26 and BLAST sequence identity of 50.4
  misc_feature: SWISSPROT Homolog: GFPT1_HUMAN EC 2.6.1.16 (Hexosephosphate aminotransferase 1) (D- fructose-6-phosphate amidotransferase 1) (GFAT 1) (GFAT1)
  misc_feature: SWISSPROT Homolog: GFPT1_MOUSE Glucosamine--fructose-6-phosphate aminotransferase [isomerizing] 1 with e-value of 1.4e-26 and BLAST sequence identity of 50.4
  misc_feature: SWISSPROT Homolog: GFPT1_MOUSE EC 2.6.1.16 (Hexosephosphate aminotransferase 1) (D- fructose-6-phosphate amidotransferase 1) (GFAT 1) (GFAT1)
  misc_feature: SWISSPROT Homolog: GFA1_SCHPO Probable glucosamine--fructose-6-phosphate aminotransferase [ isomerizing] with e-value of 9.3e-25 and BLAST sequence identity of 45.8
  misc_feature: SWISSPROT Homolog: GFA1_SCHPO EC 2.6.1.16) (Hexosephosphate aminotransferase) (D- fructose-6-phosphate amidotransferase) (GFAT)
  misc_feature: SWISSPROT Homolog: GFPT2_HUMAN Probable glucosamine--fructose-6-phosphate aminotransferase [ isomerizing] with e-value of 8.3e-24 and BLAST sequence identity of 47.1
  misc_feature: SWISSPROT Homolog: GFPT2_HUMAN EC 2.6.1.16 (Hexosephosphate aminotransferase 2) (D- fructose-6-phosphate amidotransferase 2) (GFAT 2) (GFAT2)
  misc_feature 381345:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(668): Functional Homolog of  Ceres CLONE ID no. 1006934 at SEQ ID NO. 3484 with e-value of 4.40E-40 and BLAST sequence identity of 76.8
MCGIFAYLNYNVNRERRFILQILFNGLRRLEYRGYDSAGVSIDHNQPLVFRQEGNIESLVKSVYQDLEESFCVHAGIAHTRWATHGEPAPRNSHPQTSGDGNEFLVVHNGVITNYQVLKETLIRHGFTFESETDTEVIPKLAKFVFDKANEGEGSHTVTFSEVVLEVMRHLEGAYALIFKSLHYPNELIACKRGSPLLLGVKELNEEFNSGPTFHDSKFLSNNDHPKELFLSSDAHAIVEHTKKVLVIEDGEVVHLKDGNVSILKFDNDKGRHGGSLSRPASVQRALSVLEMEVEQINKGNYEHYMQKEIHEQPESLKTTMRGRLIRGGSCKAKTVLLGGLKDHFKTIRRSRRIVFIGCGTSYNAALAARPILEELSGVPVTMEIASDLLDRQGPIYREDTAVFVSQSGETADTLNALEYALENGALCVGITNTVGSAIARRTHCGVHINAGAEIGVASTKAYTSQIVVMAMLALAIGGDAISSQTRREAIIDGLFDLPNKVREVLKLDQEMKDLAKLLIAEQSLLVFGRGYNYATALEGALKVKEVALMHSEGMLAGEMKHGPLALVDENLTIIVIATRDSCFSKQQSVIQQLHARKGRLIVMCSKGDAVSACPGGFGRVIEVPQVEDCLQPVINIVPLQLLAYHLTVLRGYNVDQPRNLAKSVTTQ

SEQ ID NO: 3440 - protein, 157 aa, Arabidopsis thaliana
  misc_feature (1)..(157): Ceres CLONE ID no. 1007549
  misc_feature (53)..(156): Pfam Name: HSP20 Pfam Description: Hsp20/alpha crystallin family
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MSLIPSIFGGRRTNVFDPFSLDVFDPFEGFLTPSGLANAPAKDVAAFTNAKVDWRETPEAHVFKADLPGLRKEEVKVEVEDGNILQISGERSNENEEKNDKWHRVERSSGKFTRRFRLPENAKMEEIKASMENGVLSVTVPKVPEKKPEVKSIDISG

SEQ ID NO: 3441 - DNA, 489 bp, Populus balsamifera subsp. trichocarpa; identical to SEQ ID NO: 1118
  misc_feature (1)..(489): Ceres ANNOT ID no. 1458198
  misc_feature 381688:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage

SEQ ID NO: 3442 - protein, 162 aa, Populus balsamifera subsp. trichocarpa; identical to SEQ ID NO: 1119
  misc_feature (1)..(162): Ceres ANNOT ID no. 1458198
  misc_feature (58)..(161): Pfam Name: HSP20 Pfam Description: Hsp20/alpha crystallin family
  misc_feature: SWISSPROT Homolog: HSP12_ARATH 17.6 kDa class I heat shock protein (HSP 17.6) with e-value of 2.1e-80 and BLAST sequence identity of 99.4
  misc_feature: SWISSPROT Homolog: HSP11_ARATH 17.4 kDa class I heat shock protein (HSP 17.4) with e-value of 3.5e-73 and BLAST sequence identity of 89.8
  misc_feature: SWISSPROT Homolog: HSP13_ARATH 18.2 kDa class I heat shock protein (HSP 18.2) with e-value of 1.8e-69 and BLAST sequence identity of 84.9
  misc_feature: SWISSPROT Homolog: HSP11_DAUCA 17.8 kDa class I heat shock protein (Clone DCHSP17.7) with e-value of 4.8e-60 and BLAST sequence identity of 72.6
  misc_feature: SWISSPROT Homolog: HSP12_MEDSA 18.2 kDa class I heat shock protein with e-value of 1.5e-58 and BLAST sequence identity of 71.5
  misc_feature 381853:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(162): Functional Homolog of  Ceres CLONE ID no. 1007549 at SEQ ID NO. 3487 with e-value of 5.80E-61 and BLAST sequence identity of 75.7

SEQ ID NO: 3443 - DNA, 480 bp, Populus balsamifera subsp. trichocarpa
  misc_feature (1)..(480): Ceres ANNOT ID no. 1439989
  misc_feature 381996:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atggcatccctcattcctagcttcttcggcagccgaaagaccaacgtgttcgatccattttctctcgacatttgggatcctttcgaggacctcttctcttctacactggccaatgttcctgcctcaactggcgaaacatcagcttttgtcaatgcaagaatcgattggaaagagactccagaagctcacgttttcaaagctgaccttccggggctaaagaaagaggaggtcaaagtggaggtggaagagggtagaatcctgcaaatcagtggagagaggagcaaagaacaggagggaaaaaatgataagtggcatcgaattgagaggagcagcggcaagtttttacgcaggttcaggttgcctgggaacgcaaagatggatcaagtgaaagccagcatggagaatggagtgcttactgtgactattcccaaggcagaggaaaagaaggccgaggtcaaggccattgagatttcaggctaa

SEQ ID NO: 3444 - protein, 159 aa, Populus balsamifera subsp. trichocarpa
  misc_feature (1)..(159): Ceres ANNOT ID no. 1439989
  misc_feature (55)..(158): Pfam Name: HSP20 Pfam Description: Hsp20/alpha crystallin family
  misc_feature: SWISSPROT Homolog: HSP12_ARATH 17.6 kDa class I heat shock protein (HSP 17.6) with e-value of 2.1e-80 and BLAST sequence identity of 99.4
  misc_feature: SWISSPROT Homolog: HSP11_ARATH 17.4 kDa class I heat shock protein (HSP 17.4) with e-value of 3.5e-73 and BLAST sequence identity of 89.8
  misc_feature: SWISSPROT Homolog: HSP13_ARATH 18.2 kDa class I heat shock protein (HSP 18.2) with e-value of 1.8e-69 and BLAST sequence identity of 84.9
  misc_feature: SWISSPROT Homolog: HSP11_DAUCA 17.8 kDa class I heat shock protein (Clone DCHSP17.7) with e-value of 4.8e-60 and BLAST sequence identity of 72.6
  misc_feature: SWISSPROT Homolog: HSP12_MEDSA 18.2 kDa class I heat shock protein with e-value of 1.5e-58 and BLAST sequence identity of 71.5
  misc_feature 382161:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(159): Functional Homolog of  Ceres CLONE ID no. 1007549 at SEQ ID NO. 3487 with e-value of 2.49E-60 and BLAST sequence identity of 75.4
MASLIPSFFGSRKTNVFDPFSLDIWDPFEDLFSSTLANVPASTGETSAFVNARIDWKETPEAHVFKADLPGLKKEEVKVEVEEGRILQISGERSKEQEGKNDKWHRIERSSGKFLRRFRLPGNAKMDQVKASMENGVLTVTIPKAEEKKAEVKAIEISG

SEQ ID NO: 3445 - DNA, 489 bp, Populus balsamifera subsp. trichocarpa
  misc_feature (1)..(489): Ceres ANNOT ID no. 1464789
  misc_feature 382301:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgtctcttatcccaagcaccctctttggtggccgaagaagtaacatctttgatcctttctctcttgacatctgggaccctttccaggactttcccttcactagcacagccatatcagccccacgatcagagttcgccaacgaaacaacggcatttgccaacacacgcatagactggaaggagacccccgaggctcacgttttcaaggctgatctcccaggcctgaagaaagaggaagtcaaagtggagttagaggaaggcagggttttgcaaataagtggagagagaagcaaagagagagaagagaaaaatgacaagtggcatagagtggagaggtcaagtgggaagttcttaaggagattcaggttgcctgagaatgcaaaacttgatcaacttaaggctaatatggaaaacggggtcttgactgtgactgtgcctaaagaggaagtcaaaaaacctgatgttaaggccatcgagatcaccggctga

SEQ ID NO: 3446 - protein, 162 aa, Populus balsamifera subsp. trichocarpa
  misc_feature (1)..(162): Ceres ANNOT ID no. 1464789
  misc_feature (58)..(161): Pfam Name: HSP20 Pfam Description: Hsp20/alpha crystallin family
  misc_feature: SWISSPROT Homolog: HSP12_ARATH 17.6 kDa class I heat shock protein (HSP 17.6) with e-value of 2.1e-80 and BLAST sequence identity of 99.4
  misc_feature: SWISSPROT Homolog: HSP11_ARATH 17.4 kDa class I heat shock protein (HSP 17.4) with e-value of 3.5e-73 and BLAST sequence identity of 89.8
  misc_feature: SWISSPROT Homolog: HSP13_ARATH 18.2 kDa class I heat shock protein (HSP 18.2) with e-value of 1.8e-69 and BLAST sequence identity of 84.9
  misc_feature: SWISSPROT Homolog: HSP11_DAUCA 17.8 kDa class I heat shock protein (Clone DCHSP17.7) with e-value of 4.8e-60 and BLAST sequence identity of 72.6
  misc_feature: SWISSPROT Homolog: HSP12_MEDSA 18.2 kDa class I heat shock protein with e-value of 1.5e-58 and BLAST sequence identity of 71.5
  misc_feature 382466:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(162): Functional Homolog of  Ceres CLONE ID no. 1007549 at SEQ ID NO. 3487 with e-value of 9.80E-59 and BLAST sequence identity of 71.9
MSLIPSTLFGGRRSNIFDPFSLDIWDPFQDFPFTSTAISAPRSEFANETTAFANTRIDWKETPEAHVFKADLPGLKKEEVKVELEEGRVLQISGERSKEREEKNDKWHRVERSSGKFLRRFRLPENAKLDQLKANMENGVLTVTVPKEEVKKPDVKAIEITG

SEQ ID NO: 3447 - DNA, 471 bp, Populus balsamifera subsp. trichocarpa; identical to SEQ ID NO: 1100
  misc_feature (1)..(471): Ceres ANNOT ID no. 1461728
  misc_feature 382609:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage

SEQ ID NO: 3448 - protein, 156 aa, Populus balsamifera subsp. trichocarpa; identical to SEQ ID NO: 1101
  misc_feature (1)..(156): Ceres ANNOT ID no. 1461728
  misc_feature (51)..(155): Pfam Name: HSP20 Pfam Description: Hsp20/alpha crystallin family
  misc_feature: SWISSPROT Homolog: HSP12_ARATH 17.6 kDa class I heat shock protein (HSP 17.6) with e-value of 2.1e-80 and BLAST sequence identity of 99.4
  misc_feature: SWISSPROT Homolog: HSP11_ARATH 17.4 kDa class I heat shock protein (HSP 17.4) with e-value of 3.5e-73 and BLAST sequence identity of 89.8
  misc_feature: SWISSPROT Homolog: HSP13_ARATH 18.2 kDa class I heat shock protein (HSP 18.2) with e-value of 1.8e-69 and BLAST sequence identity of 84.9
  misc_feature: SWISSPROT Homolog: HSP11_DAUCA 17.8 kDa class I heat shock protein (Clone DCHSP17.7) with e-value of 4.8e-60 and BLAST sequence identity of 72.6
  misc_feature: SWISSPROT Homolog: HSP12_MEDSA 18.2 kDa class I heat shock protein with e-value of 1.5e-58 and BLAST sequence identity of 71.5
  misc_feature 382772:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(156): Functional Homolog of  Ceres CLONE ID no. 1007549 at SEQ ID NO. 3487 with e-value of 2.70E-56 and BLAST sequence identity of 70.9

SEQ ID NO: 3449 - DNA, 459 bp, Populus balsamifera subsp. trichocarpa; identical to SEQ ID NO: 1108
  misc_feature (1)..(459): Ceres ANNOT ID no. 1479711
  misc_feature 382912:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage

SEQ ID NO: 3450 - protein, 152 aa, Populus balsamifera subsp. trichocarpa; identical to SEQ ID NO: 1109
  misc_feature (1)..(152): Ceres ANNOT ID no. 1479711
  misc_feature (48)..(151): Pfam Name: HSP20 Pfam Description: Hsp20/alpha crystallin family
  misc_feature: SWISSPROT Homolog: HSP12_ARATH 17.6 kDa class I heat shock protein (HSP 17.6) with e-value of 2.1e-80 and BLAST sequence identity of 99.4
  misc_feature: SWISSPROT Homolog: HSP11_ARATH 17.4 kDa class I heat shock protein (HSP 17.4) with e-value of 3.5e-73 and BLAST sequence identity of 89.8
  misc_feature: SWISSPROT Homolog: HSP13_ARATH 18.2 kDa class I heat shock protein (HSP 18.2) with e-value of 1.8e-69 and BLAST sequence identity of 84.9
  misc_feature: SWISSPROT Homolog: HSP11_DAUCA 17.8 kDa class I heat shock protein (Clone DCHSP17.7) with e-value of 4.8e-60 and BLAST sequence identity of 72.6
  misc_feature: SWISSPROT Homolog: HSP12_MEDSA 18.2 kDa class I heat shock protein with e-value of 1.5e-58 and BLAST sequence identity of 71.5
  misc_feature 383075:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(152): Functional Homolog of  Ceres CLONE ID no. 1007549 at SEQ ID NO. 3487 with e-value of 3.60E-52 and BLAST sequence identity of 67.7

SEQ ID NO: 3451 - DNA, 429 bp, Populus balsamifera subsp. trichocarpa
  misc_feature (1)..(429): Ceres ANNOT ID no. 1440649
  misc_feature 383215:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgtcactcatttcccagctttgtgttgatgagatttttgaccccttcctttcaatgatcaacaaatgtcctgtccttaacaccccaacagattggaaagagatcccagatgctcatatattcgtatccgatcttccaggactaaagaaagaagaagtgacggtagaagtggtagatgaagggaaggtgcttcaaataagcggagacaggaaaaatgaggaaattagcgaggataacaaaactgataagtggcaccatgttgagcgttgccgtggtaagttccttaggaggtttaggctaccaggaaatgcaaagtctgatgaagtaaaggcgtctatggataatggagtgcttgtagtgactgttcctaaacaggaagtcaagaagccagagaagaaggtgattgagattgaggaaataaagggttga

SEQ ID NO: 3452 - protein, 142 aa, Populus balsamifera subsp. trichocarpa
  misc_feature (1)..(142): Ceres ANNOT ID no. 1440649
  misc_feature (31)..(138): Pfam Name: HSP20 Pfam Description: Hsp20/alpha crystallin family
  misc_feature: SWISSPROT Homolog: HSP12_ARATH 17.6 kDa class I heat shock protein (HSP 17.6) with e-value of 2.1e-80 and BLAST sequence identity of 99.4
  misc_feature: SWISSPROT Homolog: HSP11_ARATH 17.4 kDa class I heat shock protein (HSP 17.4) with e-value of 3.5e-73 and BLAST sequence identity of 89.8
  misc_feature: SWISSPROT Homolog: HSP13_ARATH 18.2 kDa class I heat shock protein (HSP 18.2) with e-value of 1.8e-69 and BLAST sequence identity of 84.9
  misc_feature: SWISSPROT Homolog: HSP11_DAUCA 17.8 kDa class I heat shock protein (Clone DCHSP17.7) with e-value of 4.8e-60 and BLAST sequence identity of 72.6
  misc_feature: SWISSPROT Homolog: HSP12_MEDSA 18.2 kDa class I heat shock protein with e-value of 1.5e-58 and BLAST sequence identity of 71.5
  misc_feature 383378:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(142): Functional Homolog of  Ceres CLONE ID no. 1007549 at SEQ ID NO. 3487 with e-value of 1.30E-33 and BLAST sequence identity of 61.7
MSLISQLCVDEIFDPFLSMINKCPVLNTPTDWKEIPDAHIFVSDLPGLKKEEVTVEVVDEGKVLQISGDRKNEEISEDNKTDKWHHVERCRGKFLRRFRLPGNAKSDEVKASMDNGVLVVTVPKQEVKKPEKKVIEIEEIKG

SEQ ID NO: 3453 - DNA, 468 bp, Populus balsamifera subsp. trichocarpa
  misc_feature (1)..(468): Ceres ANNOT ID no. 1464547
  misc_feature 383515:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgtctctccttcactctctcttgaaccaaaacagcttgtttgatccatctcggggtttcttgatcgaaaactcagagacccaaatggactggaaggaaactcctcacgcccatgtattcgagatcgatcttcccggccttacaaaagaggacgtgaagattgaagttcatgaggggacagtgcttcaaataagtactgcagagagaaaagaagaagccgaggagaaaggagagaagtggcactgcaaagagaggtcacgtggtgggttttcaaggaggtttcggttgcccgaaaatgctaaacttgatgagattaaggcgtcaatgcatgatggggttcttgtggtgacagtgcctaaagatgaactgaaaacgaagcctaaaaacaaggccgtagaaatctctggagatgatggtgaaaaacatgtttccaggggattaggtcgttttgtttgctgcaaggcttaa

SEQ ID NO: 3454 - protein, 155 aa, Populus balsamifera subsp. trichocarpa
  misc_feature (1)..(155): Ceres ANNOT ID no. 1464547
  misc_feature (30)..(135): Pfam Name: HSP20 Pfam Description: Hsp20/alpha crystallin family
  misc_feature: SWISSPROT Homolog: HSP12_ARATH 17.6 kDa class I heat shock protein (HSP 17.6) with e-value of 2.1e-80 and BLAST sequence identity of 99.4
  misc_feature: SWISSPROT Homolog: HSP11_ARATH 17.4 kDa class I heat shock protein (HSP 17.4) with e-value of 3.5e-73 and BLAST sequence identity of 89.8
  misc_feature: SWISSPROT Homolog: HSP13_ARATH 18.2 kDa class I heat shock protein (HSP 18.2) with e-value of 1.8e-69 and BLAST sequence identity of 84.9
  misc_feature: SWISSPROT Homolog: HSP11_DAUCA 17.8 kDa class I heat shock protein (Clone DCHSP17.7) with e-value of 4.8e-60 and BLAST sequence identity of 72.6
  misc_feature: SWISSPROT Homolog: HSP12_MEDSA 18.2 kDa class I heat shock protein with e-value of 1.5e-58 and BLAST sequence identity of 71.5
  misc_feature 383678:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(155): Functional Homolog of  Ceres CLONE ID no. 1007549 at SEQ ID NO. 3487 with e-value of 4.29E-33 and BLAST sequence identity of 63.1
MSLLHSLLNQNSLFDPSRGFLIENSETQMDWKETPHAHVFEIDLPGLTKEDVKIEVHEGTVLQISTAERKEEAEEKGEKWHCKERSRGGFSRRFRLPENAKLDEIKASMHDGVLVVTVPKDELKTKPKNKAVEISGDDGEKHVSRGLGRFVCCKA

SEQ ID NO: 3455 - DNA, 462 bp, Populus balsamifera subsp. trichocarpa
  misc_feature (1)..(462): Ceres ANNOT ID no. 1454104
  misc_feature 383818:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgtccatctatggcgaagtgcacaaccctttcaataactttgatgtttgggatccctaccatcatgacaatcactctggagcccctttcgctgcaccacgcccagctttctcctacgaagcaacagtgccccttgttagtaccaagatacactggaaggagactccagaggcacatatgttcagagttgatcttcctgggcttacaaaagatgaagtgaaggtggagttagagcaaggcaatgtcatttgcgtaattggtgaaaagattatcgagaaagaagagaaggccgaccattcgtaccatttggaacgtagtggtggcaagtttgttcgaagctttaggttgcctgagaactcaaaggctaagaacatgaaggcttgtatggaaaatggggtgcttaccatcacagttcccaagaaggacatgaataagacctccagactcatccacgttggatga

SEQ ID NO: 3456 - protein, 153 aa, Populus balsamifera subsp. trichocarpa
  misc_feature (1)..(153): Ceres ANNOT ID no. 1454104
  misc_feature (51)..(153): Pfam Name: HSP20 Pfam Description: Hsp20/alpha crystallin family
  misc_feature: SWISSPROT Homolog: HSP12_ARATH 17.6 kDa class I heat shock protein (HSP 17.6) with e-value of 2.1e-80 and BLAST sequence identity of 99.4
  misc_feature: SWISSPROT Homolog: HSP11_ARATH 17.4 kDa class I heat shock protein (HSP 17.4) with e-value of 3.5e-73 and BLAST sequence identity of 89.8
  misc_feature: SWISSPROT Homolog: HSP13_ARATH 18.2 kDa class I heat shock protein (HSP 18.2) with e-value of 1.8e-69 and BLAST sequence identity of 84.9
  misc_feature: SWISSPROT Homolog: HSP11_DAUCA 17.8 kDa class I heat shock protein (Clone DCHSP17.7) with e-value of 4.8e-60 and BLAST sequence identity of 72.6
  misc_feature: SWISSPROT Homolog: HSP12_MEDSA 18.2 kDa class I heat shock protein with e-value of 1.5e-58 and BLAST sequence identity of 71.5
  misc_feature 383981:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: CAULINE LEAVES - Large Useful for making plants with increased biomass and foliage
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Strong Useful for making stronger plants
  misc_feature: Phenotype: INFLORESCENCE - Short Useful for modulating plant height
  misc_feature: Phenotype: ROSETTE LEAVES - Lanceolate Shaped Useful for making plants with increased biomass and foliage
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(153): Functional Homolog of  Ceres CLONE ID no. 1007549 at SEQ ID NO. 3487 with e-value of 1.09E-29 and BLAST sequence identity of 54.5
MSIYGEVHNPFNNFDVWDPYHHDNHSGAPFAAPRPAFSYEATVPLVSTKIHWKETPEAHMFRVDLPGLTKDEVKVELEQGNVICVIGEKIIEKEEKADHSYHLERSGGKFVRSFRLPENSKAKNMKACMENGVLTITVPKKDMNKTSRLIHVG

SEQ ID NO: 3457 - protein, 147 aa, Arabidopsis thaliana
  misc_feature (1)..(147): Ceres CLONE ID no. 1007869
  misc_feature (19)..(83): Pfam Name: AP2 Pfam Description: AP2 domain
  misc_feature (94)..(94): Xaa is any aa, unknown, or other
MEEKPKKAIPVTETAVKAKHYRGVRQRPWGKFAAEIRDPAKNGARVWLGTFETAEDAALAYDIAAFRMRGSRALLNFPLRVNSGEPDPVRITSXRSSSSSSSSSSSTSSSENGKLKRRRKAENLTSEVVQVKCEVGDETRVDELLVS

SEQ ID NO: 3458 - DNA, 843 bp, Populus balsamifera subsp. trichocarpa
  misc_feature (1)..(843): Ceres ANNOT ID no. 1446840
  misc_feature 384177:<222: Transcription Factor
atgtacgggcagagcttacttgatcagcccgattatgcctttcttgatcccgttcgcttgcatttgcaaggcgaaactgtttctactgctcccaccactacttgcagctacactccagcaattacaacgacgacggctgctccagctgctaattatactccaccccttgtttattgcaggagcacaagcttcagcagcttgtatccttgcttaacagaaaactggggagacttgccactcaaggtcgacgattccgaggatatgttcctttatgctgtcctccgcgacgccgtcaccgttgggtgggtcccatcactcaaaaccgatcaactggtgcagcccaatttcccactagtgaaattggaacccacagagaatctggctgtctcgccgccctccacggcggttccagtggctgagcctgcggtgcttccgtccaaggggaagcattaccggggtgtgaggcagcggccttgggggaagttcgcagcggagattagggacccagcgaagaacggggcccgggtttggctggggacgttcgagacggcggaggatgcggcgttggcttacgaccgtgctgcctatagaatgcgtgggtcgagggcgttgttgaatttcccgttgagggtgaattccggtgagcctgatccggttagagtgacttcgaagaggtcttctccggagccatcatcgtcggtggacagcgggtcaccgaagaggaggaagaaggttggtggcacggcgggtgctgctacagtggtggctaaagctgggttggaaattgggaatggggttggatgtcaagtgggtacccatggcgagcaaatgttggttatctag

SEQ ID NO: 3459 - protein, 193 aa, Populus balsamifera subsp. trichocarpa
  misc_feature (1)..(193): Ceres ANNOT ID no. 1446840
  misc_feature (62)..(126): Pfam Name: AP2 Pfam Description: AP2 domain
  misc_feature: SWISSPROT Homolog: ERF2_ARATH Ethylene-responsive transcription factor 2 EREBP-2 (AtERF2) with e-value of 1.9e-72 and BLAST sequence identity of 99.3
  misc_feature: SWISSPROT Homolog: ERF1A_ARATH Ethylene-responsive transcription factor 1A EREBP-1A (AtERF1) with e-value of 6.1e-44 and BLAST sequence identity of 70.1
  misc_feature: SWISSPROT Homolog: ERF2_TOBAC Ethylene-responsive transcription factor 2 EREBP-2 (NtERF2) with e-value of 1.1e-37 and BLAST sequence identity of 57.2
  misc_feature: SWISSPROT Homolog: ERF2_NICSY Ethylene-responsive transcription factor 2 EREBP-2 (NsERF2) with e-value of 4.7e-37 and BLAST sequence identity of 57.2
  misc_feature: SWISSPROT Homolog: ERF1_LYCES Ethylene-responsive transcription factor 1 EREBP-1 (ERF1-like protein) (LeERF1) with e-value of 4.2e-36 and BLAST sequence identity of 73.1
  misc_feature 384271:<222: Transcription Factor
  misc_feature (1)..(193): Functional Homolog of  Ceres CLONE ID no. 1007869 at SEQ ID NO. 3504 with e-value of 1.59E-42 and BLAST sequence identity of 70.0
MFLYAVLRDAVTVGWVPSLKTDQLVQPNFPLVKLEPTENLAVSPPSTAVPVAEPAVLPSKGKHYRGVRQRPWGKFAAEIRDPAKNGARVWLGTFETAEDAALAYDRAAYRMRGSRALLNFPLRVNSGEPDPVRVTSKRSSPEPSSSVDSGSPKRRKKVGGTAGAATVVAKAGLEIGNGVGCQVGTHGEQMLVI

SEQ ID NO: 3460 - DNA, 852 bp, Populus balsamifera subsp. trichocarpa
  misc_feature (1)..(852): Ceres ANNOT ID no. 1486132
  misc_feature 384336:<222: Transcription Factor
atgtacggagagaactttcttgatcagtccgattatgcctttcttgaatctgttcgcatgcatttgctaggcgaacctacttctcctaccactgccagcagctgctttaatccagcaagtactaacagtgcaatgtcagcagcagcagcaaccacccctgctacttgtactccagtccctgtttattgcaggagcacaagcttcagcagcttgtacccttgcttgacagaaaactggggagacttgccactcaaagtcgatgattctgaggatatgttcctttacggtgtcctcagcgacgccgtcaccgttgggtgggtcccatcactcaaaaccgatcaattcattgagcccaatcttccagcggtgaagttagaaccctctgagaacttgacgatatcccctccgcgcacggaggctccgatagctgagccggcggtggttccgtccaaggggaagcattaccggggtgtgaggcagcggccgtgggggaagttcgcggcggagattagggaccctgcgaagaatggggcccgggtttggttggggacattcgagacggcggaggatgcagcgttggcttacgaccgtgctgcctatagaatgcgtgggtcgagggcgttgttgaattttccgttgagggtgaattccggcgagcctgccccggttagagtgacttcgaagaggtcatcgccggagcggtcatcgtcggtggagagtgcgtccctgaagaggaagaaggttggtggcacggcgggcactgctacagtggtgcctcaagctgggttggaaatgaggaatggggttgggtgtcaagtgggtacacatggcgaacaattattggttatctag

SEQ ID NO: 3461 - protein, 239 aa, Populus balsamifera subsp. trichocarpa
  misc_feature (1)..(239): Ceres ANNOT ID no. 1486132
  misc_feature (109)..(173): Pfam Name: AP2 Pfam Description: AP2 domain
  misc_feature: SWISSPROT Homolog: ERF2_ARATH Ethylene-responsive transcription factor 2 EREBP-2 (AtERF2) with e-value of 1.9e-72 and BLAST sequence identity of 99.3
  misc_feature: SWISSPROT Homolog: ERF1A_ARATH Ethylene-responsive transcription factor 1A EREBP-1A (AtERF1) with e-value of 6.1e-44 and BLAST sequence identity of 70.1
  misc_feature: SWISSPROT Homolog: ERF2_TOBAC Ethylene-responsive transcription factor 2 EREBP-2 (NtERF2) with e-value of 1.1e-37 and BLAST sequence identity of 57.2
  misc_feature: SWISSPROT Homolog: ERF2_NICSY Ethylene-responsive transcription factor 2 EREBP-2 (NsERF2) with e-value of 4.7e-37 and BLAST sequence identity of 57.2
  misc_feature: SWISSPROT Homolog: ERF1_LYCES Ethylene-responsive transcription factor 1 EREBP-1 (ERF1-like protein) (LeERF1) with e-value of 4.2e-36 and BLAST sequence identity of 73.1
  misc_feature 384430:<222: Transcription Factor
  misc_feature (1)..(239): Functional Homolog of  Ceres CLONE ID no. 1007869 at SEQ ID NO. 3504 with e-value of 2.70E-40 and BLAST sequence identity of 73.8
MSAAAATTPATCTPVPVYCRSTSFSSLYPCLTENWGDLPLKVDDSEDMFLYGVLSDAVTVGWVPSLKTDQFIEPNLPAVKLEPSENLTISPPRTEAPIAEPAVVPSKGKHYRGVRQRPWGKFAAEIRDPAKNGARVWLGTFETAEDAALAYDRAAYRMRGSRALLNFPLRVNSGEPAPVRVTSKRSSPERSSSVESASLKRKKVGGTAGTATVVPQAGLEMRNGVGCQVGTHGEQLLVI

SEQ ID NO: 3462 - protein, 427 aa, Arabidopsis thaliana
  misc_feature (1)..(427): Ceres CLONE ID no. 1011386
  misc_feature (307)..(383): Pfam Name: Helicase_C Pfam Description: Helicase conserved C-terminal domain
  misc_feature (69)..(239): Pfam Name: DEAD Pfam Description: DEAD/DEAH box helicase
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Tall Useful for making taller plants and plants with longer inflorescences
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
MGDARDNEAYEEELLDYEEEDEKVPDSGNKVNGEAVKKGYVGIHSSGFRDFLLKPELLRAIVDSGFEHPSEVQHECIPQAILGMDVICQAKSGMGKTAVFVLSTLQQIEPSPGQVSALVLCHTRELAYQICNEFVRFSTYLPDTKVSVFYGGVNIKIHKDLLKNECPHIVVGTPGRVLALAREKDLSLKNVRHFILDECDKMLESLDMRRDVQEIFKMTPHDKQVMMFSATLSKEIRPVCKKFMQDPMEIYVDDEAKLTLHGLVQHYIKLSEMEKNRKLNDLLDALDFNQVVIFVKSVSRAAELNKLLVECNFPSICIHSGMSQEERLTRYKSFKEGHKRILVATDLVGRGIDIERVNIVINYDMPDSADTYLHRVGRAGRFGTKGLAITFVASASDSEVLNQVQERFEVDIKELPEQIDTSTYMPS

SEQ ID NO: 3463 - DNA, 1296 bp, Populus balsamifera subsp. trichocarpa
  misc_feature (1)..(1296): Ceres ANNOT ID no. 1531134
  misc_feature 384651:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Tall Useful for making taller plants and plants with longer inflorescences
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
atgggtgaaacaagagacaacgatgcttacgaggaggagcttctcgactacgaagaagaagatgacaaagcacctgactccgtcggagctaaagttaacggcgaagccgttaagaagggatatgttggaattcacagttcgggattcagagacttccttttgaagccagagcttcttcggtccattgttgactcgggttttgagcatccttctgaagtgcaacatgagtgtattccccaagccatcttgggaatggatgtcatctgccaagctaaatctggaatgggaaagactgctgtttttgttctgtctactcttcagcaaattgagcctacctctggacaagttattgcccttgttctatgtcacactagagagttggcataccagatctgtcacgagtttgagaggttcagtacttacttgcccgatacaaaggttgctgttttctatggtggtgtcaatgtcaaaactcacaaagatctactgaaaaatgaatgccctcatgttgttgttggaactcctggaagaatcctggcactggctagagataaagacctttctttgaagaatgtcagacattttatccttgatgaatgtgacaaaatgctggaatcactcgacatgaggagagatgttcaggagatcttcaaattgactcctcatgataagcaagttatgatgttttctgcaacactcagcaaagaaatccgcccagtttgcaaaaaattcatgcaagatccaatggaaatttacgtcgatgatgaagccaagttgaccctccatggtcttgtacagcactacatcaaactgactgagctggagaaaaatcggaagttgaacgatcttcttgatgcattggacttcaatcaagttgttatctttgttaaaagtgtgagcagagcagctgagctgaacaagttactcgtggagtgtaatttcccctctatttgcatccattctggcatgtcacaggaagaaaggttgatgcgctacaagggtttcaaggagggtcataaaaggattcttgttgccactgatttggttggcaggggtattgatattgaacgtgtcaacattgttattaactatgacatgccagactctgctgacacttacttgcacagggttggtagagctggtaggtttggcacaaagggccttgcaattacctttgtatcatcagcttccgactctgatgttctcaaccaggttcaagagaggtttgaggtggatataaaggagctaccggagcagattgatacatctacatatagtagaggtgagatgggctaa

SEQ ID NO: 3464 - protein, 431 aa, Populus balsamifera subsp. trichocarpa
  misc_feature (1)..(431): Ceres ANNOT ID no. 1531134
  misc_feature (308)..(384): Pfam Name: Helicase_C Pfam Description: Helicase conserved C-terminal domain
  misc_feature (70)..(240): Pfam Name: DEAD Pfam Description: DEAD/DEAH box helicase
  misc_feature: SWISSPROT Homolog: DDX39_RAT ATP-dependent RNA helicase DDX39(EC 3.6.1.-)(DEAD box protein 39) (Nuclear RNA helicase, DECD variant of DEAD box family) with e-value of 7.5e-165 and BLAST sequence identity of 72.4
  misc_feature: SWISSPROT Homolog: DDX39_MOUSE ATP-dependent RNA helicase DDX39 (EC 3.6.1.-) (DEAD box protein 39) with e-value of 2.0e-164 and BLAST sequence identity of 72.2
  misc_feature: SWISSPROT Homolog: UAP56_CANFA Spliceosome RNA helicase BAT1 (EC 3.6.1.-) DEAD box protein UAP56 56 kDa U2AF65-associated protein with e-value of 4.1e-164 and BLAST sequence identity of 72.1
  misc_feature: SWISSPROT Homolog: UAP56_HUMAN Spliceosome RNA helicase BAT1 with e-value of 5.3e-164 and BLAST sequence identity of 71.9
  misc_feature: SWISSPROT Homolog: UAP56_HUMAN EC 3.6.1.- (DEAD box protein UAP56) (56 kDa U2AF65-associated protein) (ATP-dependent RNA helicase p47) (HLA-B-associated transcript-1)
  misc_feature: SWISSPROT Homolog: UAP56_MACMU DEAD box protein UAP56 A 56 kDa U2AF65-associated protein with e-value of 5.3e-164 and BLAST sequence identity of 71.9
  misc_feature 384815:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Tall Useful for making taller plants and plants with longer inflorescences
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
  misc_feature (1)..(431): Functional Homolog of  Ceres CLONE ID no. 1011386 at SEQ ID NO. 3509 with e-value of 2.99E-215 and BLAST sequence identity of 94.1
MGETRDNDAYEEELLDYEEEDDKAPDSVGAKVNGEAVKKGYVGIHSSGFRDFLLKPELLRSIVDSGFEHPSEVQHECIPQAILGMDVICQAKSGMGKTAVFVLSTLQQIEPTSGQVIALVLCHTRELAYQICHEFERFSTYLPDTKVAVFYGGVNVKTHKDLLKNECPHVVVGTPGRILALARDKDLSLKNVRHFILDECDKMLESLDMRRDVQEIFKLTPHDKQVMMFSATLSKEIRPVCKKFMQDPMEIYVDDEAKLTLHGLVQHYIKLTELEKNRKLNDLLDALDFNQVVIFVKSVSRAAELNKLLVECNFPSICIHSGMSQEERLMRYKGFKEGHKRILVATDLVGRGIDIERVNIVINYDMPDSADTYLHRVGRAGRFGTKGLAITFVSSASDSDVLNQVQERFEVDIKELPEQIDTSTYSRGEMG

SEQ ID NO: 3465 - DNA, 1605 bp, Populus balsamifera subsp. trichocarpa
  misc_feature (1)..(1605): Ceres ANNOT ID no. 1508758
  misc_feature 384964:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Tall Useful for making taller plants and plants with longer inflorescences
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
atgggagaaacaagagacaacgacacttacgaggaggagcttctagattatgaagaagaagacgagaaagcacctgactccgtcggcgctaaagttaacggcgaagccgttaagaattcgggattcagagatttccttttgaagccagagctgcttaggtctattgtcgactcgggttttgagcatccttctgaagtgcaacatgaatgtatccctcaagccatcttggggatggatgtcatctgccaagctaaatctggaatgggaaagactgcggtttttgttctgtctactcttcagcaaattgagcctacctctggacaagttattgcccttgttctatgtcacactagagagttggcttaccagatctgccacgagtttgagaggttcagtacttacttgcctgacaccaaggttgctgttttctatggtggtgtcaatatcaaaactcacaaggatctactgaaaaatgaatgcccccatattgttgttggaacacccggaagaatcctggcacttgctagagataaggacctttctttgaagaatgtcagacattttatccttgatgaatgtgacaaaatgcttgaatcactcgacatgaggagagatgttcaggagattttcaagatgactcctcatgataagcaggttatgatgttttctgcaacgctcagcaaagaaatccgcccagtttgcaagaaatttatgcaagatccaatggaaatttacgtcgatgatgaagccaagttgaccctccatggtcttgtgcagcactacatcaaactgactgagctggagaaaaacagaaagttaaatgatcttcttgatgcactggacttcaatcaagttgttatctttgttaaaagtgtgagcagagcagctgagctgaacaagttactagtggagtgtaatttcccctccatttgcatacattctggcatgtcacaggaagaaaggttgatgcgctacaagggtttcaaggagggtcataaaaggattcttgttgccactgacttggttggcaggggtattgatattgaacgtgtcaacattgtcattaactatgacatgccagactcagctgacacttacttgcacagggttggcagagctggtaggtttggcacaaaaggccttgcaattacctttgtatcatcagcttcggattctgatgttctcaaccaggttcaagagaggtttgaggtggatataaaggagcttcctgagcaaattgatacatctacatataattctgctttccccgtcagactcttaaaagctagaacgtggacaggctgtggagcatttagcaccagtgtttggaacgttcaagggaaaataatcgcgcccaccacctttcaggcatggaacaactgtcacgcagcttactggataggctttgtaggcgtggccaatctcaatatgcatggatcaggaaccattgatggccagggttcggcatggtggctgaataagcaagctaacaacttagatgtgctatttgcaaaatctttcctgcaattcttttcccagttcatcaagatgtttatcactaaaaactactataaactcattattctattaatcttcaggcaataa

SEQ ID NO: 3466 - protein, 534 aa, Populus balsamifera subsp. trichocarpa
  misc_feature (1)..(534): Ceres ANNOT ID no. 1508758
  misc_feature (301)..(377): Pfam Name: Helicase_C Pfam Description: Helicase conserved C-terminal domain
  misc_feature (466)..(494): Pfam Name: Glyco_hydro_28 Pfam Description: Glycosyl hydrolases family 28
  misc_feature (63)..(233): Pfam Name: DEAD Pfam Description: DEAD/DEAH box helicase
  misc_feature: SWISSPROT Homolog: DDX39_RAT ATP-dependent RNA helicase DDX39(EC 3.6.1.-)(DEAD box protein 39) (Nuclear RNA helicase, DECD variant of DEAD box family) with e-value of 7.5e-165 and BLAST sequence identity of 72.4
  misc_feature: SWISSPROT Homolog: DDX39_MOUSE ATP-dependent RNA helicase DDX39 (EC 3.6.1.-) (DEAD box protein 39) with e-value of 2.0e-164 and BLAST sequence identity of 72.2
  misc_feature: SWISSPROT Homolog: UAP56_CANFA DEAD box protein UAP56 A 56 kDa U2AF65-associated protein with e-value of 4.1e-164 and BLAST sequence identity of 72.1
  misc_feature: SWISSPROT Homolog: UAP56_HUMAN Spliceosome RNA helicase BAT1 with e-value of 5.3e-164 and BLAST sequence identity of 71.9
  misc_feature: SWISSPROT Homolog: UAP56_HUMAN EC 3.6.1.- (DEAD box protein UAP56) (56 kDa U2AF65-associated protein) (ATP-dependent RNA helicase p47) (HLA-B-associated transcript-1)
  misc_feature: SWISSPROT Homolog: UAP56_MACMU DEAD box protein UAP56 A 56 kDa U2AF65-associated protein with e-value of 5.3e-164 and BLAST sequence identity of 71.9
  misc_feature 385144:<222: Transcription Factor
  misc_feature: Phenotype: WHOLE PLANT - Dark Green Useful for increasing chlorophyll and photosynthetic capacity
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Tall Useful for making taller plants and plants with longer inflorescences
  misc_feature: Phenotype: WHOLE PLANT - Yellow-Green Viable 1 Useful for making lethal plants for genetic confinement systems
  misc_feature: Phenotype: INFLORESCENCE - Short Useful for modulating plant height
  misc_feature (1)..(534): Functional Homolog of  Ceres CLONE ID no. 1011386 at SEQ ID NO. 3509 with e-value of 6.90E-209 and BLAST sequence identity of 94.4
MGETRDNDTYEEELLDYEEEDEKAPDSVGAKVNGEAVKNSGFRDFLLKPELLRSIVDSGFEHPSEVQHECIPQAILGMDVICQAKSGMGKTAVFVLSTLQQIEPTSGQVIALVLCHTRELAYQICHEFERFSTYLPDTKVAVFYGGVNIKTHKDLLKNECPHIVVGTPGRILALARDKDLSLKNVRHFILDECDKMLESLDMRRDVQEIFKMTPHDKQVMMFSATLSKEIRPVCKKFMQDPMEIYVDDEAKLTLHGLVQHYIKLTELEKNRKLNDLLDALDFNQVVIFVKSVSRAAELNKLLVECNFPSICIHSGMSQEERLMRYKGFKEGHKRILVATDLVGRGIDIERVNIVINYDMPDSADTYLHRVGRAGRFGTKGLAITFVSSASDSDVLNQVQERFEVDIKELPEQIDTSTYNSAFPVRLLKARTWTGCGAFSTSVWNVQGKIIAPTTFQAWNNCHAAYWIGFVGVANLNMHGSGTIDGQGSAWWLNKQANNLDVLFAKSFLQFFSQFIKMFITKNYYKLIILLIFRQ

SEQ ID NO: 3467 - protein, 358 aa, Arabidopsis thaliana
  misc_feature (1)..(358): Ceres CLONE ID no. 1011537
  misc_feature (99)..(177): Pfam Name: SBP Pfam Description: SBP domain
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
MDWNFKLSSGYLSGFDQEPDLSPMDGSISFGGSSQSKADFSFDLKLGRNIGNSSSVFGDTEQVISLSKWKDSALAKPEGSRSSSSKRTRNGVGTNQMPICLVDGCDSDFSNCREYHKRHKVCDVHSKTPVVTINGHKQRFCQQCSRFHALEEFDEGKRSCRKRLDGHNRRRRKPQPEHIGRPANFFTGFQGSKLLEFSGGSHVFPTTSVLNPSWGNSLVSVAVAANGSSYGQSQSYVVGSSPAKTGIMFPISSSPNSTRSIAKQFPFLQEEESSRTASLCERMTSCIHDSDCALSLLSSSSSSVPHLLQPPLSLSQEAVETVFYGSGLFENACAVSDGSVISGNEAVRLPQTFPFHWE

SEQ ID NO: 3468 - DNA, 1146 bp, Populus balsamifera subsp. trichocarpa
  misc_feature (1)..(1146): Ceres ANNOT ID no. 1473879
  misc_feature 385432:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
atggactggaacttgaaggcaacttcctgggatttgactgaatttgagcaaggagctgttccaagcataagcatagatgcatttgataggtcaactaactttggagttaacaggagtggagggggtttttctattgatttgaaacttggtagggttggtgattcaagtgatgaatctataattaattggaagcagcctggagtctcaaaactacagcccttaccttctggatcaacgaagagagcacgcggagctaacagtggaactcaggtagctatgtgccttgttgatggttgcaattcagacctcagtgcttgtagggactatcacaggcgccataaggtctgtgagcttcattccaagactcctcaggttacagttggcggtcagaagcagcgattctgccaacaatgtagcaggttccattccctggaggaatttgatgaagggaaaagaagctgcaggaaacgtcttgatgggcacaatcggcggcgaaggaagcctcaaccagatccccattctcgtcctccaagttttttatccaattatcaaggtacccaattatttccattctctagttcccatgtatatccatcctctactgtattgaatcccacgtggtcgggagttgctagtactgaggcagatggtaggcaccataatctgcatcaacttcctgacaaacagaacctgttctttggatcatcctcgagcagttaccatggagtgaagcagttcccttttttgcattggcacagccctggccttaacaatcagacatctccggaagcttctgtctgccagccgcttctaagaaccattgctttgccaggaagtagtggggcaagtagccatagtatgttctgtgacaggttaacacaaatacaagactcggattgtgctctctctcttctgtcatcaacacagacgcatgcatccgggaacctcatggtgcaacataattcagtccctttatcgcatcctataggcccaacagtacatgatcatggtttagggccaattgattcagttttggttttcaataacagggatgctaatgtccattttccaggaacgtttcaaccgcagtctggtggttcctctggcaacaaagcccctcaaacacttccatttaactgggagtaa

SEQ ID NO: 3469 - protein, 381 aa, Populus balsamifera subsp. trichocarpa
  misc_feature (1)..(381): Ceres ANNOT ID no. 1473879
  misc_feature (93)..(171): Pfam Name: SBP Pfam Description: SBP domain
  misc_feature: SWISSPROT Homolog: SPL13_ARATH Squamosa promoter-binding-like protein 13 with e-value of 4.9e-193 and BLAST sequence identity of 99.4
  misc_feature: SWISSPROT Homolog: SPL9_ARATH Squamosa promoter-binding-like protein 9 with e-value of 1.2e-32 and BLAST sequence identity of 60.2
  misc_feature: SWISSPROT Homolog: SPL6_ARATH Squamosa promoter-binding-like protein 6 with e-value of 2.2e-32 and BLAST sequence identity of 41.1
  misc_feature: SWISSPROT Homolog: SPL11_ARATH Squamosa promoter-binding-like protein 11 with e-value of 3.6e-30 and BLAST sequence identity of 35.5
  misc_feature: SWISSPROT Homolog: SPL14_ARATH Squamosa promoter-binding-like protein 14 (SPL1-related protein 2) with e-value of 7.7e-30 and BLAST sequence identity of 58.3
  misc_feature 385560:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature (1)..(381): Functional Homolog of  Ceres CLONE ID no. 1011537 at SEQ ID NO. 3514 with e-value of 4.80E-66 and BLAST sequence identity of 49.1
MDWNLKATSWDLTEFEQGAVPSISIDAFDRSTNFGVNRSGGGFSIDLKLGRVGDSSDESIINWKQPGVSKLQPLPSGSTKRARGANSGTQVAMCLVDGCNSDLSACRDYHRRHKVCELHSKTPQVTVGGQKQRFCQQCSRFHSLEEFDEGKRSCRKRLDGHNRRRRKPQPDPHSRPPSFLSNYQGTQLFPFSSSHVYPSSTVLNPTWSGVASTEADGRHHNLHQLPDKQNLFFGSSSSSYHGVKQFPFLHWHSPGLNNQTSPEASVCQPLLRTIALPGSSGASSHSMFCDRLTQIQDSDCALSLLSSTQTHASGNLMVQHNSVPLSHPIGPTVHDHGLGPIDSVLVFNNRDANVHFPGTFQPQSGGSSGNKAPQTLPFNWE

SEQ ID NO: 3470 - DNA, 993 bp, Populus balsamifera subsp. trichocarpa
  misc_feature (1)..(993): Ceres ANNOT ID no. 1468666
  misc_feature 385686:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
atggactggaacttgaaggcaacttcttgggatttgactgaatttgagcaaggagctgttccaagtatttgcatagatgcatttggtaggccaactaactttggagctaacaggactggagggggtttctcaattgatttgaaacttggtagggttggtaattcgagtgatgaatctatggttaactggaagcagcctggagtctcaaaactagagtcttcaccttcaggatcaacgaagagggcacgtggagctaacaatggaactcaggtagctatgtgccttgttgatggttgcaactctgacctcagtacatgcagggactaccataggcgccataaggtctgtgagcttcattccaagactcctcaggttaccattggtggtcagaagcagcgattctgccagcaatgtagccgattccattcgctggaggaatttgacgaagggaaaagaagctgcaggaaacgtcttgatggacacaatcggcggcgaaggaagcctcagccagatcccttttctcatcctccaagtttcttacccaatcaccaaggtacccaaatatttccattctctagttcccatgtatatcattccacagctgtagtgaattccacctggtctggagttgctaatactgaggcagatggagggcactataatctgcatcaacttcctgacaaacagaacctgttccttggatcatcctcgaacagctacaaaggggggaagctgttcccttttttgcaatgtgacaatccttgccttaacaatcagacatcggaagcttctgtttgcctgccgcttccaagagccattgcttttccaggaagcagtggggcaagtagccatagtatgttctgtgacaggttagcaacacaagtacaagactcggattgcgcgctctctctcttctgtcatcaacacagacgcatgcatggggaaaccccatgctgcaacgacataactcagtccccttttcgcatcccatag

SEQ ID NO: 3471 - protein, 330 aa, Populus balsamifera subsp. trichocarpa
  misc_feature (1)..(330): Ceres ANNOT ID no. 1468666
  misc_feature (93)..(171): Pfam Name: SBP Pfam Description: SBP domain
  misc_feature: SWISSPROT Homolog: SPL13_ARATH Squamosa promoter-binding-like protein 13 with e-value of 4.9e-193 and BLAST sequence identity of 99.4
  misc_feature: SWISSPROT Homolog: SPL9_ARATH Squamosa promoter-binding-like protein 9 with e-value of 1.2e-32 and BLAST sequence identity of 60.2
  misc_feature: SWISSPROT Homolog: SPL6_ARATH Squamosa promoter-binding-like protein 6 with e-value of 2.2e-32 and BLAST sequence identity of 41.1
  misc_feature: SWISSPROT Homolog: SPL11_ARATH Squamosa promoter-binding-like protein 11 with e-value of 3.6e-30 and BLAST sequence identity of 35.5
  misc_feature: SWISSPROT Homolog: SPL14_ARATH Squamosa promoter-binding-like protein 14 (SPL1-related protein 2) with e-value of 7.7e-30 and BLAST sequence identity of 58.3
  misc_feature 385808:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature (1)..(330): Functional Homolog of  Ceres CLONE ID no. 1011537 at SEQ ID NO. 3514 with e-value of 1.10E-61 and BLAST sequence identity of 51.6
MDWNLKATSWDLTEFEQGAVPSICIDAFGRPTNFGANRTGGGFSIDLKLGRVGNSSDESMVNWKQPGVSKLESSPSGSTKRARGANNGTQVAMCLVDGCNSDLSTCRDYHRRHKVCELHSKTPQVTIGGQKQRFCQQCSRFHSLEEFDEGKRSCRKRLDGHNRRRRKPQPDPFSHPPSFLPNHQGTQIFPFSSSHVYHSTAVVNSTWSGVANTEADGGHYNLHQLPDKQNLFLGSSSNSYKGGKLFPFLQCDNPCLNNQTSEASVCLPLPRAIAFPGSSGASSHSMFCDRLATQVQDSDCALSLFCHQHRRMHGETPCCNDITQSPFRIP

SEQ ID NO: 3472 - DNA, 1233 bp, Populus balsamifera subsp. trichocarpa
  misc_feature (1)..(1233): Ceres ANNOT ID no. 1438163
  misc_feature 385925:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
atgggctataattttaagactccttgggaattagctgaatcggaaaaacaaagcagtccgtactttactcaaatcactgtgtctagcagcttaagggtacctcaggctaccgggtattgttcagtagacttgaagctcggcaattctggtaatttcaaggacaagtataaggatcccgggggctctttaatggaatcatcttcgtctggatcttcaaagagagctaggacacctaacaatgcaaccctagtcccctcatgcttggttgatggatgcacttctgaccttagcaaatgcagggattaccatcggcgacataaagtatgtgagttccactccaagtcgtctcaggtttttattaaaggccaggaacaacggttttgccagcagtgcagcaggttgactttgccagatgctgccgatagtgtttggcagcttaataacctatgtagttataggcttctagctgtatctttcttattcgcttccataccctcgaggttccattcgttgggggagtttgatgaggggaagcgaagctgcagaaaacgtcttgatggacataatcggcgtcgaaggaagccccagccagattcactttcagtaaattctgcaaggatattttccaaccaaggtactagatatctacaattcggtagctctcaaatattttcaaccagtgctatgagctctgcttggactggagctgcaaaagccgagagggatccaatgctttatactagtcaatcctcaatgaacttcgatggcagaaaaaatctttttcctggttccttgtctcccaactataaaggaggaaagcagttcccctttttacaaggcactagttccacacttcctggagattctatccgtctcaatgccaattccacattaggaaatattggcaacagccagaaaatgttctctgatgggttaaaccgagtcatagactccaaccgtgctctctctcttctgtcatctccaccatctgagactcgggatattggtttgagccacgtagtgcagcctgacctgaaccctcctgctcagtccttgatcccaagcttgaactataataatgctcttggaatggaaagtgagccagtaggacctgtcttagcatctgatggcagcagcaattccaacccccatggtcagcatatgtttcagatcggacctgattggttatctgcaaatggatctcaccagacactttccttctcgtgggagtag

SEQ ID NO: 3473 - protein, 410 aa, Populus balsamifera subsp. trichocarpa
  misc_feature (1)..(410): Ceres ANNOT ID no. 1438163
  misc_feature (86)..(198): Pfam Name: SBP Pfam Description: SBP domain
  misc_feature: SWISSPROT Homolog: SPL13_ARATH Squamosa promoter-binding-like protein 13 with e-value of 4.9e-193 and BLAST sequence identity of 99.4
  misc_feature: SWISSPROT Homolog: SPL9_ARATH Squamosa promoter-binding-like protein 9 with e-value of 1.2e-32 and BLAST sequence identity of 60.2
  misc_feature: SWISSPROT Homolog: SPL6_ARATH Squamosa promoter-binding-like protein 6 with e-value of 2.2e-32 and BLAST sequence identity of 41.1
  misc_feature: SWISSPROT Homolog: SPL11_ARATH Squamosa promoter-binding-like protein 11 with e-value of 3.6e-30 and BLAST sequence identity of 35.5
  misc_feature: SWISSPROT Homolog: SPL14_ARATH Squamosa promoter-binding-like protein 14 (SPL1-related protein 2) with e-value of 7.7e-30 and BLAST sequence identity of 58.3
  misc_feature 386055:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: FLOWER - Sterile Useful for sterility, genetic confinement systems
  misc_feature: Phenotype: INFLORESCENCE - Short Useful for modulating plant height
  misc_feature (1)..(410): Functional Homolog of  Ceres CLONE ID no. 1011537 at SEQ ID NO. 3514 with e-value of 1.50E-39 and BLAST sequence identity of 47.5
MGYNFKTPWELAESEKQSSPYFTQITVSSSLRVPQATGYCSVDLKLGNSGNFKDKYKDPGGSLMESSSSGSSKRARTPNNATLVPSCLVDGCTSDLSKCRDYHRRHKVCEFHSKSSQVFIKGQEQRFCQQCSRLTLPDAADSVWQLNNLCSYRLLAVSFLFASIPSRFHSLGEFDEGKRSCRKRLDGHNRRRRKPQPDSLSVNSARIFSNQGTRYLQFGSSQIFSTSAMSSAWTGAAKAERDPMLYTSQSSMNFDGRKNLFPGSLSPNYKGGKQFPFLQGTSSTLPGDSIRLNANSTLGNIGNSQKMFSDGLNRVIDSNRALSLLSSPPSETRDIGLSHVVQPDLNPPAQSLIPSLNYNNALGMESEPVGPVLASDGSSNSNPHGQHMFQIGPDWLSANGSHQTLSFSWE

SEQ ID NO: 3474 - protein, 451 aa, Arabidopsis thaliana
  misc_feature (1)..(451): Ceres CLONE ID no. 1029167
  misc_feature (229)..(299): Pfam Name: RRM_1 Pfam Description: RNA recognition motif. (a.k.a. RRM RBD, or RNP domain)
  misc_feature: Phenotype: WHOLE PLANT - Small Useful for modulating plant size
  misc_feature: Phenotype: ROSETTE LEAVES - Oval Shaped Useful for making plants with increased biomass and foliage
MTKKRKLESESNETSEPTEKQQQQCEKEDPEIRNVDNQRDDDEQVVEQDTLKEMHEEEAKGEDNIEAETSSGSGNQGNEDDDEEEPIEDLLEPFSKDQLLILLKEAAERHRDVANRIRIVADEDLVHRKIFVHGLGWDTKADSLIDAFKQYGEIEDCKCVVDKVSGQSKGYGFILFKSRSGARNALKQPQKKIGTRMTACQLASIGPVQGNPVVAPAQHFNPENVQRKIYVSNVSADIDPQKLLEFFSRFGEIEEGPLGLDKATGRPKGFALFVYRSLESAKKALEEPHKTFEGHVLHCHKANDGPKQVKQHQHNHNSHNQNSRYQRNDNNGYGAPGGHGHFIAGNNQAVQAFNPAIGQALTALLASQGAGLGLNQAFGQALLGTLGTASPGAVGGMPSGYGTQANISPGVYPGYGAQAGYQGGYQTQQPGQGGAGRGQHGAGYGGPYMGR

SEQ ID NO: 3475 - DNA, 1425 bp, Populus balsamifera subsp. trichocarpa
  misc_feature (1)..(1425): Ceres ANNOT ID no. 1453409
  misc_feature 386310:<222: Transcription Factor
  misc_feature: Phenotype: WHOLE PLANT - Small Useful for modulating plant size
  misc_feature: Phenotype: ROSETTE LEAVES - Oval Shaped Useful for making plants with increased biomass and foliage
atggctagaaaacgaaagctcgactccaaatccaccgaaacagcagaagaaccgccgaagaaacaacagcaacaagaagaaccaccaaaggaagaacctcaagaagaagaagtagaagtagaagaggaggaagaagaagaatatgaagaagtggaagaggaggaagaagataatgaagatgatccagatggagaaaccaatcaaaacgctcagatctcagctgttgagaatctaaacgacgacgatgacgaagacgaggagccgattgagaaacttcttgaaccgtttggaaaagaccagttgattaatttacttcgtgaagcagcggatggtcaccgagatgttgcagataaaatccggcaagtagctgaccaagatccggtgcaccggaagatttttgttcatgggcttggttgggatacgaatgctgaggctttgatcaatgcgtttaagccttatggtgagattgaggactgtaaagctgtgtgcgataaggttacggggaaatcgaagggttatgggtttattttgtttaagaaaaggagtggggcgcggaatgcgttgaaggagccgcagaagaagatagggaataggatggcagcttgtcaattggcttctactggtccggttccacagtccagtgctggaccctctgggccgatcgctgctgctgcgcaaacacagcagccggtttcggagtatacgctgaggaagatttatgtgagtaatgtgggagcaaatttggatcctcagaagctgatgagtttcttttcggagtttggagagattgaagaaggaccattagggcttgataaagcgactgggaaaccgaaagggttttgtttgtttgtttataagacagttgagagtgctaagaaagcgttagaagagccacataagagttttgaagggcacattttgcattgtcagaaagctgttgatgggccaaaacatgcgaaatcgcagaaaccaccacagcaacatcataatatgcaaagctcgcattaccagaggaatgatggaggtgggtatgttgctagtgggggtcgtggtggtcatttaatggccccggctgctgctggtgctgggatcgggtttaatcagagtgctgctgctcctgctttgaaccctgcacttggacaggcgctgaccgcattgcttgccactcagggtgctggactgggagggctcactaatttgcttgggactttggggtctgccgcggctgtgacccagggtggtgtacctagtgcagctcatggaatgcagggtgcctatgggaaccaggcgagcataagtcctggagtgataggagcttatgcgaatcagggagctatgcagggtggatatccaaatcagcagatgggacagggtggttctgggagaggacaacatgggcaatataccccttatatgggtcactag

SEQ ID NO: 3476 - protein, 474 aa, Populus balsamifera subsp. trichocarpa
  misc_feature (1)..(474): Ceres ANNOT ID no. 1453409
  misc_feature (239)..(309): Pfam Name: RRM_1 Pfam Description: RNA recognition motif. (a.k.a. RRM RBD, or RNP domain)
  misc_feature: SWISSPROT Homolog: HNRPD_HUMAN Heterogeneous nuclear ribonucleoprotein D0 (hnRNP D0) (AU-rich element RNA-binding protein 1) with e-value of 3.1e-23 and BLAST sequence identity of 29.2
  misc_feature: SWISSPROT Homolog: HNRPD_MOUSE Heterogeneous nuclear ribonucleoprotein D0 (hnRNP D0) (AU-rich element RNA-binding protein 1) with e-value of 4.4e-23 and BLAST sequence identity of 29.2
  misc_feature: SWISSPROT Homolog: ROA1_CAEEL Heterogeneous nuclear ribonucleoprotein A1 with e-value of 4.5e-23 and BLAST sequence identity of 28.3
  misc_feature: SWISSPROT Homolog: MSI2H_MOUSE RNA-binding protein Musashi homolog 2 (Musashi-2) with e-value of 1.3e-21 and BLAST sequence identity of 28.6
  misc_feature: SWISSPROT Homolog: ROAA_HUMAN Heterogeneous nuclear ribonucleoprotein A/B (hnRNP A/B) (APOBEC-1-binding protein 1) (ABBP-1) with e-value of 1.7e-21 and BLAST sequence identity of 28.3
  misc_feature 386436:<222: Transcription Factor
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature (1)..(474): Functional Homolog of  Ceres CLONE ID no. 1029167 at SEQ ID NO. 3521 with e-value of 3.29E-138 and BLAST sequence identity of 65.3
MARKRKLDSKSTETAEEPPKKQQQQEEPPKEEPQEEEVEVEEEEEEEYEEVEEEEEDNEDDPDGETNQNAQISAVENLNDDDDEDEEPIEKLLEPFGKDQLINLLREAADGHRDVADKIRQVADQDPVHRKIFVHGLGWDTNAEALINAFKPYGEIEDCKAVCDKVTGKSKGYGFILFKKRSGARNALKEPQKKIGNRMAACQLASTGPVPQSSAGPSGPIAAAAQTQQPVSEYTLRKIYVSNVGANLDPQKLMSFFSEFGEIEEGPLGLDKATGKPKGFCLFVYKTVESAKKALEEPHKSFEGHILHCQKAVDGPKHAKSQKPPQQHHNMQSSHYQRNDGGGYVASGGRGGHLMAPAAAGAGIGFNQSAAAPALNPALGQALTALLATQGAGLGGLTNLLGTLGSAAAVTQGGVPSAAHGMQGAYGNQASISPGVIGAYANQGAMQGGYPNQQMGQGGSGRGQHGQYTPYMGH

SEQ ID NO: 3477 - DNA, 1434 bp, Populus balsamifera subsp. trichocarpa
  misc_feature (1)..(1434): Ceres ANNOT ID no. 1474630
  misc_feature 386566:<222: Transcription Factor
  misc_feature: Phenotype: WHOLE PLANT - Small Useful for modulating plant size
  misc_feature: Phenotype: ROSETTE LEAVES - Oval Shaped Useful for making plants with increased biomass and foliage
atggctaaaaaacgaaagcacgacgccaaatccaccgagccagcggaagagccgccgaagaagcagcaacaacaagaaccgccaaaagaagagctccaagaagagcaaaacgaagaagaagtagaagaagttgaagaggaggaagaagaagaatacgaagaagtcgaagaggaagaagaaaacgaagatgaagctgatgaagaaaacaatcaaaacgctcagatctcagctggggagattcaaaacgacgacgaagatgaagatgaggagccggttgagaaacttcttgaaccgtttggaaaagaccagctgattaatttacttcgggaagcagcggatgctcaccgggacgttgcggagaaaatccggcaagtggctgaccaagatccagttcatcggaagatttttgttcatgggcttggatgggatacgaacgctgaggctttgatgagtgcgtttaagccttatggagagattgaggattgtaaagctgtgtgcgataaggtttcggggaaatcaaaggggtatgggtttattttgtttaagagaaggagtggggcacggaaggcgctgaaggaaccgcagaagaagatagggaataggatgacagcttgtcaattggcgtctattggtccggttccacagtcgagtggtggccaggctgggcctgttgctgcggcagcgcaagcgcagcagccagtttcggagtatacgctgaggaagatttatgtgagtaacgtggcggcagatttggatccgcagaagttgtatagttacttttcggagtttggagagatcgaggaaggacccttagggcttgataaggcgactgggaagccgaaagggttttgtttgtttgtttataagagttctgagggtgctaagaaagcgttggaagagccacataagagttttgaaggacatatgttgcattgtcagaaggctatagatgggccgaaaccagggaaagctcagaaacaaccgcagcaacatcataatttgcaaagctcgcattaccagaggaatgatggtggtggttatgttggtggtggcagtcgcggtggtcatttaatggcgccggctgcttctggagctgggattgggtttaatcagggtgctgctggtcctgccctgaaccctgcacttggacaggcactgaccgcattgcttgcaactcagggtgctggattgggggggctgactaatttgcttgggactttggggtctgctgcagctgtgaatcagggtggtttatctggtgcaggtcatggaatgcagggtgcctatgggaaccaggcgagcataagtccgggagtgatgggaacttatgcgaatcagggagctatgcagggtggatatccaaaccagcagacgggacagggtggttctgggagaggacaacatgggcaatatgctccttatatgggtcactag

SEQ ID NO: 3478 - protein, 477 aa, Populus balsamifera subsp. trichocarpa
  misc_feature (1)..(477): Ceres ANNOT ID no. 1474630
  misc_feature (242)..(312): Pfam Name: RRM_1 Pfam Description: RNA recognition motif. (a.k.a. RRM RBD, or RNP domain)
  misc_feature: SWISSPROT Homolog: HNRPD_HUMAN Heterogeneous nuclear ribonucleoprotein D0 (hnRNP D0) (AU-rich element RNA-binding protein 1) with e-value of 3.1e-23 and BLAST sequence identity of 29.2
  misc_feature: SWISSPROT Homolog: HNRPD_MOUSE Heterogeneous nuclear ribonucleoprotein D0 (hnRNP D0) (AU-rich element RNA-binding protein 1) with e-value of 4.4e-23 and BLAST sequence identity of 29.2
  misc_feature: SWISSPROT Homolog: ROA1_CAEEL Heterogeneous nuclear ribonucleoprotein A1 with e-value of 4.5e-23 and BLAST sequence identity of 28.3
  misc_feature: SWISSPROT Homolog: MSI2H_MOUSE RNA-binding protein Musashi homolog 2 (Musashi-2) with e-value of 1.3e-21 and BLAST sequence identity of 28.6
  misc_feature: SWISSPROT Homolog: ROAA_HUMAN Heterogeneous nuclear ribonucleoprotein A/B (hnRNP A/B) (APOBEC-1-binding protein 1) (ABBP-1) with e-value of 1.7e-21 and BLAST sequence identity of 28.3
  misc_feature 386692:<222: Transcription Factor
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature (1)..(477): Functional Homolog of  Ceres CLONE ID no. 1029167 at SEQ ID NO. 3521 with e-value of 8.29E-133 and BLAST sequence identity of 65.1
MAKKRKHDAKSTEPAEEPPKKQQQQEPPKEELQEEQNEEEVEEVEEEEEEEYEEVEEEEENEDEADEENNQNAQISAGEIQNDDEDEDEEPVEKLLEPFGKDQLINLLREAADAHRDVAEKIRQVADQDPVHRKIFVHGLGWDTNAEALMSAFKPYGEIEDCKAVCDKVSGKSKGYGFILFKRRSGARKALKEPQKKIGNRMTACQLASIGPVPQSSGGQAGPVAAAAQAQQPVSEYTLRKIYVSNVAADLDPQKLYSYFSEFGEIEEGPLGLDKATGKPKGFCLFVYKSSEGAKKALEEPHKSFEGHMLHCQKAIDGPKPGKAQKQPQQHHNLQSSHYQRNDGGGYVGGGSRGGHLMAPAASGAGIGFNQGAAGPALNPALGQALTALLATQGAGLGGLTNLLGTLGSAAAVNQGGLSGAGHGMQGAYGNQASISPGVMGTYANQGAMQGGYPNQQTGQGGSGRGQHGQYAPYMGH

SEQ ID NO: 3479 - DNA, 1194 bp, Populus balsamifera subsp. trichocarpa
  misc_feature (1)..(1194): Ceres ANNOT ID no. 1450948
  misc_feature 386822:<222: Transcription Factor
  misc_feature: Phenotype: WHOLE PLANT - Small Useful for modulating plant size
  misc_feature: Phenotype: ROSETTE LEAVES - Oval Shaped Useful for making plants with increased biomass and foliage
atggcaaaaaccgaaaaaactaagaaactcaagaccgccaaaaaaccagaaaccaccaccaaacagaaaccgctaaagaaacccaaactcaagatacgaaaaaccaaacccctcccttcagaccctgccgatctctcaacccttctcgaaccctacacaaaagaccaattaatcgacctaattaccaactctgccattaagaacccctctttgtattctctaattcatcaacacgccgaccgcgatgtcactcaccggaatgtttttgtccacggcttctcctgggacacaacgcgccaagacctcgtatctgccttcgccgccttcggagaaatcgaggaatgcaatgttgtaattgataaagcaacaggtaaagcaaaaggctatggttttgtcttgtttaaatcgcgaaaagctgcgatctctgcgttgaaggaaacgaaaagaatggttaatgatcggatggctagttgtcaattggcttctgtaggatctgctaatgcggcctcggcggccaaagggaaggaattggagggtggggtgaggaagatatttgtgagtaatgtaggaatgagtactgataaggaaaagttgagagctttctttgagaaattcggagaaattgagaatgggccaattgggtttgataaggagactgggaagtcaagaggttatgctttgtttgtttataagaccgtggagggagccataaaggcattagaggagcctcataagatatttgaagggcagcaattgcgttgctcggtcgcgacagaaggaaaaaacaagactaatcaaaatgtggcgcagggaatgcagcaggtggtacagcagcagccggtgcatcaacagcctcaagggcagtttttggcagcggcgcagaatctggcattgtttggtcagcatcctgggtttaatccactgtatagcgcattgttggggagcacaggtgttggtggtggcatgatcagtccagtaatcggccagagtatggtgccaactgcgacgagtcaagtggggggattgggagttgggagccagtcaacactggaggcatatagggctgcgcaagtgttgcagcatgtttattcgagcactacgcagattgggcagacagggatgggtaggggtcagggggctggtggatcatttaccggctatccaaaatatatgtggtgggagttgatggggtag

SEQ ID NO: 3480 - protein, 397 aa, Populus balsamifera subsp. trichocarpa
  misc_feature (1)..(397): Ceres ANNOT ID no. 1450948
  misc_feature (88)..(158): Pfam Name: RRM_1 Pfam Description: RNA recognition motif. (a.k.a. RRM RBD, or RNP domain)
  misc_feature: SWISSPROT Homolog: HNRPD_HUMAN Heterogeneous nuclear ribonucleoprotein D0 (hnRNP D0) (AU-rich element RNA-binding protein 1) with e-value of 3.1e-23 and BLAST sequence identity of 29.2
  misc_feature: SWISSPROT Homolog: HNRPD_MOUSE Heterogeneous nuclear ribonucleoprotein D0 (hnRNP D0) (AU-rich element RNA-binding protein 1) with e-value of 4.4e-23 and BLAST sequence identity of 29.2
  misc_feature: SWISSPROT Homolog: ROA1_CAEEL Heterogeneous nuclear ribonucleoprotein A1 with e-value of 4.5e-23 and BLAST sequence identity of 28.3
  misc_feature: SWISSPROT Homolog: MSI2H_MOUSE RNA-binding protein Musashi homolog 2 (Musashi-2) with e-value of 1.3e-21 and BLAST sequence identity of 28.6
  misc_feature: SWISSPROT Homolog: ROAA_HUMAN Heterogeneous nuclear ribonucleoprotein A/B (hnRNP A/B) (APOBEC-1-binding protein 1) (ABBP-1) with e-value of 1.7e-21 and BLAST sequence identity of 28.3
  misc_feature 386940:<222: Transcription Factor
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature (1)..(397): Functional Homolog of  Ceres CLONE ID no. 1029167 at SEQ ID NO. 3521 with e-value of 7.19E-63 and BLAST sequence identity of 45.1
MAKTEKTKKLKTAKKPETTTKQKPLKKPKLKIRKTKPLPSDPADLSTLLEPYTKDQLIDLITNSAIKNPSLYSLIHQHADRDVTHRNVFVHGFSWDTTRQDLVSAFAAFGEIEECNVVIDKATGKAKGYGFVLFKSRKAAISALKETKRMVNDRMASCQLASVGSANAASAAKGKELEGGVRKIFVSNVGMSTDKEKLRAFFEKFGEIENGPIGFDKETGKSRGYALFVYKTVEGAIKALEEPHKIFEGQQLRCSVATEGKNKTNQNVAQGMQQVVQQQPVHQQPQGQFLAAAQNLALFGQHPGFNPLYSALLGSTGVGGGMISPVIGQSMVPTATSQVGGLGVGSQSTLEAYRAAQVLQHVYSSTTQIGQTGMGRGQGAGGSFTGYPKYMWWELMG

SEQ ID NO: 3481 - protein, 189 aa, Glycine max
  misc_feature (1)..(189): Ceres CLONE ID no. 1043081
  misc_feature (5)..(68): Pfam Name: AP2 Pfam Description: AP2 domain
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
MVQSRKFRGVRQRNWGSWVSEIRHPLLKRRVWLGTFETADEAARAYDEAAILMSGRNAKTNFPVGENQMGNHSSSTSSSSTTTLSAVLSAKLRKCCKSPSPSLTCLRLDTENSHIGVWQKRAGPRSDSNWIMMVELEKKNNKGPSSESELPVVVVDDDAPEKVKPEESTGLDEEQKMALQMIEELLNRN

SEQ ID NO: 3482 - DNA, 621 bp, Populus balsamifera subsp. trichocarpa; identical to SEQ ID NO: 674
  misc_feature (1)..(621): Ceres ANNOT ID no. 1478584
  misc_feature 387140:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance

SEQ ID NO: 3483 - protein, 206 aa, Populus balsamifera subsp. trichocarpa; identical to SEQ ID NO: 675
  misc_feature (1)..(206): Ceres ANNOT ID no. 1478584
  misc_feature (5)..(68): Pfam Name: AP2 Pfam Description: AP2 domain
  misc_feature: SWISSPROT Homolog: PZ02_LUPPO Protein PPLZ02 with e-value of 1.7e-23 and BLAST sequence identity of 58.2
  misc_feature: SWISSPROT Homolog: ERF4_NICSY Ethylene-responsive transcription factor 4 EREBP-3 (NsERF3) with e-value of 7.9e-19 and BLAST sequence identity of 56.6
  misc_feature: SWISSPROT Homolog: DRE2B_ARATH Dehydration-responsive element-binding protein 2B (DREB2B protein) with e-value of 1.6e-18 and BLAST sequence identity of 35.6
  misc_feature: SWISSPROT Homolog: ERF4_TOBAC Ethylene-responsive transcription factor 4 EREBP-3 (NtERF3) with e-value of 3.4e-18 and BLAST sequence identity of 57.5
  misc_feature: SWISSPROT Homolog: DRE2F_ARATH Dehydration-responsive element-binding protein 2F (DREB2F protein) with e-value of 4.1e-18 and BLAST sequence identity of 58.6
  misc_feature 387253:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
  misc_feature (1)..(206): Functional Homolog of  Ceres CLONE ID no. 1043081 at SEQ ID NO. 3528 with e-value of 5.29E-60 and BLAST sequence identity of 67.9

SEQ ID NO: 3484 - DNA, 681 bp, Populus balsamifera subsp. trichocarpa
  misc_feature (1)..(681): Ceres ANNOT ID no. 1455564
  misc_feature 387346:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
atggagggcatgcttgcttttcaggaacaggtgcctcacaaacttaaatgcgcacccgtaccccttcacattagtgtttttctaagttttctttcccaaatcatggtacaatccaagaaattcagaggcgtcaggcaacgccagtggggctcttgggtgtctgaaattcgccaccctttactgaagaggagggtatggctagggacatttgagacagctgaggcagcagcaagagcatatgatcaagcagctatattgatgaatggacagaatgccaagaccaatttcccagcaagtcatcttgatcaagacactaagctcggcaaagataacaactctcccttgcctgccaaggcactggctgagcttctctactcaaagctaaggaagtgttgtggaaaagacccttctccttcactcacttgtctaaggctcgacaatgataactctcatattggcgtgtggcaaaagaaagctggctcttgttcaagctcgaattgggtcatgagggtcgagcttggaaatagcaacaggaagagcacacaagttatggaggaattacgaccttcattgtcatcagaatcatcgtcaagagttgagattgaacctgagattaatggtacggatgaagaggataaaattgctatgcaaatgatagacgagctacttaattgtaattaa

SEQ ID NO: 3485 - protein, 192 aa, Populus balsamifera subsp. trichocarpa
  misc_feature (1)..(192): Ceres ANNOT ID no. 1455564
  misc_feature (5)..(68): Pfam Name: AP2 Pfam Description: AP2 domain
  misc_feature: SWISSPROT Homolog: PZ02_LUPPO Protein PPLZ02 with e-value of 1.7e-23 and BLAST sequence identity of 58.2
  misc_feature: SWISSPROT Homolog: ERF4_NICSY Ethylene-responsive transcription factor 4 EREBP-3 (NsERF3) with e-value of 7.9e-19 and BLAST sequence identity of 56.6
  misc_feature: SWISSPROT Homolog: DRE2B_ARATH Dehydration-responsive element-binding protein 2B (DREB2B protein) with e-value of 1.6e-18 and BLAST sequence identity of 35.6
  misc_feature: SWISSPROT Homolog: ERF4_TOBAC Ethylene-responsive transcription factor 4 EREBP-3 (NtERF3) with e-value of 3.4e-18 and BLAST sequence identity of 57.5
  misc_feature: SWISSPROT Homolog: DRE2F_ARATH Dehydration-responsive element-binding protein 2F (DREB2F protein) with e-value of 4.1e-18 and BLAST sequence identity of 58.6
  misc_feature 387461:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
  misc_feature (1)..(192): Functional Homolog of  Ceres CLONE ID no. 1043081 at SEQ ID NO. 3528 with e-value of 9.99E-57 and BLAST sequence identity of 63.4
MVQSKKFRGVRQRQWGSWVSEIRHPLLKRRVWLGTFETAEAAARAYDQAAILMNGQNAKTNFPASHLDQDTKLGKDNNSPLPAKALAELLYSKLRKCCGKDPSPSLTCLRLDNDNSHIGVWQKKAGSCSSSNWVMRVELGNSNRKSTQVMEELRPSLSSESSSRVEIEPEINGTDEEDKIAMQMIDELLNCN

SEQ ID NO: 3486 - DNA, 579 bp, Populus balsamifera subsp. trichocarpa
  misc_feature (1)..(579): Ceres ANNOT ID no. 1508764
  misc_feature 387554:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
atggtacaatccaagaaattcagaggcgtcaggcaacgccagtggggctcttgggtgtctgaaattcgccaccctttactgaagaggagggtatggctagggacatttgagacagctgaggcagcagcaagagcatatgatcaagcagctatattgatgaatggacagaatgccaagaccaatttcccagcaagtcatcttgatcaagacactaagctcggcaaagataacaactctcccttgcctgccaaggcactggctgagcttctctactcaaagctaaggaagtgttgtggaaaagacccttctccttcactcacttgtctaaggctcgacaatgataactctcatattggcgtgtggcaaaagaaagctggctcttgttcaagctcgaattgggtcatgagggtcgagcttggaaatagcaacaggaagagcacacaagttatggaggaattacgaccttcattgtcatcagaatcatcgtcaagagttgagattgaacctgagattaatggtacggatgaagaggataaaattgctatgcaaatgatagacgagctacttaattgtaattaa

SEQ ID NO: 3487 - protein, 192 aa, Populus balsamifera subsp. trichocarpa; identical to SEQ ID NO: 3485
  misc_feature (1)..(192): Ceres ANNOT ID no. 1508764
  misc_feature (5)..(68): Pfam Name: AP2 Pfam Description: AP2 domain
  misc_feature: SWISSPROT Homolog: PZ02_LUPPO Protein PPLZ02 with e-value of 1.7e-23 and BLAST sequence identity of 58.2
  misc_feature: SWISSPROT Homolog: ERF4_NICSY Ethylene-responsive transcription factor 4 EREBP-3 (NsERF3) with e-value of 7.9e-19 and BLAST sequence identity of 56.6
  misc_feature: SWISSPROT Homolog: DRE2B_ARATH Dehydration-responsive element-binding protein 2B (DREB2B protein) with e-value of 1.6e-18 and BLAST sequence identity of 35.6
  misc_feature: SWISSPROT Homolog: ERF4_TOBAC Ethylene-responsive transcription factor 4 EREBP-3 (NtERF3) with e-value of 3.4e-18 and BLAST sequence identity of 57.5
  misc_feature: SWISSPROT Homolog: DRE2F_ARATH Dehydration-responsive element-binding protein 2F (DREB2F protein) with e-value of 4.1e-18 and BLAST sequence identity of 58.6
  misc_feature 387665:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
  misc_feature (1)..(192): Functional Homolog of  Ceres CLONE ID no. 1043081 at SEQ ID NO. 3528 with e-value of 9.99E-57 and BLAST sequence identity of 63.4

SEQ ID NO: 3488 - DNA, 537 bp, Populus balsamifera subsp. trichocarpa
  misc_feature (1)..(537): Ceres ANNOT ID no. 1477651
  misc_feature 387758:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
atggtacaatcaaagaaattcagaggcgtcaggcaacgccagtggggctcttgggtgtctgaaattcgccacccattactgaagaggagggtgtggctggggacatttgagacagctgaggcagcagcaagagcgtatgatcaagcagctatattgatgaatggacagaatgccaagaccaatttcccgacaagtcaccttgatcaagacacaaatcttggcaaagataacaactctcccttgcctgccaaggcactggctgagcttctcaactcaaagctaagaaagtgttgcggcaaagacccttctccttcactcacttgcctgaggcttgataatgataactctcatattggtgtgtggcagaagaaagctggttctcgttcaagttcaaattgggtcatgaaggtggagcttggaaattacaacaagaagacagagtcatcgccgacggttgagattgagccggaaaatggtacggaagaagaggatagaattgctatgcaaatgatagaagagctgcttaatcggaattga

SEQ ID NO: 3489 - protein, 178 aa, Populus balsamifera subsp. trichocarpa
  misc_feature (1)..(178): Ceres ANNOT ID no. 1477651
  misc_feature (5)..(68): Pfam Name: AP2 Pfam Description: AP2 domain
  misc_feature: SWISSPROT Homolog: PZ02_LUPPO Protein PPLZ02 with e-value of 1.7e-23 and BLAST sequence identity of 58.2
  misc_feature: SWISSPROT Homolog: ERF4_NICSY Ethylene-responsive transcription factor 4 EREBP-3 (NsERF3) with e-value of 7.9e-19 and BLAST sequence identity of 56.6
  misc_feature: SWISSPROT Homolog: DRE2B_ARATH Dehydration-responsive element-binding protein 2B (DREB2B protein) with e-value of 1.6e-18 and BLAST sequence identity of 35.6
  misc_feature: SWISSPROT Homolog: ERF4_TOBAC Ethylene-responsive transcription factor 4 EREBP-3 (NtERF3) with e-value of 3.4e-18 and BLAST sequence identity of 57.5
  misc_feature: SWISSPROT Homolog: DRE2F_ARATH Dehydration-responsive element-binding protein 2F (DREB2F protein) with e-value of 4.1e-18 and BLAST sequence identity of 58.6
  misc_feature 387867:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
  misc_feature (1)..(178): Functional Homolog of  Ceres CLONE ID no. 1043081 at SEQ ID NO. 3528 with e-value of 2.70E-56 and BLAST sequence identity of 69.1
MVQSKKFRGVRQRQWGSWVSEIRHPLLKRRVWLGTFETAEAAARAYDQAAILMNGQNAKTNFPTSHLDQDTNLGKDNNSPLPAKALAELLNSKLRKCCGKDPSPSLTCLRLDNDNSHIGVWQKKAGSRSSSNWVMKVELGNYNKKTESSPTVEIEPENGTEEEDRIAMQMIEELLNRN

SEQ ID NO: 3490 - DNA, 543 bp, Populus balsamifera subsp. trichocarpa; identical to SEQ ID NO: 676
  misc_feature (1)..(543): Ceres ANNOT ID no. 1487130
  misc_feature 387957:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance

SEQ ID NO: 3491 - protein, 180 aa, Populus balsamifera subsp. trichocarpa; identical to SEQ ID NO: 677
  misc_feature (1)..(180): Ceres ANNOT ID no. 1487130
  misc_feature (17)..(69): Pfam Name: AP2 Pfam Description: AP2 domain
  misc_feature: SWISSPROT Homolog: PZ02_LUPPO Protein PPLZ02 with e-value of 1.7e-23 and BLAST sequence identity of 58.2
  misc_feature: SWISSPROT Homolog: ERF4_NICSY Ethylene-responsive transcription factor 4 EREBP-3 (NsERF3) with e-value of 7.9e-19 and BLAST sequence identity of 56.6
  misc_feature: SWISSPROT Homolog: DRE2B_ARATH Dehydration-responsive element-binding protein 2B (DREB2B protein) with e-value of 1.6e-18 and BLAST sequence identity of 35.6
  misc_feature: SWISSPROT Homolog: ERF4_TOBAC Ethylene-responsive transcription factor 4 EREBP-3 (NtERF3) with e-value of 3.4e-18 and BLAST sequence identity of 57.5
  misc_feature: SWISSPROT Homolog: DRE2F_ARATH Dehydration-responsive element-binding protein 2F (DREB2F protein) with e-value of 4.1e-18 and BLAST sequence identity of 58.6
  misc_feature 388068:<222: Transcription Factor
  misc_feature: Phenotype: WHOLE PLANT - Dark Green Useful for increasing chlorophyll and photosynthetic capacity
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: ROSETTE LEAVES - Glossy Useful for making plants with enhanced abiotic stress tolerance
  misc_feature (1)..(180): Functional Homolog of  Ceres CLONE ID no. 1043081 at SEQ ID NO. 3528 with e-value of 2.49E-46 and BLAST sequence identity of 68.4

SEQ ID NO: 3492 - protein, 545 aa, Arabidopsis thaliana
  misc_feature (1)..(545): Ceres CDNA ID no. 2702830
  misc_feature (114)..(481): Pfam Name: PTR2 Pfam Description: POT family
  misc_feature: Utility: MSX Useful for making plants tolerant to low nitrogen
  misc_feature: Utility: High Sucrose Useful for making plants with enhanced tolerance to drought
  misc_feature: Phenotype: WHOLE PLANT - High Sucrose Useful for making plants with enhanced tolerance to drought
  misc_feature: Phenotype: WHOLE PLANT - MSX Useful for making plants tolerant to low nitrogen
MASIDEERSLLEVEESLIQEEVKLYAEDGSIDIHGNPPLKQTTGNWKACPFIFANECCERLAYYGIAKNLITYFTNELHETNVSAARHVMTWQGTCYITPLIGALIADAYWGRYWTIACFSAIYFTGMVALTLSASVPGLKPAECIGSLCPPATMVQSTVLFSGLYLIALGTGGIKPCVSSFGADQFDKTDPSERVRKASFFNWFYFTINIGAFVSSTVLVWIQENYGWELGFLIPTVFMGLATMSFFFGTPLYRFQKPRGSPITSVCQVLVAAYRKSNLKVPEDSTDEGDANTNPWKLCTVTQVEEVKILLRLVPIWASGIIFSVLHSQIYTLFVQQGRCMKRTIGLFEIPPATLGMFDTASVLISVPIYDRVIVPLVRRFTGLAKGFTELQRMGIGLFVSVLSLTFAAIVETVRLQLARDLDLVESGDIVPLNIFWQIPQYFLMGTAGVFFFVGRIEFFYEQSPDSMRSLCSAWALLTTTLGNYLSSLIITLVAYLSGKDCWIPSDNINNGHLDYFFWLLVSLGSVNIPVFVFFSVKYTHMKV

SEQ ID NO: 3493 - DNA, 1755 bp, Populus balsamifera subsp. trichocarpa
  misc_feature (1)..(1755): Ceres ANNOT ID no. 1516968
  misc_feature 388310:<222: Transcription Factor
  misc_feature: Phenotype: WHOLE PLANT - High Sucrose Useful for making plants with enhanced tolerance to drought
  misc_feature: Phenotype: WHOLE PLANT - MSX Useful for making plants tolerant to low nitrogen
atggctaagattaacaagtatccagtccttgtcagtttcgtattatatttccaggatgaaagcaatggactctacacaggagatggctcagttgacattaatgggaaccctgtccttaagcagaaaactggaaactggaaagcatgccctttcatactgggtactgaatgttgtgaacgcctggcctactatgggattgctactaatctcgtcacttaccttaccaagaagctacatgaaggaaatgtgtcggctgcaagaaatgttaccacctggtcagggacatgctatcttacacccctcatcggagctgtattagcagatacttgttggggaagatattggactattgctgctttctcctcaatttacttcattggaatgtgtgcgttgactctctcagcatctattcctgcattaaagccagctgaatgcgtaggttctctgtgccctccagcaactccagctcagtatgcagtattcttttttggcctctatctgattgcgcttgggacgggtggcatcaaaccatgtgtttcatcctttggggcagatcaatttgatgacactgatcccaaggaacgggtaaagaagggatctttcttcaattggttctatttttcaatcaatattggtgctcttatatcaagtagttttctggtatatattcaagacaatgccggttggggactaggatttggaattcctgcactgttcatgggcatagctattgctagcttcttttcaggcacacccctttacagatttcaaagaccaggggggagccctattacaaggatgtgccaagttttggttgcatcattccataagtggaatctggaggttcctctagacagtagcctcctgtatgaaacacaagacaaacactctgccattgaaggaagccggaaactggtgcacagcgatgaactaaagtgccttgataaagctgctgtgctgtcagaggctgagatgaaaagtggggacttccccaacccttggaggctttgtactgtcacgcaggtggaggaattgaagattttgatccgcatgtttccaatctgggctacaggaattgtcttttccgctgtgtatgcccagatgtctactatgtttgtggaacaagggatgctgatggacacgacaattggttctttcacaattcctccagcatctctgtcatcctttgatgttattagtgttatttgctgggtgccaatctatgataggattgttgttcccattgcaaggaagttcacaggaaaagagaggggcttctcagatttgcagcgtatgggaattggcctgttcatttcagtgttatcaatgacagctgctgctttggtggagattaagcgcctacagcttgcgaaagagcttggcttggctggtgaagctgttgcagtgcctatcagtattttttggcagatcccccaatatatgttggtaggtgcttcagaagtttttacattcattggtcagattgaattcttctatgaagaatctccagatgcaatgcggagtttatgcagtgcgttgtcactcctgactacgtctttgggtaattacttgagctcttttattctgactatggtaacttacttcacaaccacgggtgggaagccaggatggatccccgataacttgaatgagggccacctcgattatttcttctggcttttagctggactcagcgttctcaacatgctggtctatgttttctgtgcgaggaaatataagcagaaggcctcctaa

SEQ ID NO: 3494 - protein, 584 aa, Populus balsamifera subsp. trichocarpa
  misc_feature (1)..(584): Ceres ANNOT ID no. 1516968
  misc_feature (52)..(530): Pfam Name: MFS_1 Pfam Description: Major Facilitator Superfamily
  misc_feature: SWISSPROT Homolog: PTR2_ARATH Peptide transporter PTR2 (Histidine-transporting protein) with e-value of 2.0e-213 and BLAST sequence identity of 77.4
  misc_feature: SWISSPROT Homolog: CHL1_ARATH Nitrate/chlorate transporter with e-value of 7.2e-101 and BLAST sequence identity of 45.5
  misc_feature: SWISSPROT Homolog: S15A1_RABIT Oligopeptide transporter, small intestine isoform with e-value of 1.3e-57 and BLAST sequence identity of 34.0
  misc_feature: SWISSPROT Homolog: S15A1_RABIT Peptide transporter 1 Intestinal H(+)/peptide cotransporter Solute carrier family 15 member 1
  misc_feature: SWISSPROT Homolog: S15A1_HUMAN Oligopeptide transporter, small intestine isoform with e-value of 1.1e-53 and BLAST sequence identity of 31.2
  misc_feature: SWISSPROT Homolog: S15A1_HUMAN Peptide transporter 1 Intestinal H(+)/peptide cotransporter Solute carrier family 15 member 1
  misc_feature: SWISSPROT Homolog: S15A1_RAT Oligopeptide transporter, small intestine isoform with e-value of 1.2e-53 and BLAST sequence identity of 30.7
  misc_feature: SWISSPROT Homolog: S15A1_RAT Peptide transporter 1 Intestinal H(+)/peptide cotransporter Solute carrier family 15 member 1 (Proton-coupled dipeptide cotransporter)
  misc_feature 388471:<222: Transcription Factor
  misc_feature: Phenotype: WHOLE PLANT - High Sucrose Useful for making plants with enhanced tolerance to drought
  misc_feature: Phenotype: WHOLE PLANT - MSX Useful for making plants tolerant to low nitrogen
  misc_feature (1)..(584): Functional Homolog of  Ceres CDNA ID no. 2702830 at SEQ ID NO. 3539 with e-value of 4.99E-190 and BLAST sequence identity of 66.7
MAKINKYPVLVSFVLYFQDESNGLYTGDGSVDINGNPVLKQKTGNWKACPFILGTECCERLAYYGIATNLVTYLTKKLHEGNVSAARNVTTWSGTCYLTPLIGAVLADTCWGRYWTIAAFSSIYFIGMCALTLSASIPALKPAECVGSLCPPATPAQYAVFFFGLYLIALGTGGIKPCVSSFGADQFDDTDPKERVKKGSFFNWFYFSINIGALISSSFLVYIQDNAGWGLGFGIPALFMGIAIASFFSGTPLYRFQRPGGSPITRMCQVLVASFHKWNLEVPLDSSLLYETQDKHSAIEGSRKLVHSDELKCLDKAAVLSEAEMKSGDFPNPWRLCTVTQVEELKILIRMFPIWATGIVFSAVYAQMSTMFVEQGMLMDTTIGSFTIPPASLSSFDVISVICWVPIYDRIVVPIARKFTGKERGFSDLQRMGIGLFISVLSMTAAALVEIKRLQLAKELGLAGEAVAVPISIFWQIPQYMLVGASEVFTFIGQIEFFYEESPDAMRSLCSALSLLTTSLGNYLSSFILTMVTYFTTTGGKPGWIPDNLNEGHLDYFFWLLAGLSVLNMLVYVFCARKYKQKAS

SEQ ID NO: 3495 - DNA, 1734 bp, Populus balsamifera subsp. trichocarpa
  misc_feature (1)..(1734): Ceres ANNOT ID no. 1520085
  misc_feature 388622:<222: Transcription Factor
  misc_feature: Phenotype: WHOLE PLANT - High Sucrose Useful for making plants with enhanced tolerance to drought
  misc_feature: Phenotype: WHOLE PLANT - MSX Useful for making plants tolerant to low nitrogen
atgaacaaaaataatggactccacacaggagatggctcggtcgacattaatgggacggctgttcttaagcagaaaactggaaattggagagcatgctctttcatattgggaaatgaatgctgtgaacgcttggcctactatggaattgctactaatctggtctcctaccttactgggaagctacatgaaggaaatgtgtcagctgcaaaaaatgttaacatttgggcaggaacttgctacttcacaccactcattggagccactttggcagatgcttattggggaagatattggaccatttctgttttctccacaatttacttcattggaatgtgtacgttgactctctcagcaactattcctgtattaaagccagctgaatgtataggttctctatgccctccagcaactcctgctcagtatggggtattcttttttggcctctatctgattgcatttgggacaggtggcatcaaaccatgtgtttcatcctttggggcggatcagtttgatgacactgatcctaaggaaagggtaaagaaggggtccttcttcaattgtttctatttttcaatcaacattggttgtcttgtatcaagtagtttaatggtatacattcaagacaaagctgggtgggggctaggatttggaattcctgcattgttcatgggcatagctattgctatcttcttttcaggcacgcccctttatagatttcagaggccagtggggagcccaattactagaatgtgccaagttgtggttgcgtcattccataagaggaatttggaggttccccaagacattagtctcctatatgaaacccaagaaaaacactcaaccattgagggaacctggaaactagcgcacagcaatgaattgaaatgccttgataaagctgctataatttcagaggctgagataaaaggtggggacttcagtgatccatggaggctttgtactatgactcaggtggaggaattgaagattttgatccgcatgtttccgatctgggctacaggcattgtcttttctgctgcccatgcccaaatgagtacaatctttgtggaacaagggatgctgatggacaagacaattggttctttcaacatccctcctgcttctatgatcacaattgatgttattagtgttattttctgggttccaatctatgataggatcattgttccaattgcaaggaagttcactggcagagagaggggcttttcagagttgcagcgtatgggaattggcttgttcatttctatgctatcaatgacagctgctgctttgctagagattaagcgcttgcagcttgtaaaagagcttggattggttggtgatgctgttgcagttcctctcagtatcttgtggcaaattccccagtatatgttgatgggtacagcagagatctttacatccattggtcagcttgaatttttctatgaacagtctccagatgccatgcggagtctatgcagtgctttgtcactcctggctgcatctttgggtaattacctgagctcttttattctgagcatggtaacttacctcacaaccacgggtgggaagacaggatggataccagataacttaaataaggggcaccttgattatttattctggcttttggctgggctcagcttcttcaacttgctgatctacactatttgtgcaaagagatttataaagagaagaaggcctcctaaggtttttacaagaggggaggcctag

SEQ ID NO: 3496 - protein, 577 aa, Populus balsamifera subsp. trichocarpa
  misc_feature (1)..(577): Ceres ANNOT ID no. 1520085
  misc_feature (97)..(501): Pfam Name: PTR2 Pfam Description: POT family
  misc_feature: SWISSPROT Homolog: PTR2_ARATH Peptide transporter PTR2 (Histidine-transporting protein) with e-value of 2.0e-213 and BLAST sequence identity of 77.4
  misc_feature: SWISSPROT Homolog: CHL1_ARATH Nitrate/chlorate transporter with e-value of 7.2e-101 and BLAST sequence identity of 45.5
  misc_feature: SWISSPROT Homolog: S15A1_RABIT Oligopeptide transporter, small intestine isoform with e-value of 1.3e-57 and BLAST sequence identity of 34.0
  misc_feature: SWISSPROT Homolog: S15A1_RABIT Peptide transporter 1 Intestinal H(+)/peptide cotransporter Solute carrier family 15 member 1
  misc_feature: SWISSPROT Homolog: S15A1_HUMAN Oligopeptide transporter, small intestine isoform with e-value of 1.1e-53 and BLAST sequence identity of 31.2
  misc_feature: SWISSPROT Homolog: S15A1_HUMAN Peptide transporter 1 Intestinal H(+)/peptide cotransporter Solute carrier family 15 member 1
  misc_feature: SWISSPROT Homolog: S15A1_RAT Oligopeptide transporter, small intestine isoform with e-value of 1.2e-53 and BLAST sequence identity of 30.7
  misc_feature: SWISSPROT Homolog: S15A1_RAT Peptide transporter 1 Intestinal H(+)/peptide cotransporter Solute carrier family 15 member 1 (Proton-coupled dipeptide cotransporter)
  misc_feature 388781:<222: Transcription Factor
  misc_feature: Phenotype: WHOLE PLANT - High Sucrose Useful for making plants with enhanced tolerance to drought
  misc_feature: Phenotype: WHOLE PLANT - MSX Useful for making plants tolerant to low nitrogen
  misc_feature (1)..(577): Functional Homolog of  Ceres CDNA ID no. 2702830 at SEQ ID NO. 3539 with e-value of 2.00E-177 and BLAST sequence identity of 64.7
MNKNNGLHTGDGSVDINGTAVLKQKTGNWRACSFILGNECCERLAYYGIATNLVSYLTGKLHEGNVSAAKNVNIWAGTCYFTPLIGATLADAYWGRYWTISVFSTIYFIGMCTLTLSATIPVLKPAECIGSLCPPATPAQYGVFFFGLYLIAFGTGGIKPCVSSFGADQFDDTDPKERVKKGSFFNCFYFSINIGCLVSSSLMVYIQDKAGWGLGFGIPALFMGIAIAIFFSGTPLYRFQRPVGSPITRMCQVVVASFHKRNLEVPQDISLLYETQEKHSTIEGTWKLAHSNELKCLDKAAIISEAEIKGGDFSDPWRLCTMTQVEELKILIRMFPIWATGIVFSAAHAQMSTIFVEQGMLMDKTIGSFNIPPASMITIDVISVIFWVPIYDRIIVPIARKFTGRERGFSELQRMGIGLFISMLSMTAAALLEIKRLQLVKELGLVGDAVAVPLSILWQIPQYMLMGTAEIFTSIGQLEFFYEQSPDAMRSLCSALSLLAASLGNYLSSFILSMVTYLTTTGGKTGWIPDNLNKGHLDYLFWLLAGLSFFNLLIYTICAKRFIKRRRPPKVFTRGEA

SEQ ID NO: 3497 - protein, 317 aa, Arabidopsis thaliana
  misc_feature (1)..(317): Ceres CDNA ID no. 2731458
  misc_feature (74)..(283): Pfam Name: TCP Pfam Description: TCP family transcription factor
MFPSFITHIQSPNSHHHYSSPSFPFSSDFLESFDESFLINQFLLQQQDVAANVVESPWKFCKKLELKKKNEKCVDGSTSQEVQWRRTVKKRDRHSKICTAQGPRDRRMRLSLQIARKFFDLQDMLGFDKASKTIEWLFSKSKTSIKQLKERVAASEGGGKDEHLQVDEKEKDETLKLRVSKRRTKTMESSFKTKESRERARKRARERTMAKMKMRLFETSETISDPHQETREIKITNGVQLLEKENKEQEWSNTNDVHMVEYQMDSVSIIEKFLGLTSDSSSSSIFGDSEECYTSLSSVRGTISAAGNSNVLTKNPN

SEQ ID NO: 3498 - DNA, 1365 bp, Populus balsamifera subsp. trichocarpa
  misc_feature (1)..(1365): Ceres ANNOT ID no. 1458858
  misc_feature 389013:<222: Transcription Factor
atgttttcttcaagtagcagtttcaatccttttgatcaatacgctaaccataccatgattgcaggcacagaaaaccctagctcgatagaatcttgttctcaaacattcttgcagcacttccccgatccctttcttgatgttgatgatttgctggtaggtgaactcttatcacaacagcagcaggagcatcaggaggaggaggaagttttgggatctaatactgcgttagcagttgaggctcatgatccgcagactatccctacagcatcaaacgaggaaacaaaaatcaacaataaaaagaagagaagtaatgttgatacttcaaagcagccaattcgtcaaaggcgaaccgggaaggacaggcacagcaagatccatactgctcaagggcctagagatcgaaggatgaggttatcccttcaaatttccagaaagttctttgatctccaagacatgctcggcttcgataaagcaagcaaaactatcgagtggctctttacaaaatcgaaggccgggatcaaggagctcacagatagtgttccaggagggagaagaagatgtagcatttgtgctgacggcaagagtgtttgttccactccagagagtgaggttgtttcaggcatcaagctgacacctgagactaacggggacaagagagggacgaaggcaaagaatgactcattagtgagcaatcctaaagagaaaaggagcaagaaagtgcacaaaccagtctttaatcttgttgacagagattctagggagaaggcgagagcaagggcgagggagaggacaagagagagaatgaagaaccaaggcatagacacgtcaagtgatcggtcttctcaggcaaaccctaacaaattggaaaagtttgagtcttctggcccccttgaatatggtgaaaatttggctcctgtaaaccaagaaatgagttctccattgaaggttggtgatgtaaaagaatccagcaatcatgacttgctaccacatcaaatggattatgtcagcatcactgggaatttcttttggatcacaaattcaccaagatcgtcttcgattttcgatttctccgagagcgttgcgcttccaggtgggacaaactgcaaggatgagtttccagggtttcctttcaattctaacatgacaaatgatagaatccagtataaatataatgcactgacgaacatgaagctaccaccattaaacgcccatgaagaaagccctaattcaattttcgtgaacatgccaaatcccaatgatcaaaactccatttcaattctcatgaccaccaccacaaatggcaatgcaaaccagtcctcctcaaattccttttttgccgaagacaactttgactgcttatattga

SEQ ID NO: 3499 - protein, 436 aa, Populus balsamifera subsp. trichocarpa
  misc_feature (1)..(436): Ceres ANNOT ID no. 1458858
  misc_feature (88)..(333): Pfam Name: TCP Pfam Description: TCP family transcription factor
  misc_feature 389083:<222: Transcription Factor
  misc_feature (1)..(436): Functional Homolog of  Ceres CDNA ID no. 2731458 at SEQ ID NO. 3544 with e-value of 4.29E-33 and BLAST sequence identity of 51.3
MIAGTENPSSIESCSQTFLQHFPDPFLDVDDLLVGELLSQQQQEHQEEEEVLGSNTALAVEAHDPQTIPTASNEETKINNKKKRSNVDTSKQPIRQRRTGKDRHSKIHTAQGPRDRRMRLSLQISRKFFDLQDMLGFDKASKTIEWLFTKSKAGIKELTDSVPGGRRRCSICADGKSVCSTPESEVVSGIKLTPETNGDKRGTKAKNDSLVSNPKEKRSKKVHKPVFNLVDRDSREKARARARERTRERMKNQGIDTSSDRSSQANPNKLEKFESSGPLEYGENLAPVNQEMSSPLKVGDVKESSNHDLLPHQMDYVSITGNFFWITNSPRSSSIFDFSESVALPGGTNCKDEFPGFPFNSNMTNDRIQYKYNALTNMKLPPLNAHEESPNSIFVNMPNPNDQNSISILMTTTTNGNANQSSSNSFFAEDNFDCLY

SEQ ID NO: 3500 - DNA, 1539 bp, Populus balsamifera subsp. trichocarpa
  misc_feature (1)..(1539): Ceres ANNOT ID no. 1526534
  misc_feature 389193:<222: Transcription Factor
atgtctttctcacgcttagtcggaagagaagtggagaactctttccacaggaggcagtttaggcaagagtacattggtgcacatgtcattctcaagctactagtccaccgggtagctctacggcggataggtgttttttggtgcaattacaaagctcaaatgtttccattaagcaacaatggcaatgaccccatgtcctataatgaccaacaagcttataacatgccctttttcagtgatatcatttccaattccaaacaatatgtgcctcctcctttatctttctgccacttgccctctcctttttttgcctatgatcagctagaattagaagaccattctatttttctccagcaaaactatgaccttttacttcaccagcaacccttgagaactgcagctaccagtactactccctctcagagtactgttgttaataacatggtggattacaacaaaaatgacgttattgagataacggaaatctgcaacaagcaatccaacagcagcactgatcagatcccaagaaagagatcttctaagaaagatcgacacagcaagattaacacggctcaaggaccaagagatcggaggatgagattgtcgctaaaggttgccagagagttctttgatctgcaagacaagctacgctttgataaagcaagcaagactgtagaatggttactcacacaggcaagaactgaaatcaaaaaactatctagtggcttccccgttatgaattatagctgcagtgttggcaccaagagtgcatcttctacttctgagtgtgaagtgctgtccgaaatccatattgactctacccttaaagtgagcagtgtttctaagggtaaatcctcactatgtgtcaagaaagagaggaggactagtagagcttcatcatcacgtaaagctctattaaacccttttgcaaaggaatcaagggagaaggcaagggagagggcaagggagagaacgaaagaaaagttgcggagtcgaagtcgaagcctcgatgaatcgaagctttgtgaattagaagcagtgaacgatgaattcaatcaattcgcaggttgttggagtccattcgaaacaggtgatcaagaatcaggtactcacaatatcaatccttccttagaagtccaactggctgaagctgaagtgccgttctatcaagagcaagagcaagagcaattagatactcgtgaggggatgattgatgaaaccttggtgaatatgggcaagtggagtccctctcttcccaatcatccacacaaaaatggaattcctcaagagaatcaattcacagactttcaatatcctttgtacaaaacatgggatcatgaggcctacaacattgacgggttttataggcaagattatcttaaaagaattgaggttcttattaactttatactttctaatccaaaaaatattagtaggggtaaaattatatgtccatgtgcgaagtgtaagaataaaaagtttcaccataaaaatgttttgacaatgcatatacttaaaaaagggttcatcgagaaataa

SEQ ID NO: 3501 - protein, 448 aa, Populus balsamifera subsp. trichocarpa
  misc_feature (1)..(448): Ceres ANNOT ID no. 1526534
  misc_feature (224)..(264): Pfam Name: TCP Pfam Description: TCP family transcription factor
  misc_feature 389269:<222: Transcription Factor
  misc_feature (1)..(448): Functional Homolog of  Ceres CDNA ID no. 2731458 at SEQ ID NO. 3544 with e-value of 1.60E-28 and BLAST sequence identity of 49.0
MSYNDQQAYNMPFFSDIISNSKQYVPPPLSFCHLPSPFFAYDQLELEDHSIFLQQNYDLLLHQQPLRTAATSTTPSQSTVVNNMVDYNKNDVIEITEICNKQSNSSTDQIPRKRSSKKDRHSKINTAQGPRDRRMRLSLKVAREFFDLQDKLRFDKASKTVEWLLTQARTEIKKLSSGFPVMNYSCSVGTKSASSTSECEVLSEIHIDSTLKVSSVSKGKSSLCVKKERRTSRASSSRKALLNPFAKESREKARERARERTKEKLRSRSRSLDESKLCELEAVNDEFNQFAGCWSPFETGDQESGTHNINPSLEVQLAEAEVPFYQEQEQEQLDTREGMIDETLVNMGKWSPSLPNHPHKNGIPQENQFTDFQYPLYKTWDHEAYNIDGFYRQDYLKRIEVLINFILSNPKNISRGKIICPCAKCKNKKFHHKNVLTMHILKKGFIEK

SEQ ID NO: 3502 - DNA, 1386 bp, Populus balsamifera subsp. trichocarpa
  misc_feature (1)..(1386): Ceres ANNOT ID no. 1473127
  misc_feature 389382:<222: Transcription Factor
atgtctttctcacgcttagtcggaagagaagtggagaactctttccacaggaggcagtttaggcaagagtacattggtgcacatgtcattctcaagctactagtccaccgggtagctctacggcggataggtgttttttggtgcaattacaaagctcaaatgtttccattaagcaacaatggcaatgaccccatgtcctataatgaccaacaagcttataacatgccctttttcagtgatatcatttccaattccaaacaatatgtgcctcctcctttatctttctgccacttgccctctcctttttttgcctatgatcagctagaattagaagaccattctatttttctccagcaaaactatgaccttttacttcaccagcaacccttgagaactgcagctaccagtactactccctctcagagtactgttgttaataacatggtggattacaacaaaaatgacgttattgagataacggaaatctgcaacaagcaatccaacagcagcactgatcagatcccaagaaagagatcttctaagaaagatcgacacagcaagattaacacggctcaaggaccaagagatcggaggatgagattgtcgctaaaggttgccagagagttctttgatctgcaagacaagctacgctttgataaagcaagcaagactgtagaatggttactcacacaggcaagaactgaaatcaaaaaactatctagtggcttccccgttatgaattatagctgcagtgttggcaccaagagtgcatcttctacttctgagtgtgaagtgctgtccgaaatccatattgactctacccttaaagtgagcagtgtttctaagggtaaatcctcactatgtgtcaagaaagagaggaggactagtagagcttcatcatcacgtaaagctctattaaacccttttgcaaaggaatcaagggagaaggcaagggagagggcaagggagagaacgaaagaaaagttgcggagtcgaagtcgaagcctcgatgaatcgaagctttgtgaattagaagcagtgaacgatgaattcaatcaattcgcaggttgttggagtccattcgaaacaggtgatcaagaatcaggtactcacaatatcaatccttccttagaagtccaactggctgaagctgaagtgccgttctatcaagagcaagagcaagagcaattagatactcgtgaggggatgattgatgaaaccttggtgaatatgggcaagtggagtccctctcttcccaatcatccacacaaaaatggaattcctcaagagaatcaattcacagactttcaatatcctttgtacaaaacatgggatcatgaggcctacaacattgacggctctgcagaacttcctaggtccaattag

SEQ ID NO: 3503 - protein, 397 aa, Populus balsamifera subsp. trichocarpa
  misc_feature (1)..(397): Ceres ANNOT ID no. 1473127
  misc_feature (224)..(264): Pfam Name: TCP Pfam Description: TCP family transcription factor
  misc_feature 389454:<222: Transcription Factor
  misc_feature (1)..(397): Functional Homolog of  Ceres CDNA ID no. 2731458 at SEQ ID NO. 3544 with e-value of 1.60E-28 and BLAST sequence identity of 49.0
MSYNDQQAYNMPFFSDIISNSKQYVPPPLSFCHLPSPFFAYDQLELEDHSIFLQQNYDLLLHQQPLRTAATSTTPSQSTVVNNMVDYNKNDVIEITEICNKQSNSSTDQIPRKRSSKKDRHSKINTAQGPRDRRMRLSLKVAREFFDLQDKLRFDKASKTVEWLLTQARTEIKKLSSGFPVMNYSCSVGTKSASSTSECEVLSEIHIDSTLKVSSVSKGKSSLCVKKERRTSRASSSRKALLNPFAKESREKARERARERTKEKLRSRSRSLDESKLCELEAVNDEFNQFAGCWSPFETGDQESGTHNINPSLEVQLAEAEVPFYQEQEQEQLDTREGMIDETLVNMGKWSPSLPNHPHKNGIPQENQFTDFQYPLYKTWDHEAYNIDGSAELPRSN

SEQ ID NO: 3504 - DNA, 1305 bp, Populus balsamifera subsp. trichocarpa
  misc_feature (1)..(1305): Ceres ANNOT ID no. 1467936
  misc_feature 389555:<222: Transcription Factor
atgacaaagaaagtgaacttgaaaaggatacatggacttgaactagctagagaagtggagaatactctatgcacaaggaggcatattgttagctacaatgccaacgacgccatctcctgtagtgatcaacaagcttataacatgcccttgttcagtgatatcatttcctatcccaaacaagatgtccctcctcctttatctctctgcttgccctctccttttatcccttgtgatcagcaagaatttgaagaccatcttatttttctccaacaaaactatgaccttttttttcaggagcaacccttgagagctacagctactagtactaatctatcccagagtactgttgttaataacatggcggattccaataaaagtgccgttattgagctagccggaatctgcaacaagaaatccaacaacagcactgatcagatcctaagaaagagatcttcaaagagagatcggcatagcaagattaacacggctcaaggaccaagagatcggagaatgagattgtcactaaaggttgccagagagttctttgatctgcaagacaagctacgctttgataaagctagcaagactgttgaatggttactcatacaggcaaagaatgaaatcaagaaactatccagtggctccccccatatgaattatagcggcagtgatggcaccaagagtgcatcttctacttctgagcgtgaaatgctgaccgaaatcaatattgaaactaccacgaaagggaggaatgtttccaagggtagatcctcaccatgtgtcaagaaagagaggactaggagagcatcatcgcgtaaaactccattcaacccttttgcaaaggaatcaagggagaaggcaagagcaagagcgagggagagaacgaaagaaaagtacttgtgcagtcgaagaatcgacaaattgaagttttctgaagaatcatcaaacaatgaattgaatcaattcgcaggttgttgggatactccattagaaactggtgatcaagaatctggcactcacaattttaatccttccttagaagttcagctagctgaagttgatgtggcaatctatcacgagcgagagaaattacgtactccagagggcatgattgatgaaaacttggtgattatgggcaagtactggagtccctcttttctcaataatctgcacaacactggaactcctgatcaggagcatcaattctcagactttcaatacaagacatgggatcaggcatgcaccattggcactttgcatctggagattttccagcgatgtgctttctcaatgattgttaagtag

SEQ ID NO: 3505 - protein, 387 aa, Populus balsamifera subsp. trichocarpa
  misc_feature (1)..(387): Ceres ANNOT ID no. 1467936
  misc_feature (90)..(251): Pfam Name: TCP Pfam Description: TCP family transcription factor
  misc_feature 389623:<222: Transcription Factor
  misc_feature (1)..(387): Functional Homolog of  Ceres CDNA ID no. 2731458 at SEQ ID NO. 3544 with e-value of 3.00E-25 and BLAST sequence identity of 53.0
MPLFSDIISYPKQDVPPPLSLCLPSPFIPCDQQEFEDHLIFLQQNYDLFFQEQPLRATATSTNLSQSTVVNNMADSNKSAVIELAGICNKKSNNSTDQILRKRSSKRDRHSKINTAQGPRDRRMRLSLKVAREFFDLQDKLRFDKASKTVEWLLIQAKNEIKKLSSGSPHMNYSGSDGTKSASSTSEREMLTEINIETTTKGRNVSKGRSSPCVKKERTRRASSRKTPFNPFAKESREKARARARERTKEKYLCSRRIDKLKFSEESSNNELNQFAGCWDTPLETGDQESGTHNFNPSLEVQLAEVDVAIYHEREKLRTPEGMIDENLVIMGKYWSPSFLNNLHNTGTPDQEHQFSDFQYKTWDQACTIGTLHLEIFQRCAFSMIVK

SEQ ID NO: 3506 - protein, 631 aa, Arabidopsis thaliana
  misc_feature (1)..(631): Ceres CDNA ID no. 2999012
  misc_feature (1)..(631): Also Known As Ceres GEMINI ID 5110B6
  misc_feature (177)..(616): Pfam Name: DUF647 Pfam Description: Protein of unknown function, DUF647
  misc_feature 389738:<222: Transcription Factor
  misc_feature: Phenotype: Activates expression of the gene endogenous to the AtHMGS (SEQ ID NO 4144) regalutory region Useful for modulating Terpenoid Biosynthesis
MSCSYLLSGDASVVASRRWSDVSSRQRLFLPRQSLRQPSGSSFSRCVRLVANVNDHFSKQSLATRNCLASVFSADLGGSNGNNDNGNGGGGGGDGGGDNSDDSSFDLRYLCFLLLGLSCFFHFRLSAASAIAKDQNSDSNGDAVKETVWEVRGSKRKRLVPDFVKDEFVSEESAFELSSSLTPENLLAQCRNLLTQFLLPEGFPNSVTSDYLDYSLWRGVQGIASQISGVLATQSLLYAVGLGKGAIPTAAAINWVLKDGIGYLSKIMLSKYGRHFDVHPKGWRLFADLLENAAFGMEMLTPVFPQFFVMIGAAAGAGRSAAALIQAATRSCFNAGFASQRNFAEVYNNFYMALVLITYQQLFVFLNYSGSLGEAQGMVSKSVGILLGIVVANCIGTSTSLALAAFGVVTTIHMYTNLKSYQCIQLRTLNPYRASLVFSEYLISGQAPLIKEVNDEEPLFPTVRFSNMKSPEKLQDFVLSSEAKAAAADIEERLQLGSKLSDVIHNKEEAIALFDLYRNEGYILTEHKGRFCVMLKESSTPQDMLRSLFQVNYLYWLEKNAGIEPASTYSDCKPGGRLHISLDYVRREFEHAKEDSESVGWVTEGLIARPLPTRIRLGHDRELLLSSPNSS

SEQ ID NO: 3507 - DNA, 1737 bp, Populus balsamifera subsp. trichocarpa
  misc_feature (1)..(1737): Ceres ANNOT ID no. 1492433
  misc_feature 389883:<222: Transcription Factor
  misc_feature: Phenotype: Activates expression of the gene endogenous to the AtHMGS (SEQ ID NO 4144) regalutory region Useful for modulating Terpenoid Biosynthesis
atggattgcgcttgcagaccctttttcctctggggaacatggatgtccaccacccctagaaccacttctcctcccaacaccatcagcctgccacttattaacagcagaagctctactccgccatcgccacctcgtctcaaggctaccacttctcctttcaatttttccgtggacttgccaagtggcggaaacaacaatcacggtggccggaacagcaacaataacaataaagggtggtggtggcggcggtggtggaatgatggcagtgactcttccaataccttttccctgttgttcttattaagctcatccattgtgctgcaattagcttcttctgcagctgcaagaactcaacaagaagagggagaggaggtttgggaagttaaagggagcaaccgggctagacttattcctgatttctccaaggatgagtttgtagtgtctccaacatcatcatcgtcactgttttctgttaatgatttatggtcgcaatgcacaaccttgttcgtgcgcctaatgcttccccaaggatttcctcgaagtgttacctctgattacttggattactctctttggcgagcagtccaaggcatcgccagccaaattagcggcgttcttgccacccaggcattgctttatgctgttgggttggggaaaggagctatcccaactgctgctgccatcaattgggtgctaaaggatggaattgggtatctcagtaaaatcgtattgtccaaatatggacgacattttgatgttcatcctaaagggtggagactgtttgctgaccttttggaaaatgctgcctttggtttggagatgttaacgcctgcgtttcctcatctctttgttttcattggtgccactgctggagctggacgctctgctgctgctcttatccaggctgctacaagaagctgtttttatgctggttttgctgctcaaagaaactttgctgaggtaattgccaagggtgaagctcaaggaatggtgagcaagtttattggtataatgcttggtatagcattggctaattgcataggctcctcaacaccccttgcccttgcttctttcagtgtggtgacatggatccacatgttctgcaatctgaaatcgtatcaatccattcaattaaggactttaaatccttatcgtgcaagtttagtttttagcgagtacctcctcagcggccaagcacctccagtcaaagagatcaatgatgaagaaccactttttccagctgtaccatttcttaatatctactctaagggcaatgtacaatcaatcgttctatcttcagaagcgaggaatgcagctgctgaaatcgagcagaggctgcagctggggtctaagctcagtgatgttgtcaacaacaaggacgatgtgcttgcattgttcaatttgtatagagatgaaggctatattttgactgagcacaagggaagattctgtgtagtgcttaaagaaagttcttcaccacatgacatgctcaagtcactgttccaagttaattatttatactggttggagagaaatgctggaattgaagcaagaagtatctctgctgactgcagacctgaggggaggctacaaatctctctggaatatgcccgacgggaattcaaccatgtgaaaaatgatagtgtatcaatgggttgggtcgctgatggactaattgccaggccttcaccaattagagtttgtcctggaaacatagcctcttcaattgcaagctga

SEQ ID NO: 3508 - protein, 564 aa, Populus balsamifera subsp. trichocarpa
  misc_feature (1)..(564): Ceres ANNOT ID no. 1492433
  misc_feature (138)..(554): Pfam Name: DUF647 Pfam Description: Protein of unknown function, DUF647
  misc_feature 389972:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(564): Functional Homolog of  Ceres CDNA ID no. 2999012 at SEQ ID NO. 3553 with e-value of 6.70E-179 and BLAST sequence identity of 72.1
MSTTPRTTSPPNTISLPLINSRSSTPPSPPRLKATTSPFNFSVDLPSGGNNNHGGRNSNNNNKGWWWRRWWNDGSDSSNTFSLLFLLSSSIVLQLASSAAARTQQEEGEEVWEVKGSNRARLIPDFSKDEFVVSPTSSSSLFSVNDLWSQCTTLFVRLMLPQGFPRSVTSDYLDYSLWRAVQGIASQISGVLATQALLYAVGLGKGAIPTAAAINWVLKDGIGYLSKIVLSKYGRHFDVHPKGWRLFADLLENAAFGLEMLTPAFPHLFVFIGATAGAGRSAAALIQAATRSCFYAGFAAQRNFAEVIAKGEAQGMVSKFIGIMLGIALANCIGSSTPLALASFSVVTWIHMFCNLKSYQSIQLRTLNPYRASLVFSEYLLSGQAPPVKEINDEEPLFPAVPFLNIYSKGNVQSIVLSSEARNAAAEIEQRLQLGSKLSDVVNNKDDVLALFNLYRDEGYILTEHKGRFCVVLKESSSPHDMLKSLFQVNYLYWLERNAGIEARSISADCRPEGRLQISLEYARREFNHVKNDSVSMGWVADGLIARPSPIRVCPGNIASSIAS

SEQ ID NO: 3509 - DNA, 1725 bp, Populus balsamifera subsp. trichocarpa
  misc_feature (1)..(1725): Ceres ANNOT ID no. 1439568
  misc_feature 390113:<222: Transcription Factor
  misc_feature: Phenotype: Activates expression of the gene endogenous to the AtHMGS (SEQ ID NO 4144) regalutory region Useful for modulating Terpenoid Biosynthesis
atggattgcgcttgcagaccctttttcctctggggaacatggatgtccaccacccctagaaccacttctcctcccaacaccatcagcctgccacttattaacagcagaagctctactccgccatcgccacctcgtctcaaggctaccacttctcctttcaatttttccgtggacttgccaagtggcggaaacaacaatcacggtggccggaacagcaacaataacaataaagggtggtggtggcggcggtggtggaatgatggcagtgactcttccaataccttttccctgttgttcttattaagctcatccattgtgctgcaattagcttcttctgcagctgcaagaactcaacaagaagagggagaggaggtttgggaagttaaagggagcaaccgggctagacttattcctgatttctccaaggatgagtttgtagtgtctccaacatcatcatcgtcactgttttctgttaatgatttatggtcgcaatgcacaaccttgttcgtgcgcctaatgcttccccaaggatttcctcgaagtgttacctctgattacttggattactctctttggcgagcagtccaaggcatcgccagccaaattagcggcgttcttgccacccaggcattgctttatgctgttgggttggggaaaggagctatcccaactgctgctgccatcaattgggtgctaaaggatggaattgggtatctcagtaaaatcgtattgtccaaatatggacgacattttgatgttcatcctaaagggtggagactgtttgctgaccttttggaaaatgctgcctttggtttggagatgttaacgcctgcgtttcctcatctctttgttttcattgagttgcttaaagtggatgctcataatttgcaggctgctacaagaagctgtttttatgctggttttgctgctcaaagaaactttgctgaggtaattgccaagggtgaagctcaaggaatggtgagcaagtttattggtataatgcttggtatagcattggctaattgcataggctcctcaacaccccttgcccttgcttctttcagtgtggtgacatggatccacatgttctgcaatctgaaatcgtatcaatccattcaattaaggactttaaatccttatcgtgcaagtttagtttttagcgagtacctcctcagcggccaagcacctccagtcaaagagatcaatgatgaagaaccactttttccagctgtaccatttcttaatatctactctaagggcaatgtacaatcaatcgttctatcttcagaagcgaggaatgcagctgctgaaatcgagcagaggctgcagctggggtctaagctcagtgatgttgtcaacaacaaggacgatgtgcttgcattgttcaatttgtatagagatgaaggctatattttgactgagcacaagggaagattctgtgtagtgcttaaagaaagttcttcaccacatgacatgctcaagtcactgttccaagttaattatttatactggttggagagaaatgctggaattgaagcaagaagtatctctgctgactgcagacctgaggggaggctacaaatctctctggaatatgcccgacgggaattcaaccatgtgaaaaatgatagtgtatcaatgggttgggtcgctgatggactaattgccaggccttcaccaattagagtttgtcctggaaacatagcctcttcaattgcaagctga

SEQ ID NO: 3510 - protein, 560 aa, Populus balsamifera subsp. trichocarpa
  misc_feature (1)..(560): Ceres ANNOT ID no. 1439568
  misc_feature (138)..(550): Pfam Name: DUF647 Pfam Description: Protein of unknown function, DUF647
  misc_feature 390202:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(560): Functional Homolog of  Ceres CDNA ID no. 2999012 at SEQ ID NO. 3553 with e-value of 1.60E-170 and BLAST sequence identity of 70.2
MSTTPRTTSPPNTISLPLINSRSSTPPSPPRLKATTSPFNFSVDLPSGGNNNHGGRNSNNNNKGWWWRRWWNDGSDSSNTFSLLFLLSSSIVLQLASSAAARTQQEEGEEVWEVKGSNRARLIPDFSKDEFVVSPTSSSSLFSVNDLWSQCTTLFVRLMLPQGFPRSVTSDYLDYSLWRAVQGIASQISGVLATQALLYAVGLGKGAIPTAAAINWVLKDGIGYLSKIVLSKYGRHFDVHPKGWRLFADLLENAAFGLEMLTPAFPHLFVFIELLKVDAHNLQAATRSCFYAGFAAQRNFAEVIAKGEAQGMVSKFIGIMLGIALANCIGSSTPLALASFSVVTWIHMFCNLKSYQSIQLRTLNPYRASLVFSEYLLSGQAPPVKEINDEEPLFPAVPFLNIYSKGNVQSIVLSSEARNAAAEIEQRLQLGSKLSDVVNNKDDVLALFNLYRDEGYILTEHKGRFCVVLKESSSPHDMLKSLFQVNYLYWLERNAGIEARSISADCRPEGRLQISLEYARREFNHVKNDSVSMGWVADGLIARPSPIRVCPGNIASSIAS

SEQ ID NO: 3511 - protein, 563 aa, Arabidopsis thaliana
  misc_feature (1)..(563): Ceres CDNA ID no. 4811190
  misc_feature (17)..(502): Pfam Name: MFS_1 Pfam Description: Major Facilitator Superfamily
  misc_feature: Utility: MSX Useful for making plants tolerant to low nitrogen
  misc_feature: Phenotype: WHOLE PLANT - MSX Useful for making plants tolerant to low nitrogen
MDLEQKTRGLSKSCALLIVIAGMERYAFKGVASNLVTYLTDVVKMSNSRAAKTVNTWAGFTSMLPLFSAPLADTYWDRFFTILASSSVYFVGLVGLTWTAFAGSRSATKTISSYFLYSSLCLVSIGLGVLNPSLQAFGADQLDHDLDKNFDLSSGDQKDAKATRKTQFFQLWYFGVCTGSLMGVTVMAYIQDTFGWVLGFAIPGIVIFLSILVFMSGCGIYVYAPGARLKKKTTTTPFEKILKFIKGRVVKQRSIYTLADEKDLDAMELELEERPLCKCETEDIETPSTTSKGLEDDESSKTVFSGIDNVKLVIRLFPIWMMLLMFAVIFQLPATFFTKQGVTMKRNIGSNFKIPPATLQSTITLSIILLMPLYDKILIPITKRIKKNGTGISVMERMGVGMFLSIIAIVIAAIVERKRLAISQKMKTLPDYDPETVPLSIFWLLPQYILLGISDIFTVVGMQEFFYSEVPVRMRTMGFALYTSVFGVGSFVSAALISIVEAYSSSTGDRQNWFADDMSEARLDKYYWLLALTSTISFVVYIFLCKFFKSSSDQGDEKEEAPK

SEQ ID NO: 3512 - DNA, 1608 bp, Populus balsamifera subsp. trichocarpa
  misc_feature (1)..(1608): Ceres ANNOT ID no. 1482936
  misc_feature 390485:<222: Transcription Factor
  misc_feature: Phenotype: WHOLE PLANT - MSX Useful for making plants tolerant to low nitrogen
atggccagtgggcagaaaccaaaagggctcaacaagtcattgatagctggtatggaaaggtttgcattcaaaggggtggcatcaaatttggtaacttatcttacagatgtggttaagatgagcaactctgctgcagccaagactgttaataattggtgtggattcacatccatgttaccacttctagttgcatcgcttgctgattcatgggatcggtattccaccattctaacctcttcctttatttatgttgtgggacttgtggcattgacatcaacagcattgtcttgggcaaggcatcccaccaacaaaataagctcctcatacctgttttggtcgctctgtttgatttctctaggacaaggtggatataacccatctttacaagcctttggagcagatcaaattgcgaacgatgatgagctgccgagcacaaaagatgagcagaaatcaaataagaagagcttattctttcagtggtggtattttggggtttgtggtggcagccttgcaggtgtcacagtcatgtcctatatccaagacacatttggctgggtactcggatttgcaattcctacaatcgcaatgggagcatcaattttactgttttggtgtggaagcagaatttatgcatacaaacaggatgatgccatctctgagaggccttcgcgggacatagttcgatccattaaggaagctctttcgaaattgatgaatagcagaatcaccttaccaaacaacaatcctggagttgttgagctggagcttcaagaaaaacctctttgtcagaattcgggcaatgccaagggattgaaggaggaaccctgcagtggtattaactacctagttgaaaatggaaaagtagtattaaggcttttgccgatatggacgatgctgctaatgtttgcagtcatctttcagcagcctgccacattcttcaccaaacagggaatgacaatgaagaggaatgtaggcagcagcttcaagatcccaccagctacactacaaagtgctattacagtttctataatcctcctgatgccattttatgatgcgttgctgatcccatttactcgactgattactcgcgacaaaaagggtatcagtgtgactcaaagaatgggtatcgggatggtactgtccataatagccatggtcattgctgcattggttgaaacaaaaagactcgaaatcagcagaaaaatggaagttcttgatccaaaattggaaacagaagttcctttaagcatattttggttgctgcctcagtacattctgcttggcatctctgacatcttcactgttgttgggatgcaagagtttttctatagtgaagttcctgtaagaatgagaacaatgggaattgcactatacactagtgtatttggggtgggaagcttcttgagtgccctgttgatttcactagtagaatatttcacaagctcaagaggcaaagggcggagctggttctctgatgacatgagagaagcccgtttcgacaaatactattggcttctagccttgttaagtgtactcagcttagtgttttatgttattttctgcaaatgttttgtaagcagaagcagtgatttggataatgagaactag

SEQ ID NO: 3513 - protein, 535 aa, Populus balsamifera subsp. trichocarpa
  misc_feature (1)..(535): Ceres ANNOT ID no. 1482936
  misc_feature (283)..(462): Pfam Name: PTR2 Pfam Description: POT family
  misc_feature (58)..(134): Pfam Name: MFS_1 Pfam Description: Major Facilitator Superfamily
  misc_feature: SWISSPROT Homolog: PTR2_ARATH Peptide transporter PTR2 (Histidine-transporting protein) with e-value of 4.8e-76 and BLAST sequence identity of 31.3
  misc_feature: SWISSPROT Homolog: CHL1_ARATH Nitrate/chlorate transporter with e-value of 8.6e-61 and BLAST sequence identity of 29.7
  misc_feature: SWISSPROT Homolog: S15A1_HUMAN Oligopeptide transporter, small intestine isoform with e-value of 1.4e-26 and BLAST sequence identity of 23.6
  misc_feature: SWISSPROT Homolog: S15A1_HUMAN Peptide transporter 1 Intestinal H(+)/peptide cotransporter Solute carrier family 15 member 1
  misc_feature: SWISSPROT Homolog: S15A1_RABIT Oligopeptide transporter, small intestine isoform with e-value of 1.2e-25 and BLAST sequence identity of 24.2
  misc_feature: SWISSPROT Homolog: S15A1_RABIT Peptide transporter 1 Intestinal H(+)/peptide cotransporter Solute carrier family 15 member 1
  misc_feature: SWISSPROT Homolog: S15A1_RAT Oligopeptide transporter, small intestine isoform with e-value of 7.2e-24 and BLAST sequence identity of 22.7
  misc_feature: SWISSPROT Homolog: S15A1_RAT Peptide transporter 1 Intestinal H(+)/peptide cotransporter Solute carrier family 15 member 1 (Proton-coupled dipeptide cotransporter)
  misc_feature 390639:<222: Transcription Factor
  misc_feature: Phenotype: WHOLE PLANT - MSX Useful for making plants tolerant to low nitrogen
  misc_feature (1)..(535): Functional Homolog of  Ceres CDNA ID no. 4811190 at SEQ ID NO. 3558 with e-value of 1.70E-164 and BLAST sequence identity of 65.4
MASGQKPKGLNKSLIAGMERFAFKGVASNLVTYLTDVVKMSNSAAAKTVNNWCGFTSMLPLLVASLADSWDRYSTILTSSFIYVVGLVALTSTALSWARHPTNKISSSYLFWSLCLISLGQGGYNPSLQAFGADQIANDDELPSTKDEQKSNKKSLFFQWWYFGVCGGSLAGVTVMSYIQDTFGWVLGFAIPTIAMGASILLFWCGSRIYAYKQDDAISERPSRDIVRSIKEALSKLMNSRITLPNNNPGVVELELQEKPLCQNSGNAKGLKEEPCSGINYLVENGKVVLRLLPIWTMLLMFAVIFQQPATFFTKQGMTMKRNVGSSFKIPPATLQSAITVSIILLMPFYDALLIPFTRLITRDKKGISVTQRMGIGMVLSIIAMVIAALVETKRLEISRKMEVLDPKLETEVPLSIFWLLPQYILLGISDIFTVVGMQEFFYSEVPVRMRTMGIALYTSVFGVGSFLSALLISLVEYFTSSRGKGRSWFSDDMREARFDKYYWLLALLSVLSLVFYVIFCKCFVSRSSDLDNEN

SEQ ID NO: 3514 - protein, 496 aa, Arabidopsis thaliana
  misc_feature (1)..(496): Ceres CDNA ID no. 12574909
  misc_feature (366)..(466): Pfam Name: mTERF Pfam Description: mTERF
MAGFSLYCFKNPRILFTLPSESPLFVLGSDKCSPATRRPSRKTRGFVVTYAHSNPKIINPKKKSRYGQTLSPYDSDEDDDDDDDDDDDDWLLNDDFAEVTEYEKKKPKSHKQTIAKKSVKKGIVKPEESETDEDDLDLGISPNATSEKKKESWRLDGRGKMSSRKYVEKLYPRLAEEIDIDPKCVPLLDYLSTFGLKESHFVQMYERHMPSLQINVFSAQERLDYLLSVGVKHRDIKRMLLRQPQILQYTVENNLKAHISFLMGLGIPNSKIGQIVAATPSLFSYSVENSLRPTIRYLIEEVGIKETDVGKVVQLSPQILVQRLDITWNTRYMFLSKELGAPRDSVVKMVKKHPQLLHYSIDDGFLPRINFLRSIGMCNSDILKVLTSLTQVLSLSLEDNLKPKYMYLVNELNNEVHILTKYPMYLSLSLDQRIRPRHRFLVELKKVRKGPFPLSSLVPNDESFCQQWAGTSVDTYLAFRQRLLLKEFANKYDKRG

SEQ ID NO: 3515 - DNA, 1485 bp, Populus balsamifera subsp. trichocarpa
  misc_feature (1)..(1485): Ceres ANNOT ID no. 1441536
  misc_feature 390891:<222: Transcription Factor
atggcagtttgttctgtttatccattaaaccctaatctcctctctcactctcttgctctttctctttcccatcattctcatgcttactggagtgtagaatcagtgagcagaataagaagaaatggcagaaaaggcagtatgactgttagggttttatccacccattcaaatgccaagattctcaaccctaaacgaaaatcacgctacggccacaccttcagtctctatgatactgatatcggtctcgatgattggttgctggatgatgaatttgcagagcctgtggattttgaagtcgatggaaagaaaagagttaattcacagaagaaaacaagtaccagagaaggtggccagagattattcaattcgagaactagcaagaacactcgggaaaagagtatggttggaaacttctatggtactaaaactagaacaaaagaagcggattcctctgacattaatggacaaggaaagctaatgacagggaaatctacggaggacagatatccaaagctatctgaagaaatagatttggatgaaaagtggctcccccttttggattacctaagcacgtttgggctgaaggaatcacactttatccaaatctatgagaggcacatgccatcactccaaataaatgtatgttctgcacgggagaggttggagtacctgcagagtattggcgtcaaacacagagatataaaaagaatacttttgaggcaaccgcaaattctagaatatacagtggagagtaatttgaagtctcatactgctttcttgattggtttaggtattccaaattccagaatagggcagataattgctgctgctccatctctattttcttatagtgttgagaattctctaaaacccacagttagatatatggttgaggaggttggaattgatgaaaaaaatataggaaaagttgtgcagctgagccctcaaatcctggttcagcggattgatgtatcatggaatactcgctatctttttctatccagggagctgggagcatccagggatagcgtagtaaagatggtaacaaaacatcctcagctccttcattacagcattgatgatggatttatcccaaggatcaatttcctgaggagtatcggaatgcataatggtgacatcttgaaagtcttgaccagccttacacaggtattgtctctgtcactggaagacaatctaaagccaaagtacaagtatttgatcaatgaacttcgtaatgaggtgcaatccttgaccaaataccctacgtacttaagcttgtctttagaccagagaattcgccctcgccataggttcttggttgccttaaagaaagctccgaaggggccgtttcctcttagttcatttgttccaactgatgaaagcttttgtcagcagtgggctggaactagtgtagataaatatttggcttttcggcaacaattgctactaaaagagttcgctaagaaatatgaaaaacgagggtaa

SEQ ID NO: 3516 - protein, 494 aa, Populus balsamifera subsp. trichocarpa
  misc_feature (1)..(494): Ceres ANNOT ID no. 1441536
  misc_feature (118)..(464): Pfam Name: mTERF Pfam Description: mTERF
  misc_feature 390965:<222: Transcription Factor
  misc_feature (1)..(494): Functional Homolog of  Ceres CDNA ID no. 12574909 at SEQ ID NO. 3561 with e-value of 5.10E-165 and BLAST sequence identity of 70.5
MAVCSVYPLNPNLLSHSLALSLSHHSHAYWSVESVSRIRRNGRKGSMTVRVLSTHSNAKILNPKRKSRYGHTFSLYDTDIGLDDWLLDDEFAEPVDFEVDGKKRVNSQKKTSTREGGQRLFNSRTSKNTREKSMVGNFYGTKTRTKEADSSDINGQGKLMTGKSTEDRYPKLSEEIDLDEKWLPLLDYLSTFGLKESHFIQIYERHMPSLQINVCSARERLEYLQSIGVKHRDIKRILLRQPQILEYTVESNLKSHTAFLIGLGIPNSRIGQIIAAAPSLFSYSVENSLKPTVRYMVEEVGIDEKNIGKVVQLSPQILVQRIDVSWNTRYLFLSRELGASRDSVVKMVTKHPQLLHYSIDDGFIPRINFLRSIGMHNGDILKVLTSLTQVLSLSLEDNLKPKYKYLINELRNEVQSLTKYPTYLSLSLDQRIRPRHRFLVALKKAPKGPFPLSSFVPTDESFCQQWAGTSVDKYLAFRQQLLLKEFAKKYEKRG

SEQ ID NO: 3517 - protein, 518 aa, Arabidopsis thaliana
  misc_feature (1)..(518): Ceres CDNA ID no. 12672729
  misc_feature (244)..(280): Pfam Name: WD40 Pfam Description: WD domain, G-beta repeat
  misc_feature: Phenotype: WHOLE PLANT - Dark Green Useful for increasing chlorophyll and photosynthetic capacity
  misc_feature: Phenotype: WHOLE PLANT - Small Useful for modulating plant size
MEEEDPTASNVITNSNSSSMRNLSPAMNTPVVSLESRINRLINANQSQSPSPSSLSRSIYSDRFIPSRSGSNFALFDLSPSPSKDGKEDGAGSYATLLRAAMFGPETPEKRDITGFSSSRNIFRFKTETHRSLNSFSPFGVDDDSPGVSHSGPVKAPRKVPRSPYKILDLVDFRSLVSIMHETICDLCDVLVSEGLEFESEVLDAPALQDDFYLNLVDWSAQNVLAVGLGNCVYLWNACSSKVTKLCDLGAEDSVCSVGWALRGTHLAVGTSTGKVQIWDASRCKRTRTMEGHRLRVGALAWGSSVLSSGSRDKSILQRDIRCQEDHVSKLAGHKSEVCGLKWSYDNRELASGGNDNRLFVWNQHSTQPVLKYSEHTAAVKAIAWSPHVHGLLASGGGTADRCIRFWNTTTNTHLSSIDTCSQVCNLAWSKNVNELVSTHGYSQNQIIVWKYPTMSKIATLTGHTYRVLYLAVSPDGQTIVTGAGDETLRFWNVFPSPKSQNTDSEIGSSFFGRTTIR

SEQ ID NO: 3518 - DNA, 1479 bp, Populus balsamifera subsp. trichocarpa
  misc_feature (1)..(1479): Ceres ANNOT ID no. 1500350
  misc_feature 391218:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
atggccgatcccacgatgtcaccgccaaaccaatcgcagctcaacgttgcagcttccacgacgcaacgtcgtcaacatcatttaaatcttgaaagcctagctccatcaccgtcatcatcggaacatgtcaaccgtctgattaattctaatcattatatttccccctcgagacctatttactccgataggtttattccctgtagatccagctcgaatttcgctcttttcaacatctctttgccctcgccttctgcaaccgcgggtagttcgccgggggacggagggaaggaggacaatcccaatgcgtatgcggcgttactcaggaatgcactttttggtcctcagactccggataagaaagactgggggacaggggcggctggacggaatattttccggtacaagacggagactaggcagtcaatgcactcgctttcgcctttcgggtttgatggtttaagtggtcctggtgttagtaatgttgctattaaggctcctaggaaggtttctagatcaccttataaggtattggatgcccctgcattgcatgatgatttttatttgaatttggtggattggtcgtcgcataatgtgttggcagtggggttagggacttgtgtgtatttatggaatgcttgtagtagcaaggtgaccaaattgtgtgatttggggaatgatgatggtgtatgttcagtaggatgggctcatcgtggtacacatcttgctgttggaaccagcaatgggaaagttcagatttgggatgcttcacgctgtaaaaggattagaatcatggagggtcatcgattgcgagttggggccttggcctggagttcatcaatgctgtcttctggtagccgggataagagcattcttcaacgagatatacgagcacaagaagactttgttagtaaactctctggacacaagtcagaggtttgtggactgaagtggtcttatgataaccgtgagttagcatcaggcggaaatgataatcgactttttgtttggaatcaacattcaacccaacctgtgctaaaatactgtgagcatacagcggctgtaaaagcaattgcttggtcaccccatcttcatggacttcttgcatccgggggtgggactgctgaccggtgtatacgattctggaatacaaccaccaactcacatctcagctgcatggacaccggcagtcaggtgtgcaatcttgtgtggtctaagaatgtcaatgaactagtcagcacacatggatactcccaaaaccaaataatagtatggagataccccaccatgtcaaagttggcaactctgacaggccatacatacagagttctttatcttgccatctcaccagacggacagacaattgtcactggagctggagatgaaactctgcggttttggaatgtgttcccttcccctaaatctcagaacacagagagtgaaattggagcatcatctctgggtagaactacaatccggtga

SEQ ID NO: 3519 - protein, 487 aa, Populus balsamifera subsp. trichocarpa
  misc_feature (1)..(487): Ceres ANNOT ID no. 1500350
  misc_feature (337)..(366): Pfam Name: WD40 Pfam Description: WD domain, G-beta repeat
  misc_feature: SWISSPROT Homolog: FZR_HUMAN Fizzy-related protein homolog (Fzr) (Cdh1/Hct1 homolog) (hCDH1) (CDC20-like protein 1) with e-value of 2.5e-118 and BLAST sequence identity of 52.2
  misc_feature: SWISSPROT Homolog: FZR_MOUSE Fizzy-related protein homolog (Fzr) (Cdh1/Hct1 homolog) with e-value of 2.5e-118 and BLAST sequence identity of 52.5
  misc_feature: SWISSPROT Homolog: SRW1_SCHPO WD-repeat-containing protein srw1 (Suppressor of rad/wee1) with e-value of 6.2e-104 and BLAST sequence identity of 54.8
  misc_feature: SWISSPROT Homolog: MFR1_SCHPO Meiotic fizzy-related protein 1 with e-value of 4.1e-93 and BLAST sequence identity of 55.3
  misc_feature: SWISSPROT Homolog: CDH1_YEAST APC/C activator protein CDH1 (CDC20 homolog 1) (Homolog of CDC twenty 1) with e-value of 8.6e-90 and BLAST sequence identity of 48.4
  misc_feature 391345:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature (1)..(487): Functional Homolog of  Ceres CDNA ID no. 12672729 at SEQ ID NO. 3564 with e-value of 8.10E-190 and BLAST sequence identity of 78.1
MSPPNQSQLNVAASTTQRRQHHLNLESLAPSPSSSEHVNRLINSNHYISPSRPIYSDRFIPCRSSSNFALFNISLPSPSATAGSSPGDGGKEDNPNAYAALLRNALFGPQTPDKKDWGTGAAGRNIFRYKTETRQSMHSLSPFGFDGLSGPGVSNVAIKAPRKVSRSPYKVLDAPALHDDFYLNLVDWSSHNVLAVGLGTCVYLWNACSSKVTKLCDLGNDDGVCSVGWAHRGTHLAVGTSNGKVQIWDASRCKRIRIMEGHRLRVGALAWSSSMLSSGSRDKSILQRDIRAQEDFVSKLSGHKSEVCGLKWSYDNRELASGGNDNRLFVWNQHSTQPVLKYCEHTAAVKAIAWSPHLHGLLASGGGTADRCIRFWNTTTNSHLSCMDTGSQVCNLVWSKNVNELVSTHGYSQNQIIVWRYPTMSKLATLTGHTYRVLYLAISPDGQTIVTGAGDETLRFWNVFPSPKSQNTESEIGASSLGRTTIR

SEQ ID NO: 3520 - protein, 637 aa, Arabidopsis thaliana
  misc_feature (1)..(637): Ceres CDNA ID no. 12676498
  misc_feature (1)..(637): Also Known As Ceres GEMINI ID 5110F8
  misc_feature (164)..(249): Pfam Name: WGR Pfam Description: WGR domain
  misc_feature (286)..(419): Pfam Name: PARP_reg Pfam Description: Poly(ADP-ribose) polymerase, regulatory domain
  misc_feature (421)..(633): Pfam Name: PARP Pfam Description: Poly(ADP-ribose) polymerase catalytic domain
  misc_feature (69)..(103): Pfam Name: SAP Pfam Description: SAP domain
  misc_feature 391510:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtSS1 (SEQ ID NO 4158) regalutory region Useful for modulating Alkaloid Biosynthesis
MANKLKVDELRLKLAERGLSTTGVKAVLVERLEEAIAEDTKKEESKSKRKRNSSNDTYESNKLIAIGEFRGMIVKELREEAIKRGLDTTGTKKDLLERLCNDANNVSNAPVKSSNGTDEAEDDNNGFEEEKKEEKIVTATKKGAAVLDQWIPDEIKSQYHVLQRGDDVYDAILNQTNVRDNNNKFFVLQVLESDSKKTYMVYTRWGRVGVKGQSKLDGPYDSWDRAIEIFTNKFNDKTKNYWSDRKEFIPHPKSYTWLEMDYGKEENDSPVNNDIPSSSSEVKPEQSKLDTRVAKFISLICNVSMMAQHMMEIGYNANKLPLGKISKSTISKGYEVLKRISEVIDRYDRTRLEELSGEFYTVIPHDFGFKKMSQFVIDTPQKLKQKIEMVEALGEIELATKLLSVDPGLQDDPLYYHYQQLNCGLTPVGNDSEEFSMVANYMENTHAKTHSGYTVEIAQLFRASRAVEADRFQQFSSSKNRMLLWHGSRLTNWAGILSQGLRIAPPEAPVTGYMFGKGVYFADMFSKSANYCYANTGANDGVLLLCEVALGDMNELLYSDYNADNLPPGKLSTKGVGKTAPNPSEAQTLEDGVVVPLGKPVERSCSKGMLLYNEYIVYNVEQIKMRYVIQVKFNYKH

SEQ ID NO: 3521 - DNA, 1905 bp, Populus balsamifera subsp. trichocarpa
  misc_feature (1)..(1905): Ceres ANNOT ID no. 1525070
  misc_feature 391663:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtSS1 (SEQ ID NO 4158) regalutory region Useful for modulating Alkaloid Biosynthesis
atggcaaataagctcaaagtagacgagcttcgagccgaactcgctaaacgtggactcgataccaccggaaccaagccttccctggtgcggagactggaatcggcactcgagcaagaaaacaagcagtcagaagtggactcggtcgatggtggaggtagtagtaacaacaaaagagaaagggagtctgaagatggaggaggagattctaataacgggacagagaaaatcaaggctattgaaaagtttcgggacatgaatgttaagcaattacgcgaacaggccagtctccttggagtttccactgccggaaccaagagacaattaattgacaggctctgcaacgctgaaccagacaatcaccattcacttcaaccaaaagaagaagagcaggaacagggtgaaaaggaaaaggataaaattgtaactgctacgaaaaagggcgcggcggtgctagatcagtttctttctgatcagataaagtcagagtatcatgttttgcaaataggtgatgatgtctatgatgccatgctgaatcagacaaatgttggggacaacaataacaagttctatgtgattcaacttcttgaatctgatggtggtggtagatatatggtctataacagatggggtagggttggggtgaatggtcaagttaagctatttggtccctacacttcacgagatcctgctgtttctgagtttgaacggaagttctacgccaagacaaagaacgattggtccaagcgaaaggagttcatatgttacccaaagtgctatgctttgttggaaatggactacagtgagcaggaaaaggagccagttgttaaagaaaagcctgactctgctatagcaattcaacctcgggagacacaacttgagtcacgtattgccaaatttatctctcttatatgtaatgttagtatgatgaagcagcaaatgatggaaataggatacaatgcaaataaattgccacttggtaaattaagcaagtcaactatattaaagggttatgatgttttgaagaggatttctgatgtaattggaacagcagatatgttaaaacttgaacaactaagcggagaattttacactgtcattcctcatgattttggatttaaaaaaatgcgagagtttgttattgatactcctcagaagttaaaatgcaagctggaaatggttgaagccctaggcgagattcaagttgcaacaaagttgttggaggatgaacctggaatgcaggaagatcccctgtattctcattacaaccggctacgttgtgaattgactccagttgaagttgattctgaggactttgcaatgaatacgcatgcaaaaacacattcacagtatactgttgatattgctcaaatattcaaggtctcaagagaggatgaaaatgaaagcttcagaaagttctctaacacaaaaaatagaatgcttttatggcatggctcgcgcctcacaaactggactggcattctatcccaaggcttgcgtattgctccccctgaagcaccagtaactggttacatgtttggaaagggagtttactttgctgacatgttctccaaaagtgcaaattattgctatgcaaatcatgctgctccagctggtgtgctgcttctgtgtgaggttgctcttggagacatggctgaactattatatgcaaactatgatgctgataagttgccatcggggaagctaagcacgaaaggagttggtagaactgctccagatctttcagatgccagggcactggaggatggtgttgttgttccccttgggaagcccaaagagcagcgaggctcaaagggtgctttgctgtacaatgagtacatagtctacaacgtgggtcagattaggatgcgatatgtagttcaagtgaattttaattacaagcattaa

SEQ ID NO: 3522 - protein, 634 aa, Populus balsamifera subsp. trichocarpa
  misc_feature (1)..(634): Ceres ANNOT ID no. 1525070
  misc_feature (168)..(253): Pfam Name: WGR Pfam Description: WGR domain
  misc_feature (2)..(36): Pfam Name: SAP Pfam Description: SAP domain
  misc_feature (289)..(422): Pfam Name: PARP_reg Pfam Description: Poly(ADP-ribose) polymerase, regulatory domain
  misc_feature (424)..(630): Pfam Name: PARP Pfam Description: Poly(ADP-ribose) polymerase catalytic domain
  misc_feature: SWISSPROT Homolog: PARP2_ARATH Poly [ADP-ribose] polymerase 2 (EC 2.4.2.30) (PARP-2) (ADPRT 2) NAD (+) ADP-ribosyltransferase 2) (Poly[ADP-ribose] synthetase 2) with e-value of 0.0e+00 and BLAST sequence identity of 100.0
  misc_feature: SWISSPROT Homolog: PARP2_HUMAN Poly [ADP-ribose] polymerase 2 with e-value of 3.5e-119 and BLAST sequence identity of 44.7
  misc_feature: SWISSPROT Homolog: PARP2_HUMAN EC 2.4.2.30; (PARP-2) (NAD (+) ADP-ribosyltransferase 2)( Poly[ADP-ribose] synthetase 2) (pADPRT-2) (hPARP-2)
  misc_feature: SWISSPROT Homolog: PARP2_MOUSE Poly [ADP-ribose] polymerase 2 with e-value of 9.0e-114 and BLAST sequence identity of 45.8
  misc_feature: SWISSPROT Homolog: PARP2_MOUSE EC 2.4.2.30 (PARP-2) (NAD (+) ADP-ribosyltransferase 2) ( Poly[ADP-ribose] synthetase 2) (pADPRT-2) (mPARP-2)
  misc_feature: SWISSPROT Homolog: PARP1_XENLA Poly [ADP-ribose] polymerase with e-value of 1.8e-106 and BLAST sequence identity of 43.1
  misc_feature: SWISSPROT Homolog: PARP1_XENLA EC 2.4.2.30 (PARP) (ADPRT) (NAD(+) ADP-ribosyltransferase) ( Poly[ADP-ribose] synthetase) (Fragment)
  misc_feature: SWISSPROT Homolog: PARP1_RAT Poly [ADP-ribose] polymerase 1 (EC 2.4.2.30) (PARP-1) (ADPRT) (NAD (+) ADP-ribosyltransferase 1) (Poly[ADP-ribose] synthetase 1) with e-value of 4.3e-105 and BLAST sequence identity of 42.2
  misc_feature 391845:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtSS1 (SEQ ID NO 4158) regalutory region Useful for modulating Alkaloid Biosynthesis
  misc_feature (1)..(634): Functional Homolog of  Ceres CDNA ID no. 12676498 at SEQ ID NO. 3567 with e-value of 3.59E-219 and BLAST sequence identity of 69.0
MANKLKVDELRAELAKRGLDTTGTKPSLVRRLESALEQENKQSEVDSVDGGGSSNNKRERESEDGGGDSNNGTEKIKAIEKFRDMNVKQLREQASLLGVSTAGTKRQLIDRLCNAEPDNHHSLQPKEEEQEQGEKEKDKIVTATKKGAAVLDQFLSDQIKSEYHVLQIGDDVYDAMLNQTNVGDNNNKFYVIQLLESDGGGRYMVYNRWGRVGVNGQVKLFGPYTSRDPAVSEFERKFYAKTKNDWSKRKEFICYPKCYALLEMDYSEQEKEPVVKEKPDSAIAIQPRETQLESRIAKFISLICNVSMMKQQMMEIGYNANKLPLGKLSKSTILKGYDVLKRISDVIGTADMLKLEQLSGEFYTVIPHDFGFKKMREFVIDTPQKLKCKLEMVEALGEIQVATKLLEDEPGMQEDPLYSHYNRLRCELTPVEVDSEDFAMNTHAKTHSQYTVDIAQIFKVSREDENESFRKFSNTKNRMLLWHGSRLTNWTGILSQGLRIAPPEAPVTGYMFGKGVYFADMFSKSANYCYANHAAPAGVLLLCEVALGDMAELLYANYDADKLPSGKLSTKGVGRTAPDLSDARALEDGVVVPLGKPKEQRGSKGALLYNEYIVYNVGQIRMRYVVQVNFNYKH

SEQ ID NO: 3523 - DNA, 2058 bp, Populus balsamifera subsp. trichocarpa
  misc_feature (1)..(2058): Ceres ANNOT ID no. 1471655
  misc_feature 392006:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtSS1 (SEQ ID NO 4158) regalutory region Useful for modulating Alkaloid Biosynthesis
atggcaaataagctcaaagtagacgagcttcgagccgaactcgctaaacgtggactcgataccaccggaaccaagccttccctggtgcggagactggaatcggcactcgagcaagaaaacaagcagtcagaagtggactcggtcgatggtggaggtagtagtaacaacaaaagagaaagggagtctgaagatggaggaggagattctaataacgggacagagaaaatcaaggctattgaaaagtttcgggacatgaatgttaagcaattacgcgaacaggccagtctccttggagtttccactgccggaaccaagagacaattaattgacaggctctgcaacgctgaaccagacaatcaccattcacttcaaccaaaagaagaagagcaggaacagggtgaaaaggaaaaggataaaattgtaactgctacgaaaaagggcgcggcggtgctagatcagtttctttctgatcagataaagtcagagtatcatgttttgcaaataggtgatgatgtctatgatgccatgctgaatcagacaaatgttggggacaacaataacaagttctatgtgattcaacttcttggcaagctttcacttccgcccatgtgggttggggtgaatggtcaagttaagctatttggtccctacacttcacgagatcctgctgtttctgagtttgaacggaagttctacgccaagacaaagaacgattggtccaagcgaaaggagttcatatgttacccaaagtgctatgctttgttggaaatggactacagtgagcaggaaaaggagccagttgttaaagaaaagcctgactctgctatagcaattcaacctcgggagacacaacttgagtcacgtattgccaaatttatctctcttatatgtaatgttagtatgatgaagcagcaaatgatggaaataggatacaatgcaaataaattgccacttggtaaattaagcaagtcaactatattaaagggttatgatgttttgaagaggatttctgatgtaattggaacagcagatatgttaaaacttgaacaactaagcggagaattttacactgtcattcctcatgattttggatttaaaaaaatgcgagagtttgttattgatactcctcagaagttaaaatgcaagctggaaatggttgaagccctaggcgagattcaagttgcaacaaagttgttggaggatgaacctggaatgcaggaagatcccctgtattctcattacaaccggctacgttgtgaattgactccagttgaagttgattctgaggactttgcaatgaatacgcatgcaaaaacacattcacagtatactgttgatattgctcaaatattcaaggtctcaagagaggatgaaaatgaaagcttcagaaagttctctaacacaaaaaatagaatgcttttatggcatggctcgcgcctcacaaactggactggcattctatcccaaggcttgcgtattgctccccctgaagcaccagtaactggttacatgtttggaaagggagtttactttgctgacatgttctccaaaagtgcaaattattgctatgcaaatcatgctgctccagctgatcagacgtatacagatgttgcaaaacagactgttcttgctcaacaagatgtagacgcttccttaattgttgcctcaccaattgttttcatggaaaaattggtgttgtctttctggaacctgaagactgggttcattattcgaaattatgttccacatatttccatgactattgcgaccaagtatttcaactatgttgctcttggagacatggctgaactattatatgcaaactatgatgctgataagttgccatcggggaagctaagcacgaaaggagttggtagaactgctccagatctttcagatgccagggcactggaggatggtgttgttgttccccttgggaagcccaaagagcagcgaggctcaaagggtgctttgctgtacaatgagtacatagtctacaacgtgggtcagattaggatgcgatatgtagttcaagtgaattttaattacaagcattaa

SEQ ID NO: 3524 - protein, 685 aa, Populus balsamifera subsp. trichocarpa
  misc_feature (1)..(685): Ceres ANNOT ID no. 1471655
  misc_feature (168)..(246): Pfam Name: WGR Pfam Description: WGR domain
  misc_feature (2)..(36): Pfam Name: SAP Pfam Description: SAP domain
  misc_feature (282)..(415): Pfam Name: PARP_reg Pfam Description: Poly(ADP-ribose) polymerase, regulatory domain
  misc_feature (417)..(527): Pfam Name: PARP Pfam Description: Poly(ADP-ribose) polymerase catalytic domain
  misc_feature: SWISSPROT Homolog: PARP2_ARATH Poly [ADP-ribose] polymerase 2 (EC 2.4.2.30) (PARP-2) (ADPRT 2) NAD (+) ADP-ribosyltransferase 2) (Poly[ADP-ribose] synthetase 2) with e-value of 0.0e+00 and BLAST sequence identity of 100.0
  misc_feature: SWISSPROT Homolog: PARP2_HUMAN Poly [ADP-ribose] polymerase 2 with e-value of 3.5e-119 and BLAST sequence identity of 44.7
  misc_feature: SWISSPROT Homolog: PARP2_HUMAN EC 2.4.2.30; (PARP-2) (NAD (+) ADP-ribosyltransferase 2)( Poly[ADP-ribose] synthetase 2) (pADPRT-2) (hPARP-2)
  misc_feature: SWISSPROT Homolog: PARP2_MOUSE Poly [ADP-ribose] polymerase 2 with e-value of 9.0e-114 and BLAST sequence identity of 45.8
  misc_feature: SWISSPROT Homolog: PARP2_MOUSE EC 2.4.2.30 (PARP-2) (NAD (+) ADP-ribosyltransferase 2) ( Poly[ADP-ribose] synthetase 2) (pADPRT-2) (mPARP-2)
  misc_feature: SWISSPROT Homolog: PARP1_XENLA Poly [ADP-ribose] polymerase with e-value of 1.8e-106 and BLAST sequence identity of 43.1
  misc_feature: SWISSPROT Homolog: PARP1_XENLA EC 2.4.2.30 (PARP) (ADPRT) (NAD(+) ADP-ribosyltransferase) ( Poly[ADP-ribose] synthetase) (Fragment)
  misc_feature: SWISSPROT Homolog: PARP1_RAT Poly [ADP-ribose] polymerase 1 (EC 2.4.2.30) (PARP-1) (ADPRT) (NAD (+) ADP-ribosyltransferase 1) (Poly[ADP-ribose] synthetase 1) with e-value of 4.3e-105 and BLAST sequence identity of 42.2
  misc_feature 392194:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtSS1 (SEQ ID NO 4158) regalutory region Useful for modulating Alkaloid Biosynthesis
  misc_feature (1)..(685): Functional Homolog of  Ceres CDNA ID no. 12676498 at SEQ ID NO. 3567 with e-value of 3.69E-194 and BLAST sequence identity of 67.5
MANKLKVDELRAELAKRGLDTTGTKPSLVRRLESALEQENKQSEVDSVDGGGSSNNKRERESEDGGGDSNNGTEKIKAIEKFRDMNVKQLREQASLLGVSTAGTKRQLIDRLCNAEPDNHHSLQPKEEEQEQGEKEKDKIVTATKKGAAVLDQFLSDQIKSEYHVLQIGDDVYDAMLNQTNVGDNNNKFYVIQLLGKLSLPPMWVGVNGQVKLFGPYTSRDPAVSEFERKFYAKTKNDWSKRKEFICYPKCYALLEMDYSEQEKEPVVKEKPDSAIAIQPRETQLESRIAKFISLICNVSMMKQQMMEIGYNANKLPLGKLSKSTILKGYDVLKRISDVIGTADMLKLEQLSGEFYTVIPHDFGFKKMREFVIDTPQKLKCKLEMVEALGEIQVATKLLEDEPGMQEDPLYSHYNRLRCELTPVEVDSEDFAMNTHAKTHSQYTVDIAQIFKVSREDENESFRKFSNTKNRMLLWHGSRLTNWTGILSQGLRIAPPEAPVTGYMFGKGVYFADMFSKSANYCYANHAAPADQTYTDVAKQTVLAQQDVDASLIVASPIVFMEKLVLSFWNLKTGFIIRNYVPHISMTIATKYFNYVALGDMAELLYANYDADKLPSGKLSTKGVGRTAPDLSDARALEDGVVVPLGKPKEQRGSKGALLYNEYIVYNVGQIRMRYVVQVNFNYKH

SEQ ID NO: 3525 - DNA, 2013 bp, Populus balsamifera subsp. trichocarpa
  misc_feature (1)..(2013): Ceres ANNOT ID no. 1525069
  misc_feature 392364:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtSS1 (SEQ ID NO 4158) regalutory region Useful for modulating Alkaloid Biosynthesis
atggccgcgtcttgcttttttgagaagccgtcgaagaactcaaaaagtaaacaatgccagtgcctgtttttaacatggccatgccctccactttcaatactgctcggctgcacttctaaaagtcacgaaagctcgctcgctccatctcaagcgtttctaatggcaaacagtctcaagaggccgttaaaagtctcaaccggtcatgatgcttcatcacttggcaacaagaggcaaagggaagcacaagtacttgacggtcctgatatcgtgtctgagaaaatcaaggccattgaagatcttcacgacatgggaactcgccaactacgcgaacaagcaatcctccgaggcctttcttcaagtgggtcaaagaaagaactactagacaggctctgtgcagagtcagagaaagagtcaaagaacggtacacctgaaggcaaagaagaagacgaagaaaaagaaacaagcaacaaggacgagaaagttactgcgagtttcaacaaggtcactgccgagctggatcagtatctgcctgatcatttaaagacacagtaccatgttctagagcatggggatagtatctatgatgccacgttgaatcaaacaaatgttgggaataataacaacaagttctatctgattcaggctcttgaatctaatgactctagcaaattcatggtatacactagatggggtagagtaggaattaaaggtcaagacaagttgcaaggcccttacacatcaagaggcagtgctattcaggagttcgaagcaaaattttttgccaagacaaagaaccgttggcccaaccggaaagatttcatatgccacccaaagtgctatacttggttggaaacagaccatgacatgaacaaagagtcgtcagaggttacaaggcttgatcctcgaattgcaaattttatctctcttatctgtgatgttcgcatgatgaagcagcggatgatggaattagggtacaatgcagaaaagttaccccttggtaagctgagcaagtcgacaatcttaaagggctatgatgtcttgaggagaatatgtgagaatattggcaaatctgatacagaaaagcttgaggagttaagtggggaattctacacaataatacctcatgactttggttttaataagatgcgtgaatttaccattgacaaccattacaaactgaaatgcaagctggaaatggttgaagctctaggggaaattgaaatagctacatcattgatcaaggatgatatctatacccaagtattgatttctgattgtttactcactttcatcgtcaaattgtgctgcttgctgcttttcagcagttatctgattttctgttccgacttaattttcaaggaagatccgctctattcgaaatatcactgccttcgttgtgaattggtaccacttgacgttgtttccaaggaattctctatgattgaaaaatacatacgtaacactggtgatgaaacacattatagaatcgacgttgttcaaatatttagagcttcaagagaaggtgaaaatgaacggttcaaaaagttctctcaaacaaaaaacagaatgcttttgtggcatggttctcggctgacaaactggaccggtattttgtctgaagaagcaccatcaactcattctcttgggaacgggctttattttggtgatatgttttccaaaagtgcaccttattgccatgctaactggataaactcagatgctgtgctagttttgtgtgaggttgcactgggtgacatgcttgattatggatcttttaactgccatgataagttgccaaagggaaagctaagtgtaaaagtagctggaggaactgtcccggactcttcacaggctcaggttcttgaagacggtgttcttgttccactcggaaagccagtagagctgccttattcccagggtatgtggccgagaaatgagtacataattcttgacgtggatcagattcgaatacgttatgtggttcatgcaaagttctgctatcaaacctgttga

SEQ ID NO: 3526 - protein, 568 aa, Populus balsamifera subsp. trichocarpa
  misc_feature (1)..(568): Ceres ANNOT ID no. 1525069
  misc_feature (194)..(327): Pfam Name: PARP_reg Pfam Description: Poly(ADP-ribose) polymerase, regulatory domain
  misc_feature (362)..(563): Pfam Name: PARP Pfam Description: Poly(ADP-ribose) polymerase catalytic domain
  misc_feature (87)..(172): Pfam Name: WGR Pfam Description: WGR domain
  misc_feature: SWISSPROT Homolog: PARP2_ARATH Poly [ADP-ribose] polymerase 2 (EC 2.4.2.30) (PARP-2) (ADPRT 2) NAD (+) ADP-ribosyltransferase 2) (Poly[ADP-ribose] synthetase 2) with e-value of 0.0e+00 and BLAST sequence identity of 100.0
  misc_feature: SWISSPROT Homolog: PARP2_HUMAN Poly [ADP-ribose] polymerase 2 with e-value of 3.5e-119 and BLAST sequence identity of 44.7
  misc_feature: SWISSPROT Homolog: PARP2_HUMAN EC 2.4.2.30; (PARP-2) (NAD (+) ADP-ribosyltransferase 2)( Poly[ADP-ribose] synthetase 2) (pADPRT-2) (hPARP-2)
  misc_feature: SWISSPROT Homolog: PARP2_MOUSE Poly [ADP-ribose] polymerase 2 with e-value of 9.0e-114 and BLAST sequence identity of 45.8
  misc_feature: SWISSPROT Homolog: PARP2_MOUSE EC 2.4.2.30 (PARP-2) (NAD (+) ADP-ribosyltransferase 2) ( Poly[ADP-ribose] synthetase 2) (pADPRT-2) (mPARP-2)
  misc_feature: SWISSPROT Homolog: PARP1_XENLA Poly [ADP-ribose] polymerase with e-value of 1.8e-106 and BLAST sequence identity of 43.1
  misc_feature: SWISSPROT Homolog: PARP1_XENLA EC 2.4.2.30 (PARP) (ADPRT) (NAD(+) ADP-ribosyltransferase) ( Poly[ADP-ribose] synthetase) (Fragment)
  misc_feature: SWISSPROT Homolog: PARP1_RAT Poly [ADP-ribose] polymerase 1 (EC 2.4.2.30) (PARP-1) (ADPRT) (NAD (+) ADP-ribosyltransferase 1) (Poly[ADP-ribose] synthetase 1) with e-value of 4.3e-105 and BLAST sequence identity of 42.2
  misc_feature 392544:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtSS1 (SEQ ID NO 4158) regalutory region Useful for modulating Alkaloid Biosynthesis
  misc_feature (1)..(568): Functional Homolog of  Ceres CDNA ID no. 12676498 at SEQ ID NO. 3567 with e-value of 1.20E-155 and BLAST sequence identity of 59.3
MGTRQLREQAILRGLSSSGSKKELLDRLCAESEKESKNGTPEGKEEDEEKETSNKDEKVTASFNKVTAELDQYLPDHLKTQYHVLEHGDSIYDATLNQTNVGNNNNKFYLIQALESNDSSKFMVYTRWGRVGIKGQDKLQGPYTSRGSAIQEFEAKFFAKTKNRWPNRKDFICHPKCYTWLETDHDMNKESSEVTRLDPRIANFISLICDVRMMKQRMMELGYNAEKLPLGKLSKSTILKGYDVLRRICENIGKSDTEKLEELSGEFYTIIPHDFGFNKMREFTIDNHYKLKCKLEMVEALGEIEIATSLIKDDIYTQVLISDCLLTFIVKLCCLLLFSSYLIFCSDLIFKEDPLYSKYHCLRCELVPLDVVSKEFSMIEKYIRNTGDETHYRIDVVQIFRASREGENERFKKFSQTKNRMLLWHGSRLTNWTGILSEEAPSTHSLGNGLYFGDMFSKSAPYCHANWINSDAVLVLCEVALGDMLDYGSFNCHDKLPKGKLSVKVAGGTVPDSSQAQVLEDGVLVPLGKPVELPYSQGMWPRNEYIILDVDQIRIRYVVHAKFCYQTC

SEQ ID NO: 3527 - DNA, 2142 bp, Populus balsamifera subsp. trichocarpa
  misc_feature (1)..(2142): Ceres ANNOT ID no. 1471654
  misc_feature 392693:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtSS1 (SEQ ID NO 4158) regalutory region Useful for modulating Alkaloid Biosynthesis
atggccgcgtcttgcttttttgagaagccgtcgaagaactcaaaaagtaaacaatgccagtgcctgtttttaacatggccatgccctccactttcaatactgctcggctgcacttctaaaagtcacgaaagctcgctcgctccatctcaagcgtttctaatggcaaacagtctcaagaggccgttaaaagtctcaaccggtcatgatgcttcatcacttggcaacaagaggcaaagggaagcacaagtacttgacggtcctgatatcgtgtctgagaaaatcaaggccattgaagatcttcacgacatgggaactcgccaactacgcgaacaagcaatcctccgaggcctttcttcaagtgggtcaaagaaagaactactagacaggctctgtgcagagtcagagaaagagtcaaagaacggtacacctgaaggcaaagaagaagacgaagaaaaagaaacaagcaacaaggacgagaaagttactgcgagtttcaacaaggtcactgccgagctggatcagtatctgcctgatcatttaaagacacagtaccatgttctagagcatggggatagtatctatgatgccacgttgaatcaaacaaatgttgggaataataacaacaagttctatctgattcaggctcttgaatctaatgactctagcaaattcatggtatacactagatggggtagagtaggaattaaaggtcaagacaagttgcaaggcccttacacatcaagaggcagtgctattcaggagttcgaagcaaaattttttgccaagacaaagaaccgttggcccaaccggaaagatttcatatgccacccaaagtgctatacttggttggaaacagaccatgacatgaacaaagagtcgtcagaggagaaccctatttttactgttgaaaggcaactacaggttacaaggcttgatcctcgaattgcaaattttatctctcttatctgtgatgttcgcatgatgaagcagcggatgatggaattagggtacaatgcagaaaagttaccccttggtaagctgagcaagtcgacaatcttaaagggctatgatgtcttgaggagaatatgtgagaatattggcaaatctgatacagaaaagcttgaggagttaagtggggaattctacacaataatacctcatgactttggttttaataagatgcgtgaatttaccattgacaaccattacaaactgaaatgcaagctggaaatggttgaagctctaggggaaattgaaatagctacatcattgatcaaggatgatatctatacccaagtattgatttctgattgtttactcactttcatcgtcaaattgtgctgcttgctgcttttcagcagttatctgattttctgttccgacttaattttcaaggaagatccgctctattcgaaatatcactgccttcgttgtgaattggtaccacttgacgttgtttccaaggaattctctatgattgaaaaatacatacgtaacactggtgatgaaacacattatagaatcgacgttgttcaaatatttagagcttcaagagaaggtgaaaatgaacggttcaaaaagttagcagtggtgttccagacgtcacaaagtaatttgcagaaattatctgacagctctttcataaatcccccaggtttacgtattgctcctccagaagcaccatcaactcattctcttgggaacgggctttattttggtgatatgttttccaaaagtgcaccttattgccatgctaactggataaactcagatgctgtgctagttttgtgtgaggttgcactgggtgacatgcttgattatggatcttttaactgccatgataagttgccaaagggaaagctaagtgtaaaagtagctggaggaactgtcccggactcttcacaggctcaggttcttgaagacggtgttcttgttccactcggaaagccagtagagctgccttattcccaggtagggtgcattagaatcctgtccaatttccccaaaaacttagtaggggcatctttcaaattcaacttgtcagaatacaagtcaaggtttatcctcgcttcttctgttgatagctctgctgtttctgaggagctgatatttctcgtacatcgctgccgttggctctgctag

SEQ ID NO: 3528 - protein, 611 aa, Populus balsamifera subsp. trichocarpa
  misc_feature (1)..(611): Ceres ANNOT ID no. 1471654
  misc_feature (206)..(339): Pfam Name: PARP_reg Pfam Description: Poly(ADP-ribose) polymerase, regulatory domain
  misc_feature (374)..(580): Pfam Name: PARP Pfam Description: Poly(ADP-ribose) polymerase catalytic domain
  misc_feature (87)..(172): Pfam Name: WGR Pfam Description: WGR domain
  misc_feature: SWISSPROT Homolog: PARP2_ARATH Poly [ADP-ribose] polymerase 2 (EC 2.4.2.30) (PARP-2) (ADPRT 2) NAD (+) ADP-ribosyltransferase 2) (Poly[ADP-ribose] synthetase 2) with e-value of 0.0e+00 and BLAST sequence identity of 100.0
  misc_feature: SWISSPROT Homolog: PARP2_HUMAN Poly [ADP-ribose] polymerase 2 with e-value of 3.5e-119 and BLAST sequence identity of 44.7
  misc_feature: SWISSPROT Homolog: PARP2_HUMAN EC 2.4.2.30; (PARP-2) (NAD (+) ADP-ribosyltransferase 2)( Poly[ADP-ribose] synthetase 2) (pADPRT-2) (hPARP-2)
  misc_feature: SWISSPROT Homolog: PARP2_MOUSE Poly [ADP-ribose] polymerase 2 with e-value of 9.0e-114 and BLAST sequence identity of 45.8
  misc_feature: SWISSPROT Homolog: PARP2_MOUSE EC 2.4.2.30 (PARP-2) (NAD (+) ADP-ribosyltransferase 2) ( Poly[ADP-ribose] synthetase 2) (pADPRT-2) (mPARP-2)
  misc_feature: SWISSPROT Homolog: PARP1_XENLA Poly [ADP-ribose] polymerase with e-value of 1.8e-106 and BLAST sequence identity of 43.1
  misc_feature: SWISSPROT Homolog: PARP1_XENLA EC 2.4.2.30 (PARP) (ADPRT) (NAD(+) ADP-ribosyltransferase) ( Poly[ADP-ribose] synthetase) (Fragment)
  misc_feature: SWISSPROT Homolog: PARP1_RAT Poly [ADP-ribose] polymerase 1 (EC 2.4.2.30) (PARP-1) (ADPRT) (NAD (+) ADP-ribosyltransferase 1) (Poly[ADP-ribose] synthetase 1) with e-value of 4.3e-105 and BLAST sequence identity of 42.2
  misc_feature 392877:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtSS1 (SEQ ID NO 4158) regalutory region Useful for modulating Alkaloid Biosynthesis
  misc_feature (1)..(611): Functional Homolog of  Ceres CDNA ID no. 12676498 at SEQ ID NO. 3567 with e-value of 1.20E-140 and BLAST sequence identity of 56.4
MGTRQLREQAILRGLSSSGSKKELLDRLCAESEKESKNGTPEGKEEDEEKETSNKDEKVTASFNKVTAELDQYLPDHLKTQYHVLEHGDSIYDATLNQTNVGNNNNKFYLIQALESNDSSKFMVYTRWGRVGIKGQDKLQGPYTSRGSAIQEFEAKFFAKTKNRWPNRKDFICHPKCYTWLETDHDMNKESSEENPIFTVERQLQVTRLDPRIANFISLICDVRMMKQRMMELGYNAEKLPLGKLSKSTILKGYDVLRRICENIGKSDTEKLEELSGEFYTIIPHDFGFNKMREFTIDNHYKLKCKLEMVEALGEIEIATSLIKDDIYTQVLISDCLLTFIVKLCCLLLFSSYLIFCSDLIFKEDPLYSKYHCLRCELVPLDVVSKEFSMIEKYIRNTGDETHYRIDVVQIFRASREGENERFKKLAVVFQTSQSNLQKLSDSSFINPPGLRIAPPEAPSTHSLGNGLYFGDMFSKSAPYCHANWINSDAVLVLCEVALGDMLDYGSFNCHDKLPKGKLSVKVAGGTVPDSSQAQVLEDGVLVPLGKPVELPYSQVGCIRILSNFPKNLVGASFKFNLSEYKSRFILASSVDSSAVSEELIFLVHRCRWLC

SEQ ID NO: 3529 - protein, 812 aa, Arabidopsis thaliana
  misc_feature (1)..(812): Ceres CDNA ID no. 12679212
  misc_feature (449)..(811): Pfam Name: SDA1 Pfam Description: SDA1
  misc_feature (86)..(138): Pfam Name: NUC130_3NT Pfam Description: NUC130/3NT domain
MSGSLGLTPASLKASGRSSENVSLLTLQGKIKRDPEGYETELQLIYKQFKTSVDLFHELAALSFSSTGGIGSDPSVSKDLGDRAMFLAHVTPFYPKQLAAFPAQLTGLLRTSCLAMPSGLRNHIAQALILLMNRKSLVIEDLLALFLDIQTLGDKNLRNLAFGHIVQTIRKMSITDPKHKSLQKIVISMLEQEDEAKAKRALATLCALHKKKIWLGDKNERVAIAICEACFHSSPRIMISALRFLLDYENIDDDDDSDAESDDDEESKKIDQVVINRQAVYKANNKGTSSSKKKKQAKLQRAVKSIKRKQRSSSENTTSTFSPLNHLNDAQKFAEKLFSRLQTIKGSGERVETRLMMIKVIARTIGLHKLHLLSFYPFLQNYALPHVKDITQILAAAVQSCHDGVPSDVVEPLFKQIVNQFVHDKSRPEAIAVGLNVVREMCLRVHDLMTEELLQDLALYKKSHEKAISAAARSLIALFREVAEAFDLLINPSLLVKKDRGRPGATVFIPKHYGESNVFSNVPNVELLQESDNESGSDGDQDDDGVELPIGDDVEQELIPGDCGSEDKAEEDSNDGDDMNNTEDDSDIDTSIGGDEDEEVNDSDEADTDSENEEIESEEEDGEASDSSVEDSGNKEKAKGKKRKIVDFDANLLSADTSLRALKRFAEAKNEKPSFDEGDGILSNEDFRKIKTLQAKKEAKIALARKGFKVPNSDQLSKKRVDPAKLEAHIRHKLTKEQRLELVKAGREDRGKYKSKAAVKQKKTGGSSNKQKEHRKNMPLAAIRSKAGKSKRIKKMKNSISGSQFRGRKAWK

SEQ ID NO: 3530 - DNA, 2406 bp, Populus balsamifera subsp. trichocarpa
  misc_feature (1)..(2406): Ceres ANNOT ID no. 1459700
  misc_feature 393215:<222: Transcription Factor
atggcggattccttgtcggcgtcggggcggagctcggagaagctgagccttcaatctctccaatccaaaatgaaaattgacccagaaggttacgaaacggagctcggcttggtttacaaccaatttaagtcggctttggatctttttcaacagcaagcagctctcagtttcgcctcctcctccggtgtctgcgctgaccccactatttacaaggacctcagtgaccgcgccacttttttgtctcatgttacacctttttacccgaagcagcttgctgagttcccagctcaactcgctgagtttctcaaatcgtctgctcggactctgccttcgggacttcggtgtcatgttactcaagcgcttattctactgattaatcgagatatggttgatattagtgaaactctagcattgttcatggagcttcaaacactgggagataggacattgaggaatttggcttttactcatgttgttcatagcattaggaggatgaataagaagcataaaaatgaggctaagaatcgggcccttcaaaatatcctcttttccttgctacagcaagatgatgaagcacgagcgaagagagcactcatcacactatgtgagcttcatcgaaggaaggtgtggttcgatgatagaactgcaaattcaatttgtatggcatgttttcattcatcatcaagaatcatgattgctgctctgtcttttctcctcgattatgagaagattgaagataatgacaatgatgatagcgatgcttcaagtggcgaagacgatccaaatcctcgaacagctcaagttgtcattagtaaagagtctatttataagtattttgttcctgttttgtcaaaaccccaggcacacaataaaggtactgtagctagcaagaagaaaaagaaagcaaaactgcagcgggccatacgtagcatgaaaaggcagcaaagattgtcatcagaaaacaacaattcaaattattattcaccattcaaccatcttaaagacgcacaggggtttgctgagaggctattttctcgccttcagacttgcaatgaacgttttgaggtcaagatgatgatgttgaaagtaattgctcgaactgtggggctccaccgcttgattttattaaacttttatccttttcttcagaaatatgttcagccacatcagcgtgacatcacaaatttacttgcagcagctgtccaggcctgtcatgatctggtgcctcctgatgcagttgagccattattcaaacaaatagtaaatcaatttgtacatgatcactcgcgtcctgaggccattgctgttggactgaatgtgatcagggaaatctgcttgcgtatacctttgttgatgaatgaagatttactgcaagaccttgtattatacaagaaatctcatgagaaggcagtttcaatagctgctcgttcactcattactttattcagagaggtttgtccttctctgctgattaagaaagatcgaggtcgtcccattgacccaaaagctaggccgaaggcctatggagaagtcaatattgtcagcagtgttcctggtgttgagttgttagaagaacttaatgatgatgatgatgaagacaaggaggacagcgatgatgttgatgatttggcatcccgtggctctgatgatgattctgaaaatgaggagatggtttctgccagtgatgaaggagatcagatttacagtgatgacgctgaaagtgaggatggtgacgtgcaagatggctcagttgatgaagatggtgatgatgctgtagacaatgacagtggtggtggtgaggggggggacgaggatgaggatcaggaggagaatgatgaagacagttatgcgagggctatcataaataaagttaacaaatctactgctagaaagaggaagttctctgattttgatgggcaacttctagcagctgatacaagtttgcgggctttaaagaaaatgacagaagagaagttgaagaaaccaccatcagactctacagatggtattctttctaatgaagacttccaaagaatcaaggaacttacggccaagaaggatgccaggattgctttaaatcggcaaggatttaaggttccaagttctgatgatctgagtgctaagcgggtggatcctgctacgcttgaagttcatgtacgggcgaggctaaacaaggaagaaagattagcgctggtgagagcagggagagaggatagagagagctacaaatctagaatcgccgtaaaacagaaaaagactggcgggcagagcaacaggcagaaagaacacaaaaagcagatgcctcttgctgcaaaaagggccaaggtagcaagatctcgacaagagaaaaagaaaaagcaaagcctttctggcaagcagttccgggggaagaaagcatggaaatga

SEQ ID NO: 3531 - protein, 801 aa, Populus balsamifera subsp. trichocarpa
  misc_feature (1)..(801): Ceres ANNOT ID no. 1459700
  misc_feature (452)..(800): Pfam Name: SDA1 Pfam Description: SDA1
  misc_feature (79)..(130): Pfam Name: NUC130_3NT Pfam Description: NUC130/3NT domain
  misc_feature: SWISSPROT Homolog: YG58_YEAST Hypothetical 86.6 kDa protein in PFK1-TDS4 intergenic region with e-value of 6.3e-58 and BLAST sequence identity of 29.4
  misc_feature: SWISSPROT Homolog: YBLE_SCHPO Hypothetical protein C106.14c in chromosome II with e-value of 2.1e-57 and BLAST sequence identity of 27.9
  misc_feature: SWISSPROT Homolog: NMD2_YEAST Nonsense-mediated mRNA decay protein 2 (Up-frameshift suppressor 2) with e-value of 5.5e-10 and BLAST sequence identity of 25.3
  misc_feature: SWISSPROT Homolog: BFR2_EMENI Protein bfr2 with e-value of 5.9e-09 and BLAST sequence identity of 30.4
  misc_feature: SWISSPROT Homolog: AN32B_SHEEP Acidic leucine-rich nuclear phosphoprotein 32 family member B with e-value of 1.5e-08 and BLAST sequence identity of 33.1
  misc_feature: SWISSPROT Homolog: AN32B_SHEEP Leucine-rich acidic nuclear protein (LAN) Acidic protein rich in leucines
  misc_feature 393371:<222: Transcription Factor
  misc_feature (1)..(801): Functional Homolog of  Ceres CDNA ID no. 12679212 at SEQ ID NO. 3576 with e-value of 4.39E-237 and BLAST sequence identity of 62.0
MADSLSASGRSSEKLSLQSLQSKMKIDPEGYETELGLVYNQFKSALDLFQQQAALSFASSSGVCADPTIYKDLSDRATFLSHVTPFYPKQLAEFPAQLAEFLKSSARTLPSGLRCHVTQALILLINRDMVDISETLALFMELQTLGDRTLRNLAFTHVVHSIRRMNKKHKNEAKNRALQNILFSLLQQDDEARAKRALITLCELHRRKVWFDDRTANSICMACFHSSSRIMIAALSFLLDYEKIEDNDNDDSDASSGEDDPNPRTAQVVISKESIYKYFVPVLSKPQAHNKGTVASKKKKKAKLQRAIRSMKRQQRLSSENNNSNYYSPFNHLKDAQGFAERLFSRLQTCNERFEVKMMMLKVIARTVGLHRLILLNFYPFLQKYVQPHQRDITNLLAAAVQACHDLVPPDAVEPLFKQIVNQFVHDHSRPEAIAVGLNVIREICLRIPLLMNEDLLQDLVLYKKSHEKAVSIAARSLITLFREVCPSLLIKKDRGRPIDPKARPKAYGEVNIVSSVPGVELLEELNDDDDEDKEDSDDVDDLASRGSDDDSENEEMVSASDEGDQIYSDDAESEDGDVQDGSVDEDGDDAVDNDSGGGEGGDEDEDQEENDEDSYARAIINKVNKSTARKRKFSDFDGQLLAADTSLRALKKMTEEKLKKPPSDSTDGILSNEDFQRIKELTAKKDARIALNRQGFKVPSSDDLSAKRVDPATLEVHVRARLNKEERLALVRAGREDRESYKSRIAVKQKKTGGQSNRQKEHKKQMPLAAKRAKVARSRQEKKKKQSLSGKQFRGKKAWK

SEQ ID NO: 3532 - DNA, 2322 bp, Populus balsamifera subsp. trichocarpa
  misc_feature (1)..(2322): Ceres ANNOT ID no. 1512967
  misc_feature 393550:<222: Transcription Factor
atggcggattccttgtcggcgtcggggcggagctcggagaagctgagccttcaatctctccaatccaaaatgaaaattgacccagaaggttacgaaacggagctcggcttggtttacaaccaatttaagtcggctttggatctttttcaacagcaagcagctctcagtttcgcctcctcctccggtgtctgcgctgaccccactatttacaaggacctcagtgaccgcgccacttttttgtctcatgttacacctttttacccgaagcagcttgctgagttcccagctcaactcgctgagtttctcaaatcgtctgctcggactctgccttcgggacttcggtgtcatgttactcaagcgcttattctactgattaatcgagatatggttgatattagtgaaactctagcattgttcatggagcttcaaacactgggagataggacattgaggaatttggcttttactcatgttgttcatagcattaggaggatgaataagaagcataaaaatgaggctaagaatcgggcccttcaaaatatcctcttttccttgctacagcaagatgatgaagcacgagcgaagagagcactcatcacactatgtgagcttcatcgaaggaaggtgtggttcgatgatagaactgcaaattcaatttgtatggcatgttttcattcatcatcaagaatcatgattgctgctctgtcttttctcctcgattatgagaagattgaagataatgacaatgatgatagcgatgcttcaagtggcgaagacgatccaaatcctcgaacagctcaagttgtcattagtaaagagtctatttataaggcacacaataaaggtactgtagctagcaagaagaaaaagaaagcaaaactgcagcgggccatacgtagcatgaaaaggcagcaaagattgtcatcagaaaacaacaattcaaattattattcaccattcaaccatcttaaagacgcacaggtcaagatgatgatgttgaaagtaattgctcgaactgtggggctccaccgcttgattttattaaacttttatccttttcttcagaaatatgttcagccacatcagcgtgacatcacaaatttacttgcagcagctgtccaggcctgtcatgatctggtgcctcctgatgcagttgagccattattcaaacaaatagtaaatcaatttgtacatgatcactcgcgtcctgaggccattgctgttggactgaatgtgatcagggaaatctgcttgcgtatacctttgttgatgaatgaagatttactgcaagaccttgtattatacaagaaatctcatgagaaggcagtttcaatagctgctcgttcactcattactttattcagagaggtttgtccttctctgctgattaagaaagatcgaggtcgtcccattgacccaaaagctaggccgaaggcctatggagaagtcaatattgtcagcagtgttcctggtgttgagttgttagaagaacttaatgatgatgatgatgaagacaaggaggacagcgatgatgttgatgatttggcatcccgtggctctgatgatgattctgaaaatgaggagatggtttctgccagtgatgaaggagatcagatttacagtgatgacgctgaaagtgaggatggtgacgtgcaagatggctcagttgatgaagatggtgatgatgctgtagacaatgacagtggtggtggtgaggggggggacgaggatgaggatcaggaggagaatgatgaagacagttatgcgagggctatcataaataaagttaacaaatctactgctagaaagaggaagttctctgattttgatgggcaacttctagcagctgatacaagtttgcgggctttaaagaaaatgacagaagagaagttgaagaaaccaccatcagactctacagatggtattctttctaatgaagacttccaaagaatcaaggaacttacggccaagaaggatgccaggattgctttaaatcggcaaggatttaaggttccaagttctgatgatctgagtgctaagcgggtggatcctgctacgcttgaagttcatgtacgggcgaggctaaacaaggaagaaagattagcgctggtgagagcagggagagaggatagagagagctacaaatctagaatcgccgtaaaacagaaaaagactggcgggcagagcaacaggcagaaagaacacaaaaagcagatgcctcttgctgcaaaaagggccaaggtagcaagatctcgacaagagaaaaagaaaaagcaaagcctttctggcaagcagttccgggggaagaaagcatggaaatga

SEQ ID NO: 3533 - protein, 773 aa, Populus balsamifera subsp. trichocarpa
  misc_feature (1)..(773): Ceres ANNOT ID no. 1512967
  misc_feature (424)..(772): Pfam Name: SDA1 Pfam Description: SDA1
  misc_feature (79)..(130): Pfam Name: NUC130_3NT Pfam Description: NUC130/3NT domain
  misc_feature: SWISSPROT Homolog: YG58_YEAST Hypothetical 86.6 kDa protein in PFK1-TDS4 intergenic region with e-value of 6.3e-58 and BLAST sequence identity of 29.4
  misc_feature: SWISSPROT Homolog: YBLE_SCHPO Hypothetical protein C106.14c in chromosome II with e-value of 2.1e-57 and BLAST sequence identity of 27.9
  misc_feature: SWISSPROT Homolog: NMD2_YEAST Nonsense-mediated mRNA decay protein 2 (Up-frameshift suppressor 2) with e-value of 5.5e-10 and BLAST sequence identity of 25.3
  misc_feature: SWISSPROT Homolog: BFR2_EMENI Protein bfr2 with e-value of 5.9e-09 and BLAST sequence identity of 30.4
  misc_feature: SWISSPROT Homolog: AN32B_SHEEP Acidic leucine-rich nuclear phosphoprotein 32 family member B with e-value of 1.5e-08 and BLAST sequence identity of 33.1
  misc_feature: SWISSPROT Homolog: AN32B_SHEEP Leucine-rich acidic nuclear protein (LAN) Acidic protein rich in leucines
  misc_feature 393702:<222: Transcription Factor
  misc_feature (1)..(773): Functional Homolog of  Ceres CDNA ID no. 12679212 at SEQ ID NO. 3576 with e-value of 1.19E-229 and BLAST sequence identity of 61.7
MADSLSASGRSSEKLSLQSLQSKMKIDPEGYETELGLVYNQFKSALDLFQQQAALSFASSSGVCADPTIYKDLSDRATFLSHVTPFYPKQLAEFPAQLAEFLKSSARTLPSGLRCHVTQALILLINRDMVDISETLALFMELQTLGDRTLRNLAFTHVVHSIRRMNKKHKNEAKNRALQNILFSLLQQDDEARAKRALITLCELHRRKVWFDDRTANSICMACFHSSSRIMIAALSFLLDYEKIEDNDNDDSDASSGEDDPNPRTAQVVISKESIYKAHNKGTVASKKKKKAKLQRAIRSMKRQQRLSSENNNSNYYSPFNHLKDAQVKMMMLKVIARTVGLHRLILLNFYPFLQKYVQPHQRDITNLLAAAVQACHDLVPPDAVEPLFKQIVNQFVHDHSRPEAIAVGLNVIREICLRIPLLMNEDLLQDLVLYKKSHEKAVSIAARSLITLFREVCPSLLIKKDRGRPIDPKARPKAYGEVNIVSSVPGVELLEELNDDDDEDKEDSDDVDDLASRGSDDDSENEEMVSASDEGDQIYSDDAESEDGDVQDGSVDEDGDDAVDNDSGGGEGGDEDEDQEENDEDSYARAIINKVNKSTARKRKFSDFDGQLLAADTSLRALKKMTEEKLKKPPSDSTDGILSNEDFQRIKELTAKKDARIALNRQGFKVPSSDDLSAKRVDPATLEVHVRARLNKEERLALVRAGREDRESYKSRIAVKQKKTGGQSNRQKEHKKQMPLAAKRAKVARSRQEKKKKQSLSGKQFRGKKAWK

SEQ ID NO: 3534 - protein, 207 aa, Arabidopsis thaliana
  misc_feature (1)..(207): Ceres CDNA ID no. 12729193
  misc_feature (21)..(71): Pfam Name: SRF-TF Pfam Description: SRF-type transcription factor DNA-binding and dimerisation domain)
MSSTKQAKGRKTKGKQKIEMKKVENYGDRMITFSKRKTGIFKKMNELVAMCDVEVAFLIFSQPKKPYTFAHPSMKKVADRLKNPSRQEPLERDDTRPLVEAYKKRRLHDLVKKMEALEEELAMDLEKLKLLKESRNEKKLDKMWWNFPSEGLSAKELQQRYQAMLELRDNLCDNMAHLRLGKDCGGSSSVRVGRRVSGGVRLFDREA

SEQ ID NO: 3535 - DNA, 585 bp, Populus balsamifera subsp. trichocarpa
  misc_feature (1)..(585): Ceres ANNOT ID no. 1449874
  misc_feature 393936:<222: Transcription Factor
atggaaggcaagcaaaccagaggcaggcaaaagatcgcaataaaaaggatagaaaacgaagatgacaggctcatcacattctcgaaacgtcgatctgggatctacaaaaaggcaagcgagttggtgactctatgcggtgctgaggttgcggtgctagtgttctcaccagccggcaaggctttctcctttggccatccatctatagaatctgttgcaaatcgctttcttggacagaacatagcaccaaatgataacacccaccctcttgtcgaggctcacagaaaggtgagaattaacgagctaaaccagcaacacaatgaactacttagtgagatggaagctgagagagaccgaggaaaggtgctaaaggaagggacaagtgagaaatcaagccaaggttggtgggaagctcccattgatgagcttagcctgcaagagcttaagcaaatgaatgtgatgctagaagagtttcataagaatttgcacaaaacaattaatgagctcagaagaaatggaggtgcatcttcatcatctttccaagttcatactggccatgcaactaatattccattttgccagctctaa

SEQ ID NO: 3536 - protein, 194 aa, Populus balsamifera subsp. trichocarpa
  misc_feature (1)..(194): Ceres ANNOT ID no. 1449874
  misc_feature (15)..(65): Pfam Name: SRF-TF Pfam Description: SRF-type transcription factor DNA-binding and dimerisation domain)
  misc_feature: SWISSPROT Homolog: MAD23_ORYSA MADS-box transcription factor 23 (OsMADS23) with e-value of 2.8e-16 and BLAST sequence identity of 34.8
  misc_feature: SWISSPROT Homolog: MAD14_ORYSA MADS-box transcription factor 14 (OsMADS14) (Protein APETALA1- like B)(Protein AGAMOUS-like 10) (FDRMADS6) (RMADS211) with e-value of 5.2e-15 and BLAST sequence identity of 31.9
  misc_feature: SWISSPROT Homolog: PIST_ARATH Floral homeotic protein PISTILLATA (Transcription factor PI) with e-value of 6.9e-15 and BLAST sequence identity of 44.3
  misc_feature: SWISSPROT Homolog: AGL5_ARATH Agamous-like MADS-box protein AGL5 with e-value of 8.4e-15 and BLAST sequence identity of 33.9
  misc_feature: SWISSPROT Homolog: MAD56_ORYSA MADS-box transcription factor 56 (OsMADS56) (FDRMADS8) (RMADS214) with e-value of 1.1e-14 and BLAST sequence identity of 35.1
  misc_feature 394020:<222: Transcription Factor
  misc_feature (1)..(194): Functional Homolog of  Ceres CDNA ID no. 12729193 at SEQ ID NO. 3581 with e-value of 3.00E-32 and BLAST sequence identity of 42.6
MEGKQTRGRQKIAIKRIENEDDRLITFSKRRSGIYKKASELVTLCGAEVAVLVFSPAGKAFSFGHPSIESVANRFLGQNIAPNDNTHPLVEAHRKVRINELNQQHNELLSEMEAERDRGKVLKEGTSEKSSQGWWEAPIDELSLQELKQMNVMLEEFHKNLHKTINELRRNGGASSSSFQVHTGHATNIPFCQL

SEQ ID NO: 3537 - DNA, 609 bp, Populus balsamifera subsp. trichocarpa
  misc_feature (1)..(609): Ceres ANNOT ID no. 1492655
  misc_feature 394085:<222: Transcription Factor
atggcttccaagaaaacaaaaggaaggcaaaaggtggaaatgaagagaatagaaaatcaagatgatagattaatcaccttctcaaaacgtagatctgggatctacaaaaaggctagcgaactggctactttaactggggcagaaattgcaatcgcagtgttttcaccggcaggtaagcccttctcttttggccatccttcggttgaatcagttattaatcgtttccttgaagatccattggacatggatagcacttatcatctcgtggaggctcaccggaggatgaggatcgaagaactaacccaaaaacataacgatatgcaacatcaactggatgaggagaaggaaaagggtctcaaattaaagagtaagatcaaagaaatggatagcaaaggttggtgggatactgctgttgacgagcttaacatccaggagctgattgagttggaaaaaaagtttaaagagttacaaatgaccttatgcagtaaaatcgctgagaacgccagtactgttgcttcttcttcacaggctccagaaataggccattcatttgcatctactactgtaaatgatcaaaatgctcctggttttcctgataagaatcactaa

SEQ ID NO: 3538 - protein, 202 aa, Populus balsamifera subsp. trichocarpa
  misc_feature (1)..(202): Ceres ANNOT ID no. 1492655
  misc_feature (15)..(65): Pfam Name: SRF-TF Pfam Description: SRF-type transcription factor DNA-binding and dimerisation domain)
  misc_feature: SWISSPROT Homolog: MAD23_ORYSA MADS-box transcription factor 23 (OsMADS23) with e-value of 2.8e-16 and BLAST sequence identity of 34.8
  misc_feature: SWISSPROT Homolog: MAD14_ORYSA MADS-box transcription factor 14 (OsMADS14) (Protein APETALA1- like B)(Protein AGAMOUS-like 10) (FDRMADS6) (RMADS211) with e-value of 5.2e-15 and BLAST sequence identity of 31.9
  misc_feature: SWISSPROT Homolog: PIST_ARATH Floral homeotic protein PISTILLATA (Transcription factor PI) with e-value of 6.9e-15 and BLAST sequence identity of 44.3
  misc_feature: SWISSPROT Homolog: AGL5_ARATH Agamous-like MADS-box protein AGL5 with e-value of 8.4e-15 and BLAST sequence identity of 33.9
  misc_feature: SWISSPROT Homolog: MAD56_ORYSA MADS-box transcription factor 56 (OsMADS56) (FDRMADS8) (RMADS214) with e-value of 1.1e-14 and BLAST sequence identity of 35.1
  misc_feature 394171:<222: Transcription Factor
  misc_feature (1)..(202): Functional Homolog of  Ceres CDNA ID no. 12729193 at SEQ ID NO. 3581 with e-value of 6.49E-30 and BLAST sequence identity of 42.2
MASKKTKGRQKVEMKRIENQDDRLITFSKRRSGIYKKASELATLTGAEIAIAVFSPAGKPFSFGHPSVESVINRFLEDPLDMDSTYHLVEAHRRMRIEELTQKHNDMQHQLDEEKEKGLKLKSKIKEMDSKGWWDTAVDELNIQELIELEKKFKELQMTLCSKIAENASTVASSSQAPEIGHSFASTTVNDQNAPGFPDKNH

SEQ ID NO: 3539 - DNA, 570 bp, Populus balsamifera subsp. trichocarpa
  misc_feature (1)..(570): Ceres ANNOT ID no. 1439788
  misc_feature 394236:<222: Transcription Factor
atggcttccaagaaaacaaaaggaaggcaaaaggtggaaatgaagagaatagaaaatcaagatgatagattaatcaccttctcaaaacgtagatctgggatctacaaaaaggctagcgaactggctactttaactggggcagaaattgcaatcgcagtgttttcaccggcagttattaatcgtttccttgaagatccattggacatggatagcacttatcatctcgtggaggctcaccggaggatgaggatcgaagaactaacccaaaaacataacgatatgcaacatcaactggatgaggagaaggaaaagggtctcaaattaaagagtaagatcaaagaaatggatagcaaaggttggtgggatactgctgttgacgagcttaacatccaggagctgattgagttggaaaaaaagtttaaagagttacaaatgaccttatgcagtaaaatcgctgagaacgccagtactgttgcttcttcttcacaggctccagaaataggccattcatttgcatctactactgtaaatgatcaaaatgctcctggttttcctgataagaatcactaa

SEQ ID NO: 3540 - protein, 189 aa, Populus balsamifera subsp. trichocarpa
  misc_feature (1)..(189): Ceres ANNOT ID no. 1439788
  misc_feature (15)..(56): Pfam Name: SRF-TF Pfam Description: SRF-type transcription factor DNA-binding and dimerisation domain)
  misc_feature: SWISSPROT Homolog: MAD23_ORYSA MADS-box transcription factor 23 (OsMADS23) with e-value of 2.8e-16 and BLAST sequence identity of 34.8
  misc_feature: SWISSPROT Homolog: MAD14_ORYSA MADS-box transcription factor 14 (OsMADS14) (Protein APETALA1- like B)(Protein AGAMOUS-like 10) (FDRMADS6) (RMADS211) with e-value of 5.2e-15 and BLAST sequence identity of 31.9
  misc_feature: SWISSPROT Homolog: PIST_ARATH Floral homeotic protein PISTILLATA (Transcription factor PI) with e-value of 6.9e-15 and BLAST sequence identity of 44.3
  misc_feature: SWISSPROT Homolog: AGL5_ARATH Agamous-like MADS-box protein AGL5 with e-value of 8.4e-15 and BLAST sequence identity of 33.9
  misc_feature: SWISSPROT Homolog: MAD56_ORYSA MADS-box transcription factor 56 (OsMADS56) (FDRMADS8) (RMADS214) with e-value of 1.1e-14 and BLAST sequence identity of 35.1
  misc_feature 394320:<222: Transcription Factor
  misc_feature (1)..(189): Functional Homolog of  Ceres CDNA ID no. 12729193 at SEQ ID NO. 3581 with e-value of 2.20E-22 and BLAST sequence identity of 42.5
MASKKTKGRQKVEMKRIENQDDRLITFSKRRSGIYKKASELATLTGAEIAIAVFSPAVINRFLEDPLDMDSTYHLVEAHRRMRIEELTQKHNDMQHQLDEEKEKGLKLKSKIKEMDSKGWWDTAVDELNIQELIELEKKFKELQMTLCSKIAENASTVASSSQAPEIGHSFASTTVNDQNAPGFPDKNH

SEQ ID NO: 3541 - protein, 172 aa, Arabidopsis thaliana
  misc_feature (1)..(172): Ceres CDNA ID no. 12733452
  misc_feature (2)..(47): Pfam Name: zf-B_box Pfam Description: B-box zinc finger
MRILCDACESAAAIVFCAADEAALCCSCDEKVHKCNKLASRHLRVGLADPSNAPSCDICENAPAFFYCEIDGSSLCLQCDMVVHVGGKRTHRRFLLLRQRIEFPGDKPNHADQLGLRCQKASSGRGQESNGNGDHDHNMIDLNSNPQRVHEPGSHNQEEGIDVNNANNHEHE

SEQ ID NO: 3542 - DNA, 705 bp, Populus balsamifera subsp. trichocarpa
  misc_feature (1)..(705): Ceres ANNOT ID no. 1514007
  misc_feature 394436:<222: Transcription Factor
atgcgaacgatttgtgacgtgtgtgagagcgcagccgcgattcttttttgtgcagctgatgaagccgctctttgccgttcctgtgacgagaaggttcatttgtgcaacaagctagctagtcggcacgtgcgagtaggacttgcagatcctagcgctgttccacagtgtgacatatgtgaaaatgcaccagctttcttttactgtgagatagatggtagttcgctctgcttgcaatgcgatatgatagtacatgttggtggtaaaagaacccatggtagatatctcctgttgaggcagagggttgagtttccaggggataaacctggccggatggaggagcaaggacaacaacctcttgatcataatgaaacaaggagggaccaaaaccagccacttaaactcacagctagagaaaataaacaaaaccacagagcctctccagttccaatggtagagaataacacagatagcgacggaaaaatggacaacaatttgattgatcttaatgccaggcctcagcggatacatggacaaaattcaactaaccaggaaaatcacgaatcttctagtgcggttcctgttggatccttcaaaagagagcctcaaaaattaagttttacaaatatatccaaccagagttctgtttttcatctcaatttcttttcaagtaaaaaacaaaagagacagaaaatactctgctgttag

SEQ ID NO: 3543 - protein, 234 aa, Populus balsamifera subsp. trichocarpa
  misc_feature (1)..(234): Ceres ANNOT ID no. 1514007
  misc_feature (53)..(96): Pfam Name: zf-B_box Pfam Description: B-box zinc finger
  misc_feature: SWISSPROT Homolog: STHY_ARATH Putative salt tolerance-like protein At1g78600 with e-value of 6.5e-24 and BLAST sequence identity of 51.5
  misc_feature: SWISSPROT Homolog: STHX_ARATH Putative salt tolerance-like protein At1g75540 with e-value of 3.2e-22 and BLAST sequence identity of 48.0
  misc_feature: SWISSPROT Homolog: STO_ARATH Salt-tolerance protein with e-value of 5.3e-22 and BLAST sequence identity of 38.9
  misc_feature: SWISSPROT Homolog: STH_ARATH Salt tolerance-like protein with e-value of 1.6e-20 and BLAST sequence identity of 47.1
  misc_feature: SWISSPROT Homolog: COL1_ARATH Zinc finger protein CONSTANS-LIKE 1 with e-value of 1.2e-18 and BLAST sequence identity of 42.7
  misc_feature 394519:<222: Transcription Factor
  misc_feature (1)..(234): Functional Homolog of  Ceres CDNA ID no. 12733452 at SEQ ID NO. 3588 with e-value of 1.29E-54 and BLAST sequence identity of 73.4
MRTICDVCESAAAILFCAADEAALCRSCDEKVHLCNKLASRHVRVGLADPSAVPQCDICENAPAFFYCEIDGSSLCLQCDMIVHVGGKRTHGRYLLLRQRVEFPGDKPGRMEEQGQQPLDHNETRRDQNQPLKLTARENKQNHRASPVPMVENNTDSDGKMDNNLIDLNARPQRIHGQNSTNQENHESSSAVPVGSFKREPQKLSFTNISNQSSVFHLNFFSSKKQKRQKILCC

SEQ ID NO: 3544 - DNA, 666 bp, Populus balsamifera subsp. trichocarpa
  misc_feature (1)..(666): Ceres ANNOT ID no. 1460742
  misc_feature 394590:<222: Transcription Factor
atgcgaacgatttgtgacgtgtgtgagagcgcagccgcgattcttttttgtgcagctgatgaagccgctctttgccgttcctgtgacgagaaggttcatttgtgcaacaagctagctagtcggcacgtgcgagtaggacttgcagatcctagcgctgttccacagtgtgacatatgtgaaaatgcaccagctttcttttactgtgagatagatggtagttcgctctgcttgcaatgcgatatgatagtacatgttggtggtaaaagaacccatggtagatatctcctgttgaggcagagggttgagtttccaggggataaacctggccggatggaggagcaaggacaacaacctcttgatcataatgaaacaaggagggaccaaaaccagccacttaaactcacagctagagaaaataaacaaaaccacagagcctctccagttccaatggtagagaataacacagatagcgacggaaaaatggacaacaatttgattgatcttaatgccaggcctcagcggatacatggacaaaattcaactaaccaggaaaatcacgaatcttctagtgcggttcctgttggatccttcaaaagagagcctcaaaatgtggaaaagcttcaagtttccattgaagtcagtcctcttaaaccaacagttgtatga

SEQ ID NO: 3545 - protein, 221 aa, Populus balsamifera subsp. trichocarpa
  misc_feature (1)..(221): Ceres ANNOT ID no. 1460742
  misc_feature (53)..(96): Pfam Name: zf-B_box Pfam Description: B-box zinc finger
  misc_feature: SWISSPROT Homolog: STHY_ARATH Putative salt tolerance-like protein At1g78600 with e-value of 6.5e-24 and BLAST sequence identity of 51.5
  misc_feature: SWISSPROT Homolog: STHX_ARATH Putative salt tolerance-like protein At1g75540 with e-value of 3.2e-22 and BLAST sequence identity of 48.0
  misc_feature: SWISSPROT Homolog: STO_ARATH Salt-tolerance protein with e-value of 5.3e-22 and BLAST sequence identity of 38.9
  misc_feature: SWISSPROT Homolog: STH_ARATH Salt tolerance-like protein with e-value of 1.6e-20 and BLAST sequence identity of 47.1
  misc_feature: SWISSPROT Homolog: COL1_ARATH Zinc finger protein CONSTANS-LIKE 1 with e-value of 1.2e-18 and BLAST sequence identity of 42.7
  misc_feature 394673:<222: Transcription Factor
  misc_feature (1)..(221): Functional Homolog of  Ceres CDNA ID no. 12733452 at SEQ ID NO. 3588 with e-value of 1.29E-54 and BLAST sequence identity of 73.4
MRTICDVCESAAAILFCAADEAALCRSCDEKVHLCNKLASRHVRVGLADPSAVPQCDICENAPAFFYCEIDGSSLCLQCDMIVHVGGKRTHGRYLLLRQRVEFPGDKPGRMEEQGQQPLDHNETRRDQNQPLKLTARENKQNHRASPVPMVENNTDSDGKMDNNLIDLNARPQRIHGQNSTNQENHESSSAVPVGSFKREPQNVEKLQVSIEVSPLKPTVV

SEQ ID NO: 3546 - protein, 268 aa, Arabidopsis thaliana
  misc_feature (1)..(268): Ceres CDNA ID no. 13579142
  misc_feature (1)..(268): Also Known As Ceres GEMINI ID 5111E1
  misc_feature (125)..(142): Pfam Name: zf-CCHC Pfam Description: Zinc knuckle
  misc_feature 394755:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
MVNQRRRLAQKRYKEANPELFPKAEPTPPKDPNKKKKKKSLFKKKKPGSSTDRPQRTGSSTRHPLRVPGMKPGEGCFICHSKTHIAKLCPEKSEWERNKICLQCRRRGHSLKNCPEKNNESSEKKLCYNCGDTGHSLSHCPYPMEDGGTKFASCFICKGQGHISKNCPENKHGIYPMGGCCKVCGSVAHLVKDCPDKFNQESAQPKKTSRFDATPRGKLTKFSGDDLEDDFTEEPKSSKKINTSDDSAQNSVEVKKKKQGPKIVNFVG

SEQ ID NO: 3547 - DNA, 822 bp, Populus balsamifera subsp. trichocarpa
  misc_feature (1)..(822): Ceres ANNOT ID no. 1522260
  misc_feature 394839:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
atggtgagcaaaagacagaaactagcacgaaagagattcaaaggggaacatcctgagttgtttccaaaaccagaaccaacactactcaaggatcccaacaagaagaaaaagaaaaagagcttgctcaagagaaaaaagtctgacccaaatgagccttataaaaaagggtttggacgacacccacttagagttcctggtatgaagcctggtgatagttgttttatttgtaaagctaaagaccatattgccaaactttgccctcaaaaatctgagtgggaaaggaataagatatgtttgctttgtcggcaccgtgggcatagcctcaagcgttgtcccaacaagaatgacgagactatggatcagaaatcgtgttacaattgtggggaaaaagggcattcgctttctcaatgtcctcagccaagagaagatgggggaacaaagtttgccaattgctttatttgtaatgaacgtggacatttgagcaaggactgccctaaaaatactcgtggtatatacccgaagggtggttgctgtaaagtatgtggtggtgtaacacatttggctagagattgtcctgataagggtttgagaggttctgcagccactggcaaagaagctactggaagggaagtaaggcctaccgggcgggtgactaagtttgtaagtggagatgagcttgatgatgattttatgacaggaaacatgtatagcattccagaagacaagtcatctgattcaaaaatcgatccttctgtttcaaaagatgttcatgtaaaatcaaaaaagaaacaaggtcctaaagtagtgaactttgtagggtag

SEQ ID NO: 3548 - protein, 273 aa, Populus balsamifera subsp. trichocarpa
  misc_feature (1)..(273): Ceres ANNOT ID no. 1522260
  misc_feature (71)..(88): Pfam Name: zf-CCHC Pfam Description: Zinc knuckle
  misc_feature: SWISSPROT Homolog: YL92_SCHPO Hypothetical protein C683.02c in chromosome I with e-value of 7.2e-25 and BLAST sequence identity of 35.2
  misc_feature: SWISSPROT Homolog: ZCHC9_HUMAN Zinc finger CCHC domain-containing protein 9 with e-value of 4.0e-24 and BLAST sequence identity of 42.9
  misc_feature: SWISSPROT Homolog: ZCHC9_MOUSE Zinc finger CCHC domain-containing protein 9 with e-value of 4.1e-22 and BLAST sequence identity of 40.0
  misc_feature: SWISSPROT Homolog: HEXP_LEIMA DNA-binding protein HEXBP (Hexamer-binding protein) with e-value of 5.0e-17 and BLAST sequence identity of 28.8
  misc_feature: SWISSPROT Homolog: BYR3_SCHPO Cellular nucleic acid-binding protein homolog with e-value of 5.9e-14 and BLAST sequence identity of 32.8
  misc_feature 394942:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature (1)..(273): Functional Homolog of  Ceres CDNA ID no. 13579142 at SEQ ID NO. 3593 with e-value of 3.69E-91 and BLAST sequence identity of 63.3
MVSKRQKLARKRFKGEHPELFPKPEPTLLKDPNKKKKKKSLLKRKKSDPNEPYKKGFGRHPLRVPGMKPGDSCFICKAKDHIAKLCPQKSEWERNKICLLCRHRGHSLKRCPNKNDETMDQKSCYNCGEKGHSLSQCPQPREDGGTKFANCFICNERGHLSKDCPKNTRGIYPKGGCCKVCGGVTHLARDCPDKGLRGSAATGKEATGREVRPTGRVTKFVSGDELDDDFMTGNMYSIPEDKSSDSKIDPSVSKDVHVKSKKKQGPKVVNFVG

SEQ ID NO: 3549 - DNA, 837 bp, Populus balsamifera subsp. trichocarpa
  misc_feature (1)..(837): Ceres ANNOT ID no. 1527806
  misc_feature 395037:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
atggtgagcaaaaggcagaaactagcacgaaagatatacaaagaagaccatccagagttgtttccaaaaccagaaccaacaccacctaacgaccccaacaagatgaagaagaagaagaagaagagcttgttcaagagaaaaaattctgacccaaaagacccaaataaagcaaataaaaaagggtttagaaaacaacctcttagagttcctggtatgaagcctggtgatagttgttttatttgcaaagctaaagaccatattgccaaactttgccctcaaaaagatgaatgggagaagaataagatatgtttgctttgtcggcatcgtgggcatagcctgaagcgttgtcctaagaagaacgatgagactatggatcagaaattgtgttacaattgtggggaaacagggcactctctttctcaatgtcctcagcctcgagaagatggggggacgaagtttgccaattgctttatctgtaatgaacgtggacatttgagcaaggactgtcctaaaaatactcgtggcatatacccaaaaggtggttgctgtaaactatgtggtggtgtaacacatttggctagagattgtcccgataagggcaagagaggtgacgctgcctttggcagaggagccattggaagggaagtaaggcctactgggcgagtgactaagtttgtaagtggagatgagcttgatgatgattttatgaccgaaaacatgtatagcattccaaaagacaagtcaactgattcaaaagttgttcctcccgattcgaaggatggtcatgtaaaatcaaagaagaaacaaggtcccaaaatagtgaactttgtaggatag

SEQ ID NO: 3550 - protein, 278 aa, Populus balsamifera subsp. trichocarpa
  misc_feature (1)..(278): Ceres ANNOT ID no. 1527806
  misc_feature (76)..(93): Pfam Name: zf-CCHC Pfam Description: Zinc knuckle
  misc_feature: SWISSPROT Homolog: YL92_SCHPO Hypothetical protein C683.02c in chromosome I with e-value of 7.2e-25 and BLAST sequence identity of 35.2
  misc_feature: SWISSPROT Homolog: ZCHC9_HUMAN Zinc finger CCHC domain-containing protein 9 with e-value of 4.0e-24 and BLAST sequence identity of 42.9
  misc_feature: SWISSPROT Homolog: ZCHC9_MOUSE Zinc finger CCHC domain-containing protein 9 with e-value of 4.1e-22 and BLAST sequence identity of 40.0
  misc_feature: SWISSPROT Homolog: HEXP_LEIMA DNA-binding protein HEXBP (Hexamer-binding protein) with e-value of 5.0e-17 and BLAST sequence identity of 28.8
  misc_feature: SWISSPROT Homolog: BYR3_SCHPO Cellular nucleic acid-binding protein homolog with e-value of 5.9e-14 and BLAST sequence identity of 32.8
  misc_feature 395140:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature (1)..(278): Functional Homolog of  Ceres CDNA ID no. 13579142 at SEQ ID NO. 3593 with e-value of 3.79E-89 and BLAST sequence identity of 62.1
MVSKRQKLARKIYKEDHPELFPKPEPTPPNDPNKMKKKKKKSLFKRKNSDPKDPNKANKKGFRKQPLRVPGMKPGDSCFICKAKDHIAKLCPQKDEWEKNKICLLCRHRGHSLKRCPKKNDETMDQKLCYNCGETGHSLSQCPQPREDGGTKFANCFICNERGHLSKDCPKNTRGIYPKGGCCKLCGGVTHLARDCPDKGKRGDAAFGRGAIGREVRPTGRVTKFVSGDELDDDFMTENMYSIPKDKSTDSKVVPPDSKDGHVKSKKKQGPKIVNFVG

SEQ ID NO: 3551 - protein, 399 aa, Arabidopsis thaliana
  misc_feature (1)..(399): Ceres CDNA ID no. 13610509
  misc_feature (1)..(399): Also Known As Ceres GEMINI ID 5110E11
  misc_feature 395243:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
TCPCDRVYDVEIEITTMSSPERALLNLLTDIALSFDGAILGLTLAVSAVGSALKYASTNAALKKIKDAPEVSISDLRSLLPASEDKSETNDNRKSNDQRIVVVRGVVKPKISGDEGYKNNNVLISPETGDKALIIQRTQTYVYSGWKRLFQSTGHRFMLERSLRKHGADFTRTVPFVIVGKDQQSNSSFVAVNMDGSRQPLPLTTVYNRLQPINSSFLQAFLYPDYPVGLLDIEKILPPGKDITAVGIYSFNNGVPEIKSCQDLPYFLSEMTKDKMIEDLMEQTNFIFLGSVILGIVSVGILSYAAVRTWNKWKQWNHQRELPQRPNDSVVDDEPEDADEIPDGELCVICVSRRRVPAFIPCGHVVCCRRCASTVERELNPKCPVCLQSIRGSMRVYYS

SEQ ID NO: 3552 - protein, 315 aa, Arabidopsis thaliana
  misc_feature (1)..(315): Ceres CDNA ID no. 13653045
  misc_feature (1)..(315): Also Known As Ceres GEMINI ID 5110A5
  misc_feature (1)..(116): Pfam Name: DEAD Pfam Description: DEAD/DEAH box helicase
  misc_feature (203)..(279): Pfam Name: Helicase_C Pfam Description: Helicase conserved C-terminal domain
  misc_feature 395371:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtDXPR (SEQ ID NO 4143) regalutory region Useful for modulating Terpenoid Biosynthesis
MQVTKVARMLAAKSEIDVKGCTVMALLDGGTLRRHKSWLKAEPPAILVATVASLCHMLEKHIFRIDSVRVLVVDEVDFLFYSSKQVGSVRKLLTSFSSCDKRQTVFASASIPQHKHFVHDCIQQKWTKRDVVHVHVSAIMPMPLCLLHRFVMCEKTNKHQVLLALLESDAPESAIIFVGEQSEKSKKAGNDPSTTLLMEFLKTSYKGSLEILLLEGDMNFNSRAASLTEIRQGGGFLLVSTDIAARGIDLPETTHIFNFDLPQTVTDYLHRAGRAGRKPFSDRKCIVANLITSEERFVLQRYENELMFSCEEMML

SEQ ID NO: 3553 - DNA, 1353 bp, Populus balsamifera subsp. trichocarpa
  misc_feature (1)..(1353): Ceres ANNOT ID no. 1463563
  misc_feature 395464:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtDXPR (SEQ ID NO 4143) regalutory region Useful for modulating Terpenoid Biosynthesis
atggctcctataatctcagctactcagcagcttccacaagtttcacacgctgttttatattcgaaacccactcgaaccggtttttctctacttcagtcgcatattttgtattcgaacagagctctcttctattctagatcaagttttaggccattaaaggccattctcaattccccttcactaaccaaagtagctgatgatgctaaagagaagggggaggccttgactctccgcgaaatttgcctagctatattatgcactccatttttcagggtagaagaggttggatatgcggtgccaacggatgtacagaaacaagctttgcctgttctttttagcggccgcgactgcatacttcatgctcaggttacaaaagttgctcggatgttggctgcaacgccaacagagaatgatgcggagcagaagtcttgcaccgtcatggcgcttctagatggagggatgttgaggagacataagagttggctaaaggtgcggcatcctcttgatatgattttttgtcgtgtggctgagcctcctacaatagtggtggcaacaatagctagcttgtgccaaatgcttgagaagcacttgcttaaacttgaatcaatgcaagtgctggttattgacgaggttgatttcatgttcaactcttcaaaacaagtcagttccctgcgaaagcttttgacatcttattcctcatgcaatagccgtcagacagtttttgctagtgcatccatccctcagcacaaccgatttttatatgattgcatacagcagaagtggaccaagagagatgtagttcatgtccatgtaaatccaattgagcccatgccaacatgcctgcaacatagattcgtgatatgcagtaaaaagcaaaggcatcaaacattgctctccttactgcagtctgacgcacccaagtctggcattatttttgttggtgagcagtctgagaagtcaaaaaaggctgggaatggtccaccaacaattgatttagtggactttctgaaaacttcatatggggattgttcagaaatccttcttctggaggaagacatgaatttcaattcacgagcagcttcattatctgaagtgagacaaggaggtggctatcttcttgttgcaacggacattgctgcaagaggggttgatcttccagaaataactcatatatacaacttcaatctgccaagaactgctgtagattatcttcatcgagctggaagaacaggcagaaaacctttttcagatgagaaatgcaatgttaccagtattattatgccagaagagcggtttgttttgcaaagatatgagaacgaattgatgtttaattgcgaggagctttttctatag

SEQ ID NO: 3554 - protein, 450 aa, Populus balsamifera subsp. trichocarpa
  misc_feature (1)..(450): Ceres ANNOT ID no. 1463563
  misc_feature (100)..(123): Pfam Name: DEAD Pfam Description: DEAD/DEAH box helicase
  misc_feature (340)..(414): Pfam Name: Helicase_C Pfam Description: Helicase conserved C-terminal domain
  misc_feature: SWISSPROT Homolog: GLH1_CAEEL ATP-dependent RNA helicase glh-1 (EC 3.6.1.-) (Germline helicase 1) with e-value of 9.2e-19 and BLAST sequence identity of 27.3
  misc_feature: SWISSPROT Homolog: GLH3_CAEEL ATP-dependent RNA helicase glh-3 (EC 3.6.1.-) (Germline helicase 3) with e-value of 1.1e-17 and BLAST sequence identity of 26.3
  misc_feature: SWISSPROT Homolog: RHLB_SHEON ATP-dependent RNA helicase rhlB (EC 3.6.1.-) with e-value of 3.7e-17 and BLAST sequence identity of 37.2
  misc_feature: SWISSPROT Homolog: IF4A_DEBHA ATP-dependent RNA helicase eIF4A (EC 3.6.1.-) with e-value of 5.6e-17 and BLAST sequence identity of 33.6
  misc_feature: SWISSPROT Homolog: IF4A_DEBHA Eukaryotic initiation factor 4A) (eIF-4A) Translation Initiation factor 1
  misc_feature: SWISSPROT Homolog: IF4A2_HUMAN Eukaryotic initiation factor 4A-II (EC 3.6.1.-) (ATP-dependent RNA helicase eIF4A-2) (eIF4A-II) (eIF-4A-II) with e-value of 1.2e-16 and BLAST sequence identity of 38.0
  misc_feature 395602:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtDXPR (SEQ ID NO 4143) regalutory region Useful for modulating Terpenoid Biosynthesis
  misc_feature (1)..(450): Functional Homolog of  Ceres CDNA ID no. 13653045 at SEQ ID NO. 3599 with e-value of 5.99E-123 and BLAST sequence identity of 74.8
MAPIISATQQLPQVSHAVLYSKPTRTGFSLLQSHILYSNRALFYSRSSFRPLKAILNSPSLTKVADDAKEKGEALTLREICLAILCTPFFRVEEVGYAVPTDVQKQALPVLFSGRDCILHAQVTKVARMLAATPTENDAEQKSCTVMALLDGGMLRRHKSWLKVRHPLDMIFCRVAEPPTIVVATIASLCQMLEKHLLKLESMQVLVIDEVDFMFNSSKQVSSLRKLLTSYSSCNSRQTVFASASIPQHNRFLYDCIQQKWTKRDVVHVHVNPIEPMPTCLQHRFVICSKKQRHQTLLSLLQSDAPKSGIIFVGEQSEKSKKAGNGPPTIDLVDFLKTSYGDCSEILLLEEDMNFNSRAASLSEVRQGGGYLLVATDIAARGVDLPEITHIYNFNLPRTAVDYLHRAGRTGRKPFSDEKCNVTSIIMPEERFVLQRYENELMFNCEELFL

SEQ ID NO: 3555 - protein, 290 aa, Arabidopsis thaliana
  misc_feature (1)..(290): Ceres CDNA ID no. 13653878
  misc_feature (212)..(241): Pfam Name: ACT Pfam Description: ACT domain
MAMASASGSALCFTDASSSLALRRDCGALCLPPRTVTFGFVDKPLVNLERLRLSTLKIRASNATAVENGKQEGSAADSDKVPTPVVIIDQDSDPDATVLEVTFGDRLGALLDTMNALKNLGLNVVKANVYLDSSGKHNKFAITRADSGRKVEDPELLEAIRLTVINNLLEFHPESSSQLAMGAAFGVLPPTEPIDVDIATHITIEDDGPDRSLLFIESADRPGLLVELVKIISDISVAVESGEFDTEGLLAKVKFHVSYRNKALIKPLQQVLANSLRYFLRRPSTDESSF

SEQ ID NO: 3556 - DNA, 837 bp, Populus balsamifera subsp. trichocarpa
  misc_feature (1)..(837): Ceres ANNOT ID no. 1457646
  misc_feature 395808:<222: Transcription Factor
atggctgtgtccttggcttttgctaatcttcgatttcactttagtaatgttaaagtggttgaaaatcccttgtgttttggcttggctcctacacagcttccttttttatgcaaggaacgaagaagattgtcatcttccaggacaataattattgtgcaagcttcatcggctccaaccgttgaggatggaagtcaaaatgagactgatgcaattccaactccgaaagttataattgaccaagactctgatccagacgctactgtggtggagataaccttcggagatcgccttggtgctcttctggatacgatgaatgcgcttaaaaacctcgggctgaatgttgttaaggctaatgtctttttggattcttccgggaagcacaacacatttgccatcactaaatctactggtagaaaagttgatgacccagagctgctggaggccattcgtttgacaatcataaacaatttgcttcagtatcacccggaatcaagttcacagttagcaatgggaattgcctttggagtagagcaaccaaaacaggttgatgtggatatagcaacccatataaaagtcaaagatgatggtcctgaccgaagcttgtttttagtggagacagctgatcgaccaggattactggtggatcttgtaaagaatatcactgacattaacatttccgttgaatcaggagaatttgacaccgaggggttgttggccaaggcaaagtttcatgtcagctacaagggtaaagccatcagcaagcctctgcaactggttctcggtaacagtttgcgatatttcttgaggcgaccaatgaccgaggaagcaagtttttga

SEQ ID NO: 3557 - protein, 278 aa, Populus balsamifera subsp. trichocarpa
  misc_feature (1)..(278): Ceres ANNOT ID no. 1457646
  misc_feature (200)..(229): Pfam Name: ACT Pfam Description: ACT domain
  misc_feature 395860:<222: Transcription Factor
  misc_feature (1)..(278): Functional Homolog of  Ceres CDNA ID no. 13653878 at SEQ ID NO. 3602 with e-value of 4.19E-90 and BLAST sequence identity of 74.6
MAVSLAFANLRFHFSNVKVVENPLCFGLAPTQLPFLCKERRRLSSSRTIIIVQASSAPTVEDGSQNETDAIPTPKVIIDQDSDPDATVVEITFGDRLGALLDTMNALKNLGLNVVKANVFLDSSGKHNTFAITKSTGRKVDDPELLEAIRLTIINNLLQYHPESSSQLAMGIAFGVEQPKQVDVDIATHIKVKDDGPDRSLFLVETADRPGLLVDLVKNITDINISVESGEFDTEGLLAKAKFHVSYKGKAISKPLQLVLGNSLRYFLRRPMTEEASF

SEQ ID NO: 3558 - DNA, 942 bp, Populus balsamifera subsp. trichocarpa
  misc_feature (1)..(942): Ceres ANNOT ID no. 1518640
  misc_feature 395940:<222: Transcription Factor
atggctgtgtccatggcttttgccaatcttgcatttcagtttaataatgtcaaagttggtgaaaatcccttgtgttttggcttggctcctacacaacttccttatttatgcaaggaaagaagaagattgccatcttccaggacaataatcattccaggagcttcatcggctccaaccattgaggatggaagtcaaaatgacactgatgcaattccaactcccaaagttataattgaccaagacgccgatccagatgcaaccgtggtggaggtaaccttcggagatcgccttggtgctcttctggatacgatgaacgcgcttaaaaacctagggctgaatgttgttaaggctaatgtctttttggattcttctgggaagcacaacacattttccatcactaaagcctttttaacagcaaatctgactgccccttgctatgagcttttcttcagtagtactggtcgaaaagttgatgacccagaactgcttgaggccattcgtttgacaatcataaacaatttgcttcagtatcatccggaatcaagttctcagttagcaatggggattgcctttggagtagagccaccgaaacaggttgatgtggatatagcaacgcgtgtaaaagtcaaagaagatagtcctgaccgaagtgttcagcatgtgaaacagcaattgctaaagggtcgactgtatttctgtggcagcttgctttttgtggaggcagctgatcgcccaggattgttggtggatcttgtaaaggctatcactgacattaatattgctgttgaatcaggagaatttgacactgaggggttgttggccaaggcaaaatttcatgtcagctacaagggtaaagccatcagcaagcctcttcaactggttcttgctaacagtttgcgatatttcttgaggcgaccatcgaccgaggaggcaagtttttga

SEQ ID NO: 3559 - protein, 309 aa, Populus balsamifera subsp. trichocarpa
  misc_feature (1)..(309): Ceres ANNOT ID no. 1518640
  misc_feature (231)..(260): Pfam Name: ACT Pfam Description: ACT domain
  misc_feature 395996:<222: Transcription Factor
  misc_feature (1)..(309): Functional Homolog of  Ceres CDNA ID no. 13653878 at SEQ ID NO. 3602 with e-value of 1.39E-82 and BLAST sequence identity of 75.6
MAFANLAFQFNNVKVGENPLCFGLAPTQLPYLCKERRRLPSSRTIIIPGASSAPTIEDGSQNDTDAIPTPKVIIDQDADPDATVVEVTFGDRLGALLDTMNALKNLGLNVVKANVFLDSSGKHNTFSITKAFLTANLTAPCYELFFSSTGRKVDDPELLEAIRLTIINNLLQYHPESSSQLAMGIAFGVEPPKQVDVDIATRVKVKEDSPDRSVQHVKQQLLKGRLYFCGSLLFVEAADRPGLLVDLVKAITDINIAVESGEFDTEGLLAKAKFHVSYKGKAISKPLQLVLANSLRYFLRRPSTEEASF

SEQ ID NO: 3560 - protein, 122 aa, Arabidopsis thaliana
  misc_feature (1)..(122): Ceres CDNA ID no. 23368554
  misc_feature (1)..(122): Also Known As Ceres GEMINI ID 5110E2
  misc_feature (7)..(120): Pfam Name: DUF952 Pfam Description: Protein of unknown function (DUF952)
  misc_feature 396096:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MAEEEFIYRISTEQEWEEFKKNGSSYGAEIDKSTCYYHLSKLDQVQLTLKNFFVDVKEYLYLLQVDPKKLGDGLIYEAVDEVNSFPHFYGPDKTFVPLPLDSVVKAEKLTFINGNFTCSFLT

SEQ ID NO: 3561 - DNA, 405 bp, Populus balsamifera subsp. trichocarpa
  misc_feature (1)..(405): Ceres ANNOT ID no. 1444863
  misc_feature 396146:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggctgcaaaggaggggattaggagtggaagggaaggtgaagaagaagagcatgtgtataggataagcacagacaaagagtgggaagagttgcagagaaatggatcttgttttggtggacaacttgacaaatcttctggcttcatccatctcagcaagctcgaccaggtgatgtcaacattgcaaaactttttcctgaatactaaggtggatttgtatctgcttcaaattgatgctaaaaagctcggggatggattgataaatgaagtcgtggatggtaccaacaacttccctcatttctatggcccttctcggagtttcagtcccctccctcttgacgtagttatcaaagcagagaagcttgttctagcagatgggcagttcagttgtagtttgctgaactaa

SEQ ID NO: 3562 - protein, 134 aa, Populus balsamifera subsp. trichocarpa
  misc_feature (1)..(134): Ceres ANNOT ID no. 1444863
  misc_feature (19)..(132): Pfam Name: DUF952 Pfam Description: Protein of unknown function (DUF952)
  misc_feature 396192:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(134): Functional Homolog of  Ceres CDNA ID no. 23368554 at SEQ ID NO. 3607 with e-value of 3.89E-39 and BLAST sequence identity of 63.0
MAAKEGIRSGREGEEEEHVYRISTDKEWEELQRNGSCFGGQLDKSSGFIHLSKLDQVMSTLQNFFLNTKVDLYLLQIDAKKLGDGLINEVVDGTNNFPHFYGPSRSFSPLPLDVVIKAEKLVLADGQFSCSLLN

SEQ ID NO: 3563 - protein, 908 aa, Arabidopsis thaliana
  misc_feature (1)..(908): Ceres CDNA ID no. 23447462
  misc_feature (1)..(908): Also Known As Ceres GEMINI ID 5109E7
  misc_feature (201)..(227): Pfam Name: zf-CCCH Pfam Description: Zinc finger C-x8-C-x5-C-x3-H type (and similar)
  misc_feature (440)..(505): Pfam Name: RRM_1 Pfam Description: RNA recognition motif. (a.k.a. RRM RBD, or RNP domain)
  misc_feature 396274:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
MELSVSSPKQSVLSPPDCMSDPEEEHEISEEEDDDRNHKHRRKEETRSQSLEQDSSDQAFSRPYRKNYRHYENGNSFSEHEKRSFGTGSGQRVQFDNQRMRSNPMFSRDSGPGRGRGNYGSWAQRDSRFNPVDLSSHMVQVGSMGQGMFGGRGLAGVSAAQSAPWPPFGMIPGVPNGGLDGFHHLQGSLRPPLNAPLNMGIPRQRCRDFEERGFCLRGDMCPMEHGMNRIVVDDVQSLSQFNLPVSVPGAPHLAASSKQVPAQFGGASFMNPKGAHGRTNEGGMAVDGLGYGDAYPSAGGTDFYDPDQPLWNNSTGETSGAISTLNSHGVDENVAPLDDSNQDAAENGCGIRDSRSTSQSVWGRMKGSNSQANSKEKADAVLNSSAVPEDQLKEVSVNSSRHGKQNHVGESVAKVVDSSNISNDMMNNTRKPTQKAMRTLFVNYVPHESNRRDLILAHFQKFGKVIDIHIPVNSERAFVQFSKREEAESALRAPDAVMGNRFIKLWWANRDSIPDNGLSTGSGASMKGRSMTASGAQNQFPIAAASKSNHVSSIAKVPTFQTGGAPSSSEQPKPVVVTTSGPKVTPLQQKKADTLERLKETLRKKQEMLEQKRNEYRKKLATLEKQGTVVKREEADEPDAKRVKLDTASDSGAAIASPKTESSTDKKVPILKPLSTAKLSTETPSPDSKNFKQRPYSFTTSLNAPMVNRYKLDNRTTTIKVVPPLPTGLADVAVVKEHFSSYGEVSKVELEDNASIDSGKDHETQNESRAACVTFVKRSAAEKAFANAKCWQEHTLQLVWVTRQSNRESNNNNNNSNSLSVSRDNLSSKNKCASVSNDPKPAVEVKTSSTEEPENTNVSGDNDSTLDKQETKESDNDNNKSNHESIEGASEVIATAGTDEEQSEQIHQ

SEQ ID NO: 3564 - DNA, 2916 bp, Populus balsamifera subsp. trichocarpa
  misc_feature (1)..(2916): Ceres ANNOT ID no. 1440467
  misc_feature 396471:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
atggagctgaaagtttcgccactaaagacaggtggtctttctcctgctgaatgcattagtgatcctgaggagaaggaagtcagtgatgaggaagatgatgatcgcaaccataagcatcgtagacgagagacgcgttctcaatctttggagagagattctctggaaccagtttctacaaggccatacaggaagcataacaaacactttgaaaatgggcatcctttccgggaaaatgaatctcaagctcgtgaaacctggaaaaattataactctgtttctcttgagaaggactatgccacaaagtttgaaagaatacgacctgacctaatgtcattaccccgaatgcctgtggatttgaatcaaagaatccggttaaaccaaacattttctggagatcctggtcctagcaggggaagaggaagggagtatggttcttggagccaacgtgattctaggttcagctcagttggcattgcttctcaaatggctcacctggggccaagcctctttgccgggagggggttggcaaatgtttcaaatgtgcagagtgcatcctggaatgcttttggtttaatgccaagaatgtcaaatggtggcctggatacaatccatcccattgggttgcaaggaacactcagaccagcagtaaattcttcattgaacatgggcattcctcaccagaggtgtagagattttgaggagcgtggattttgtttaagaggggacatgtgtccattggagcatggtgtcaatcgcatcgtggttgaagatgttcagagcctttcacagtttaatctccctgtttcacttccacgtgcccaactacctggaacaacttctggactgggggctgtgccaacagttggtgcccctccagccacattgatgaatagcaaaggaatgcatggaaaaagtaacaagcctggaatagttgatgatggcttgggtctgaacggtgcgtatactggttctgttagtgtgagtggaggagacttgtatgacccagatcagcccctgtggaatgacaatggtcccgaaacttctagtacactcttagcaccacattcacctaaatttgatgaaactgaatccatgataagtgtggatccttctgatcacaatcatgccaggttacgtgatggtgctgataatgaatgcccaattagaagcactgggattgctgtgggttttcaaggcatgaattcttctgtttggggtagaattgggtctttgaacaatagattagatgtgaaagagaaaatcgattccacagcaagtatgtcaagttatatggagagtgaatccaaggaagatcagggtgcattagacaatgttcatggtacttcccatcaaggaaagtgcactaattttgacgattgtggcacaaaaaccatggattcacctgccaagatacatagcgataccatgcgtcacacgcggaaactatctcaaaaggcactgcgaacactatttgtgaatggcattccgcataaaagcaacaaaagagacgctctactttctcattttcaaaaatttggagaggttattgacatttatattccattgaacagtgagcgagcatttattcagttttctaaaagggaagaggcagaagctgctctaagggcacctgatgctgtaatgggcaatcgttttatcagactgtggtgggctaatcgtgatagcatacctgatgatgctacttcccggggtgttcctgctacttcaggtctaccccacctgtctattggtaacagtggaaaggataatcttcagttggctatttcaaagactactgtagtccctacctctgatacttctatgcctgccactgaccaccctaaggtcgacatcacaaatggtccagaggtttctcctcctatgcagaagaagctagagaatttagaacaattgaaggaggaacttcgcaagaaacaggagctgctggatcagaagcgaaatgactttcggcgtcagttgcacaaacttgagaaacaagctacaggagtcaagggtgaggtagcaactgagcctgcttctaagagacaaaaaactggaatagcatctgatgttgccaaagctgctactacgaggtctgctgatccaggtgccggtgtcgcatcaccacatggtgggatagtggataagaacaaaagaatggagaatattgtgtcttctagtaccaaaacaagtacagtgatggctctgcaggagtctgctggctcaaagcaatcaattcatccattagcacctgttgggcctccttttttgatgaataaatacaagttggacaaccgacccacagcgtttaaaattatttcacctttaccagctggtttggcaaatgttgctgctttgaaggaacacttctcatcatatggttatctttcttccgtggaactagaagatgagcctggtgattatgatggtgatggcaatggtgatggatcagatacagtaaaaagttgttcagctcgtgtgactttcgcaactcgcagatctgctgagagagcattccttaatggtaaatgttggcaaggcaagaatttgaagtttgagtggctgatgactagcacttctagcattggagaaaattcatctgctcccaagtgtcttgtacatgctgatgtacagcctgttaaaaatctagctcgtttggattcccaggaagttcctgcatcaggaaatggagaacctgaaaacccagagagaaataatggtgctggcccaacagagttggataaagcttcgcagtgctgttcagcctcaatttcaggtgaggtagagtcaccaaaatgtgagcctagtccaaagtcaatatctcctgagaaagagtcaacagaaacggaccctagtcaaactgcaatgtcagagaaagagacccccgaaggcattttctgtttgacgatgggttga

SEQ ID NO: 3565 - protein, 971 aa, Populus balsamifera subsp. trichocarpa
  misc_feature (1)..(971): Ceres ANNOT ID no. 1440467
  misc_feature (825)..(852): Pfam Name: RRM_1 Pfam Description: RNA recognition motif. (a.k.a. RRM RBD, or RNP domain)
  misc_feature: SWISSPROT Homolog: CSX1_SCHPO RNA-binding post-transcriptional regulator csx1 with e-value of 3.0e-07 and BLAST sequence identity of 27.5
  misc_feature: SWISSPROT Homolog: DSPP_HUMAN Dentin sialophosphoprotein precursor [Contains: (Dentin phosphophoryn) (DPP); Dentin sialoprotein (DSP)] with e-value of 2.8e-06 and BLAST sequence identity of 26.2
  misc_feature 396617:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (1)..(971): Functional Homolog of  Ceres CDNA ID no. 23447462 at SEQ ID NO. 3610 with e-value of 7.39E-193 and BLAST sequence identity of 52.3
MELKVSPLKTGGLSPAECISDPEEKEVSDEEDDDRNHKHRRRETRSQSLERDSLEPVSTRPYRKHNKHFENGHPFRENESQARETWKNYNSVSLEKDYATKFERIRPDLMSLPRMPVDLNQRIRLNQTFSGDPGPSRGRGREYGSWSQRDSRFSSVGIASQMAHLGPSLFAGRGLANVSNVQSASWNAFGLMPRMSNGGLDTIHPIGLQGTLRPAVNSSLNMGIPHQRCRDFEERGFCLRGDMCPLEHGVNRIVVEDVQSLSQFNLPVSLPRAQLPGTTSGLGAVPTVGAPPATLMNSKGMHGKSNKPGIVDDGLGLNGAYTGSVSVSGGDLYDPDQPLWNDNGPETSSTLLAPHSPKFDETESMISVDPSDHNHARLRDGADNECPIRSTGIAVGFQGMNSSVWGRIGSLNNRLDVKEKIDSTASMSSYMESESKEDQGALDNVHGTSHQGKCTNFDDCGTKTMDSPAKIHSDTMRHTRKLSQKALRTLFVNGIPHKSNKRDALLSHFQKFGEVIDIYIPLNSERAFIQFSKREEAEAALRAPDAVMGNRFIRLWWANRDSIPDDATSRGVPATSGLPHLSIGNSGKDNLQLAISKTTVVPTSDTSMPATDHPKVDITNGPEVSPPMQKKLENLEQLKEELRKKQELLDQKRNDFRRQLHKLEKQATGVKGEVATEPASKRQKTGIASDVAKAATTRSADPGAGVASPHGGIVDKNKRMENIVSSSTKTSTVMALQESAGSKQSIHPLAPVGPPFLMNKYKLDNRPTAFKIISPLPAGLANVAALKEHFSSYGYLSSVELEDEPGDYDGDGNGDGSDTVKSCSARVTFATRRSAERAFLNGKCWQGKNLKFEWLMTSTSSIGENSSAPKCLVHADVQPVKNLARLDSQEVPASGNGEPENPERNNGAGPTELDKASQCCSASISGEVESPKCEPSPKSISPEKESTETDPSQTAMSEKETPEGIFCLTMG

SEQ ID NO: 3566 - DNA, 2895 bp, Populus balsamifera subsp. trichocarpa
  misc_feature (1)..(2895): Ceres ANNOT ID no. 1476600
  misc_feature 396834:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
atggagctgaaagtttcaacactaaagacaggtggtctttctcctgctgattgcattagcgatcctgaggagaaggaagtcagtgatgaggatgatgatgatcgcaaccataagcatcgtagacgggagatacgttctcaatctttggagagagattctctggaaccagttttcacaaggccatacaggaagcgtaacaaaccatttgaaaatgggcaattttaccaggaaaatgactataactctgttcctcttgagaaaggctttgccacaaagtttgaaagaatacgacctggcttggtgtcattacctcgaatgcctgtggattggaatcaaagaatcaggtcaaaccaaacattttatggagatcctggtcttggcaggggaagaggaagggagcctgtttcttggagccaacatgattctaggttcagcccagttgacattgcttctcaaatggttcaccaggggcagagcctctttactgggaggggtttggcaaatgtttcaaatgcgcagagtgcatcctggaatgcatatggtttatttccaggaataccaaatggtggcctggataaactccgtcccattggtttgcaagcaactctcagaccagcagtaacttcttcattgaacatgggcattcctcaacaaaggtgtagagactttgaggagcgtggattttgtctaagaggggacatgtgtccaatggagcatggtgtcaatcgtattgttgttgaagatgttcagagcctttcacagtttaatctccctgtttcacttccacgtgcccaactagttggaacaactgctagaccgggggctctaccaactgttggtgccccttcagccacattgataaatagcaaaggaatgcatagcaaatgtaacaagcctggaatagtcaatgctggattgggcttcaatggtgcacatactggttctgctagtgtgagtggaggagacttgtatgatccagatcaacccctgtggaatgacagtgttcctgaaacttcaagtgcactcatagcaccacattcacctaaaattgatgaaattgaatccatgataagtattgattcttttgatcacaatcatgtcagtttacgtggtggtgctgataatgaatgcccaattagaagcactgggattgctgtgcattcagagagtttgaattcttctgtttggggtaaagtcagggcttcgaacaatagattacatgtgaaagagaaaaccgatttgactgtaagtatgttaaataatatggagagtgagtccaaggaaaatcagggtgcattagccaatgttcgtggtacttcccgtcaaggaaaacaaattaattttgaggattctagcgcaaaaaccatagattcacctgccaagacacaaagcaacaccatgcgccacacaccaaaaccatctcaaaaggcactgcgtacactatttgtcaatggcattccacagaaaagcaacaaaagagaggctctactttctcattttcaaaaatttggagaggttattgacatttatattccattgaacactgagcgagcatttgttcaattctcaaaaagggaagaggcagaagctgctctaagggcacctgatgctgtaatgggcaaccgttttatcaggctgtggtgggctaatcgtgatagcattcctgatggtggcgctggcagtagcaatagtgtatctgtcacaccccggggtgtgacttctacttcatttccaccccatctgcctattggtaacagtggaaaagataatcttcagttgtctgtttcaaaggctactgctgttcctccctctgttgctcctgtccctgccatcgatcactctaaggtcatcacgacaaatgttccaaaggttccacctcctatgcagaagctagagagtttagaacaattgaaggaggagctgcgcaagaagcaggagctgctggatcagaagcggaatgactttcggcgtcagttggacaagcttgagaaacaagctacaggagtcaagggtgaggtaacagcagagcctgcttcaaagagacacaaaactggaataccagcatctgatattgtcaaagctgctactccgaggtctgctgatccaggttctgcgtccccacatgctgaaatggtggataagaacaaaacagtggagaatgttgtgtcatctagtagcaaaacatgtgtaatgatggctctgcaggattctgcaggctcaaagccatcaattcatcctttagcacctgttgggcctccttttctgatgaataaatacaagttggacaaccgacctacagcattcaaaattatttcacctttaccagctggtttggcaaatgttgctactttaaaggaatatttctcatcatatggcgatctttctgctgtggaactagaagatgagcctagtgattatgatggtgttggatctgagacactgaaaaattgttcagcttgtgtgactttcacaactcgccgatcagctgagagggctttcctaaatggtaaatgttggcaaggcaagaatttgaagtttgcgtggctgacatctagcacttctagcaatgagccgggaagtggacaaaattcatttgctcccaattgtcttgtagatactgatcagtctgttgaaaaactagcttgtttggattcccaggaagcttctgcatcaggaaatggaggaccagaaaattcagagataaataatggtactggccccatagagttgcatgaagctctccagtgccattcagcctcaatattaggtgaggcagagtcaccgaaatgtgagcctagtccaacatcaatatctcatgagaaagagtcaacaaaaaaggaccctagtcaaactgcaatgtcagagaaagagacccccgaaggcattgtctggtga

SEQ ID NO: 3567 - protein, 964 aa, Populus balsamifera subsp. trichocarpa
  misc_feature (1)..(964): Ceres ANNOT ID no. 1476600
  misc_feature (821)..(846): Pfam Name: RRM_1 Pfam Description: RNA recognition motif. (a.k.a. RRM RBD, or RNP domain)
  misc_feature: SWISSPROT Homolog: CSX1_SCHPO RNA-binding post-transcriptional regulator csx1 with e-value of 3.0e-07 and BLAST sequence identity of 27.5
  misc_feature: SWISSPROT Homolog: DSPP_HUMAN Dentin sialophosphoprotein precursor [Contains: (Dentin phosphophoryn) (DPP); Dentin sialoprotein (DSP)] with e-value of 2.8e-06 and BLAST sequence identity of 26.2
  misc_feature 396980:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (1)..(964): Functional Homolog of  Ceres CDNA ID no. 23447462 at SEQ ID NO. 3610 with e-value of 9.99E-192 and BLAST sequence identity of 49.0
MELKVSTLKTGGLSPADCISDPEEKEVSDEDDDDRNHKHRRREIRSQSLERDSLEPVFTRPYRKRNKPFENGQFYQENDYNSVPLEKGFATKFERIRPGLVSLPRMPVDWNQRIRSNQTFYGDPGLGRGRGREPVSWSQHDSRFSPVDIASQMVHQGQSLFTGRGLANVSNAQSASWNAYGLFPGIPNGGLDKLRPIGLQATLRPAVTSSLNMGIPQQRCRDFEERGFCLRGDMCPMEHGVNRIVVEDVQSLSQFNLPVSLPRAQLVGTTARPGALPTVGAPSATLINSKGMHSKCNKPGIVNAGLGFNGAHTGSASVSGGDLYDPDQPLWNDSVPETSSALIAPHSPKIDEIESMISIDSFDHNHVSLRGGADNECPIRSTGIAVHSESLNSSVWGKVRASNNRLHVKEKTDLTVSMLNNMESESKENQGALANVRGTSRQGKQINFEDSSAKTIDSPAKTQSNTMRHTPKPSQKALRTLFVNGIPQKSNKREALLSHFQKFGEVIDIYIPLNTERAFVQFSKREEAEAALRAPDAVMGNRFIRLWWANRDSIPDGGAGSSNSVSVTPRGVTSTSFPPHLPIGNSGKDNLQLSVSKATAVPPSVAPVPAIDHSKVITTNVPKVPPPMQKLESLEQLKEELRKKQELLDQKRNDFRRQLDKLEKQATGVKGEVTAEPASKRHKTGIPASDIVKAATPRSADPGSASPHAEMVDKNKTVENVVSSSSKTCVMMALQDSAGSKPSIHPLAPVGPPFLMNKYKLDNRPTAFKIISPLPAGLANVATLKEYFSSYGDLSAVELEDEPSDYDGVGSETLKNCSACVTFTTRRSAERAFLNGKCWQGKNLKFAWLTSSTSSNEPGSGQNSFAPNCLVDTDQSVEKLACLDSQEASASGNGGPENSEINNGTGPIELHEALQCHSASILGEAESPKCEPSPTSISHEKESTKKDPSQTAMSEKETPEGIVW

SEQ ID NO: 3568 - DNA, 2610 bp, Populus balsamifera subsp. trichocarpa
  misc_feature (1)..(2610): Ceres ANNOT ID no. 1493336
  misc_feature 397197:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
atggagctgaaagtttcgccactaaagacaggtggtctttctcctgctgaatgcattagtgatcctgaggagaaggaagtcagtgatgaggaagatgatgatcgcaaccataagcatcgtagacgagagacgcgttctcaatctttggagagagattctctggaaccagtttctacaaggccatacaggaagcataacaaacactttgaaaatgggcatcctttccgggaaaatgaatctcaagctcgtgaaacctggaaaaattataactctgtttctcttgagaaggactatgccacaaagtttgaaagaatacgacctgacctaatgtcattaccccgaatgcctgtggatttgaatcaaagaatccggttaaaccaaacattttctggagatcctggtcctagcaggggaagaggaagggagtatggttcttggagccaacgtgattctaggttcagctcagttggcattgcttctcaaatggctcacctggggccaagcctctttgccgggagggggttggcaaatgtttcaaatgtgcagagtgcatcctggaatgcttttggtttaatgccaagaatgtcaaatggtggcctggatacaatccatcccattgggttgcaaggaacactcagaccagcagtaaattcttcattgaacatgggcattcctcaccagaggtgtagagattttgaggagcgtggattttgtttaagaggggacatgtgtccattggagcatggtgtcaatcgcatcgtggttgaagatgttcagagcctttcacagtttaatctccctgtttcacttccacgtgcccaactacctggaacaacttctggactgggggctgtgccaacagttggtgcccctccagccacattgatgaatagcaaaggaatgcatggaaaaagtaacaagcctggaatagttgatgatggcttgggtctgaacggtgcgtatactggttctgttagtgtgagtggaggagacttgtatgacccagatcagcccctgtggaatgacaatggtcccgaaacttctagtacactcttagcaccacattcacctaaatttgatgaaactgaatccatgataagtgtggatccttctgatcacaatcatgccaggttacgtgatggtgctgataatgaatgcccaattagaagcactgggattgctgtgggttttcaaggcatgaattcttctgtttggggtagaattgggtctttgaacaatagattagatgtgaaagagaaaatcgattccacagcaagtatgtcaagttatatggagagtgaatccaaggaagatcagggtgcattagacaatgttcatggtacttcccatcaaggaaagtgcactaattttgacgattgtggcacaaaaaccatggattcacctgccaagatacatagcgataccatgcgtcacacgcggaaactatctcaaaaggcactgcgaacactatttgtgaatggcattccgcataaaagcaacaaaagagacgctctactttctcattttcaaaaatttggagaggttattgacatttatattccattgaacagtgagcgagcatttattcagttttctaaaagggaagaggcagaagctgctctaagggcacctgatgctgtaatgggcaatcgttttatcagactgtggtgggctaatcgtgatagcatacctgatgatgctacttcccggggtgttcctgctacttcaggtctaccccacctgtctattggtaacagtggaaaggataatcttcagttggctatttcaaagactactgtagtccctacctctgatacttctatgcctgccactgaccaccctaaggtcgacatcacaaatggtccagaggtttctcctcctatgcagaagaagctagagaatttagaacaattgaaggaggaacttcgcaagaaacaggagctgctggatcagaagcgaaatgactttcggcgtcagttgcacaaacttgagaaacaagagtctgctggctcaaagcaatcaattcatccattagcacctgttgggcctccttttttgatgaataaatacaagttggacaaccgacccacagcgtttaaaattatttcacctttaccagctggtttggcaaatgttgctgctttgaaggaacacttctcatcatatggttatctttcttccgtggaactagaagatgagcctggtgattatgatggtgatggcaatggtgatggatcagatacagtaaaaagttgttcagctcgtgtgactttcgcaactcgcagatctgctgagagagcattccttaatggtaaatgttggcaaggcaagaatttgaagtttgagtggctgatgactagcacttctagcattggagaaaattcatctgctcccaagtgtcttgtacatgctgatgtacagcctgttaaaaatctagctcgtttggattcccaggaagttcctgcatcaggaaatggagaacctgaaaacccagagagaaataatggtgctggcccaacagagttggataaagcttcgcagtgctgttcagcctcaatttcaggagatgaactagtagttcatggttatttggatgttagttttcaataa

SEQ ID NO: 3569 - protein, 869 aa, Populus balsamifera subsp. trichocarpa
  misc_feature (1)..(869): Ceres ANNOT ID no. 1493336
  misc_feature (754)..(781): Pfam Name: RRM_1 Pfam Description: RNA recognition motif. (a.k.a. RRM RBD, or RNP domain)
  misc_feature: SWISSPROT Homolog: CSX1_SCHPO RNA-binding post-transcriptional regulator csx1 with e-value of 3.0e-07 and BLAST sequence identity of 27.5
  misc_feature: SWISSPROT Homolog: DSPP_HUMAN Dentin sialophosphoprotein precursor [Contains: (Dentin phosphophoryn) (DPP); Dentin sialoprotein (DSP)] with e-value of 2.8e-06 and BLAST sequence identity of 26.2
  misc_feature 397333:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (1)..(869): Functional Homolog of  Ceres CDNA ID no. 23447462 at SEQ ID NO. 3610 with e-value of 3.90E-174 and BLAST sequence identity of 53.5
MELKVSPLKTGGLSPAECISDPEEKEVSDEEDDDRNHKHRRRETRSQSLERDSLEPVSTRPYRKHNKHFENGHPFRENESQARETWKNYNSVSLEKDYATKFERIRPDLMSLPRMPVDLNQRIRLNQTFSGDPGPSRGRGREYGSWSQRDSRFSSVGIASQMAHLGPSLFAGRGLANVSNVQSASWNAFGLMPRMSNGGLDTIHPIGLQGTLRPAVNSSLNMGIPHQRCRDFEERGFCLRGDMCPLEHGVNRIVVEDVQSLSQFNLPVSLPRAQLPGTTSGLGAVPTVGAPPATLMNSKGMHGKSNKPGIVDDGLGLNGAYTGSVSVSGGDLYDPDQPLWNDNGPETSSTLLAPHSPKFDETESMISVDPSDHNHARLRDGADNECPIRSTGIAVGFQGMNSSVWGRIGSLNNRLDVKEKIDSTASMSSYMESESKEDQGALDNVHGTSHQGKCTNFDDCGTKTMDSPAKIHSDTMRHTRKLSQKALRTLFVNGIPHKSNKRDALLSHFQKFGEVIDIYIPLNSERAFIQFSKREEAEAALRAPDAVMGNRFIRLWWANRDSIPDDATSRGVPATSGLPHLSIGNSGKDNLQLAISKTTVVPTSDTSMPATDHPKVDITNGPEVSPPMQKKLENLEQLKEELRKKQELLDQKRNDFRRQLHKLEKQESAGSKQSIHPLAPVGPPFLMNKYKLDNRPTAFKIISPLPAGLANVAALKEHFSSYGYLSSVELEDEPGDYDGDGNGDGSDTVKSCSARVTFATRRSAERAFLNGKCWQGKNLKFEWLMTSTSSIGENSSAPKCLVHADVQPVKNLARLDSQEVPASGNGEPENPERNNGAGPTELDKASQCCSASISGDELVVHGYLDVSFQ

SEQ ID NO: 3570 - protein, 268 aa, Arabidopsis thaliana; identical to SEQ ID NO: 3546
  misc_feature (1)..(268): Ceres CDNA ID no. 23458190
  misc_feature (1)..(268): Also Known As Ceres GEMINI ID 5111E1
  misc_feature (125)..(142): Pfam Name: zf-CCHC Pfam Description: Zinc knuckle
  misc_feature 397546:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis

SEQ ID NO: 3571 - DNA, 822 bp, Populus balsamifera subsp. trichocarpa; identical to SEQ ID NO: 3547
  misc_feature (1)..(822): Ceres ANNOT ID no. 1522260
  misc_feature 397630:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis

SEQ ID NO: 3572 - protein, 273 aa, Populus balsamifera subsp. trichocarpa; identical to SEQ ID NO: 3548
  misc_feature (1)..(273): Ceres ANNOT ID no. 1522260
  misc_feature (71)..(88): Pfam Name: zf-CCHC Pfam Description: Zinc knuckle
  misc_feature: SWISSPROT Homolog: YL92_SCHPO Hypothetical protein C683.02c in chromosome I with e-value of 7.2e-25 and BLAST sequence identity of 35.2
  misc_feature: SWISSPROT Homolog: ZCHC9_HUMAN Zinc finger CCHC domain-containing protein 9 with e-value of 4.0e-24 and BLAST sequence identity of 42.9
  misc_feature: SWISSPROT Homolog: ZCHC9_MOUSE Zinc finger CCHC domain-containing protein 9 with e-value of 4.1e-22 and BLAST sequence identity of 40.0
  misc_feature: SWISSPROT Homolog: HEXP_LEIMA DNA-binding protein HEXBP (Hexamer-binding protein) with e-value of 5.0e-17 and BLAST sequence identity of 28.8
  misc_feature: SWISSPROT Homolog: BYR3_SCHPO Cellular nucleic acid-binding protein homolog with e-value of 5.9e-14 and BLAST sequence identity of 32.8
  misc_feature 397733:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature (1)..(273): Functional Homolog of  Ceres CDNA ID no. 23458190 at SEQ ID NO. 3617 with e-value of 3.69E-91 and BLAST sequence identity of 63.3

SEQ ID NO: 3573 - DNA, 837 bp, Populus balsamifera subsp. trichocarpa; identical to SEQ ID NO: 3549
  misc_feature (1)..(837): Ceres ANNOT ID no. 1527806
  misc_feature 397828:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis

SEQ ID NO: 3574 - protein, 278 aa, Populus balsamifera subsp. trichocarpa; identical to SEQ ID NO: 3550
  misc_feature (1)..(278): Ceres ANNOT ID no. 1527806
  misc_feature (76)..(93): Pfam Name: zf-CCHC Pfam Description: Zinc knuckle
  misc_feature: SWISSPROT Homolog: YL92_SCHPO Hypothetical protein C683.02c in chromosome I with e-value of 7.2e-25 and BLAST sequence identity of 35.2
  misc_feature: SWISSPROT Homolog: ZCHC9_HUMAN Zinc finger CCHC domain-containing protein 9 with e-value of 4.0e-24 and BLAST sequence identity of 42.9
  misc_feature: SWISSPROT Homolog: ZCHC9_MOUSE Zinc finger CCHC domain-containing protein 9 with e-value of 4.1e-22 and BLAST sequence identity of 40.0
  misc_feature: SWISSPROT Homolog: HEXP_LEIMA DNA-binding protein HEXBP (Hexamer-binding protein) with e-value of 5.0e-17 and BLAST sequence identity of 28.8
  misc_feature: SWISSPROT Homolog: BYR3_SCHPO Cellular nucleic acid-binding protein homolog with e-value of 5.9e-14 and BLAST sequence identity of 32.8
  misc_feature 397931:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature (1)..(278): Functional Homolog of  Ceres CDNA ID no. 23458190 at SEQ ID NO. 3617 with e-value of 3.79E-89 and BLAST sequence identity of 62.1

SEQ ID NO: 3575 - protein, 667 aa, Arabidopsis thaliana
  misc_feature (1)..(667): Ceres CDNA ID no. 23461192
  misc_feature (1)..(667): Also Known As Ceres GEMINI ID 5110B8
  misc_feature (208)..(244): Pfam Name: Pyr_redox Pfam Description: Pyridine nucleotide-disulphide oxidoreductase
  misc_feature (365)..(397): Pfam Name: FAD_binding_3 Pfam Description: FAD binding domain
  misc_feature (558)..(634): Pfam Name: FHA Pfam Description: FHA domain
  misc_feature (82)..(112): Pfam Name: Pyr_redox_2 Pfam Description: Pyridine nucleotide-disulphide oxidoreductase
  misc_feature 398058:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
MGSTPFCYSINPSPSKLDFTRTHVFSPVSKQFYLDLSSFSGKPGGVSGFRSRRALLGVKAATALVEKEEKREAVTEKKKKSRVLVAGGGIGGLVFALAAKKKGFDVLVFEKDLSAIRGEGKYRGPIQIQSNALAALEAIDIEVAEQVMEAGCITGDRINGLVDGISGTWYVKFDTFTPAASRGLPVTRVISRMTLQQILARAVGEDVIRNESNVVDFEDSGDKVTVVLENGQRYEGDLLVGADGIWSKVRNNLFGRSEATYSGYTCYTGIADFIPADIESVGYRVFLGHKQYFVSSDVGGGKMQWYAFHEEPAGGADAPNGMKKRLFEIFDGWCDNVLDLLHATEEEAILRRDIYDRSPGFTWGKGRVTLLGDSIHAMQPNMGQGGCMAIEDSFQLALELDEAWKQSVETTTPVDVVSSLKRYEESRRLRVAIIHAMARMAAIMASTYKAYLGVGLGPLSFLTKFRVPHPGRVGGRFFVDIAMPSMLDWVLGGNSEKLQGRPPSCRLTDKADDRLREWFEDDDALERTIKGEWYLIPHGDDCCVSETLCLTKDEDQPCIVGSEPDQDFPGMRIVIPSSQVSKMHARVIYKDGAFFLMDLRSEHGTYVTDNEGRRYRATPNFPARFRSSDIIEFGSDKKAAFRVKVIRKTPKSTRKNESNNDKLLQTA

SEQ ID NO: 3576 - DNA, 1989 bp, Populus balsamifera subsp. trichocarpa
  misc_feature (1)..(1989): Ceres ANNOT ID no. 1504431
  misc_feature 398210:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atggcatcttcaactttgttttgcaacactccaacggctgttttctcaagaacccagtttccagttccaatctttagcaactcatccgtagaattctcgtcttccacgcactataactacaacttcaaaaccaagacaggtagtgctaagaaattgaaacatgtgaatgctgtagtgaccgaggcacctgctgtgagtgaatcaagagggaaacagtcagaacaaaggaagttaaaggttcttgttgctggaggtggaattggagggctggtttttgcgttggcagcaaaaaggaaagggtttgaggtgatggtttttgagaaggatttgagtgcggtaagaggagaagggcaatatagaggtccaattcagatacagagcaatgcattagctgctttggaagctattgatttagaggttgctgaagaggttatgagagctggctgtatcacgggtgataggattaatggacttgttgatggggtttctggtacttggtatgtcaagtttgataccttcactccagcagcagaaagagggcttcctgtcacgagagttattagccgaatgactttgcaacagatcctagctcgtgcagttggagatgatgtgattcttaatgatagtaatgttgttagttttcaggatgaagggaataagatcactgtggtgctcgagaatggacaacaatttgaaggtgatctcctagtgggtgctgatggaatatggtcaaaggtgaggaagaacttatttggacccaaggaggcagtgtactcaggctatacatgttatactggtatagcagattttgtgcctgtcgatatcgagactgttgggtatcgtgtatttttgggtcacaaacaatacttcgtgtcttcagatgtgggtgctggaaagatgcagtggtatgcatttcacaaggaacaacctggtggcatggatggcccccgtggtaaaaaggatcggttgttgaaaatttttgagggttggtgtgataatgtgatagatttgatactggccacagatgaagatgccattcttcgacgtgatatatatgacagggaacccattcttacttggggaaggggtcgtgtgaccttgcttggggattctgtccatgccatgcaaccgaatatgggtcaaggggggtgcatggccattgaggatagctaccaacttgcattggagcttgataaagcatggaaacaaagtgttgaatcaggaacctctgttgacgttatttcatcactaaggagctatgagaatgctagaagacttcgagttgccattatccatggaatggcaagaatggcggcaattatggcttcaacatacaaggcgtatctgggtgtagggcttggtccactgtcgttcttgacaaagtttcggatacctcacccaggaagagttggtggcagatttttcgttgacatagcaatgcctgtgatgctcaattgggtcttgggcggaaatagttccaaacttgaaggcaggtctctaagttgccgactctcagacaaagccagtgaccagttgcgaagatggtttgaagatgatgatgctctagagcgtgctcttgatggagagtggtttcttttaccatgtggaaatgaggctgttgcttcacaacctattggtttaagtagggatgagaacaaaccctgtgtggttgggagtgtgtcacatgatgattttccgggaatgtccatagtgatacccgcacctgaggtttcagaaatgcatgctcgtatctcttgtaaaaatggtgcattttacctaattgatttgcggagtgagcatggtacctttatcacagataatgaggggagacggtatagggcaactccgaactttcctgcccgattccatccatcagatatgattgagtttggctcggacaagaaggcaacatttcgtgttaaggtgatgaggtctcctccgaagatttcagaaaagaaggaagaaagccaagttcttcgttcggtataa

SEQ ID NO: 3577 - protein, 662 aa, Populus balsamifera subsp. trichocarpa
  misc_feature (1)..(662): Ceres ANNOT ID no. 1504431
  misc_feature (211)..(250): Pfam Name: FAD_binding_3 Pfam Description: FAD binding domain
  misc_feature (555)..(631): Pfam Name: FHA Pfam Description: FHA domain
  misc_feature (79)..(109): Pfam Name: DAO Pfam Description: FAD dependent oxidoreductase
  misc_feature: SWISSPROT Homolog: ABA2_PRUAR Zeaxanthin epoxidase, chloroplast precursor (EC 1.14.13.90) (PA-ZE) with e-value of 1.4e-257 and BLAST sequence identity of 72.6
  misc_feature: SWISSPROT Homolog: ABA2_NICPL Zeaxanthin epoxidase, chloroplast precursor (EC 1.14.13.90) with e-value of 3.7e-250 and BLAST sequence identity of 70.7
  misc_feature: SWISSPROT Homolog: ABA2_LYCES Zeaxanthin epoxidase, chloroplast precursor (EC 1.14.13.90) with e-value of 7.4e-245 and BLAST sequence identity of 69.3
  misc_feature: SWISSPROT Homolog: ABA2_CAPAN Zeaxanthin epoxidase, chloroplast precursor (EC 1.14.13.90) (Xanthophyll epoxidase) (Beta-cyclohexenyl epoxidase) with e-value of 7.5e-236 and BLAST sequence identity of 71.1
  misc_feature: SWISSPROT Homolog: NHG2_PSEPU Salicylate hydroxylase (EC 1.14.13.1) (Salicylate 1-monooxygenase) with e-value of 3.5e-14 and BLAST sequence identity of 26.6
  misc_feature 398362:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(662): Functional Homolog of  Ceres CDNA ID no. 23461192 at SEQ ID NO. 3622 with e-value of 3.99E-259 and BLAST sequence identity of 73.6
MASSTLFCNTPTAVFSRTQFPVPIFSNSSVEFSSSTHYNYNFKTKTGSAKKLKHVNAVVTEAPAVSESRGKQSEQRKLKVLVAGGGIGGLVFALAAKRKGFEVMVFEKDLSAVRGEGQYRGPIQIQSNALAALEAIDLEVAEEVMRAGCITGDRINGLVDGVSGTWYVKFDTFTPAAERGLPVTRVISRMTLQQILARAVGDDVILNDSNVVSFQDEGNKITVVLENGQQFEGDLLVGADGIWSKVRKNLFGPKEAVYSGYTCYTGIADFVPVDIETVGYRVFLGHKQYFVSSDVGAGKMQWYAFHKEQPGGMDGPRGKKDRLLKIFEGWCDNVIDLILATDEDAILRRDIYDREPILTWGRGRVTLLGDSVHAMQPNMGQGGCMAIEDSYQLALELDKAWKQSVESGTSVDVISSLRSYENARRLRVAIIHGMARMAAIMASTYKAYLGVGLGPLSFLTKFRIPHPGRVGGRFFVDIAMPVMLNWVLGGNSSKLEGRSLSCRLSDKASDQLRRWFEDDDALERALDGEWFLLPCGNEAVASQPIGLSRDENKPCVVGSVSHDDFPGMSIVIPAPEVSEMHARISCKNGAFYLIDLRSEHGTFITDNEGRRYRATPNFPARFHPSDMIEFGSDKKATFRVKVMRSPPKISEKKEESQVLRSV

SEQ ID NO: 3578 - DNA, 1989 bp, Populus balsamifera subsp. trichocarpa
  misc_feature (1)..(1989): Ceres ANNOT ID no. 1510151
  misc_feature 398522:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atggcatcctcaactttgtttggcaacactttaacagctgtttcttcaagaacccactttccaaccccaatctttaacaacaactcactagaattgttgtcttccgcacactctaactacaacttcaaaaccaagacaagtactagtgctaagaaattgaaagtgaaagctgtagtgactgagacacctgctgggagtaaatcagaagggaaacaatcggagcaaagaaagttaaaggttctggttgctggaggtgggattggagggctggtttttgcattggcagcaaaaaagaaagggtttgatgtgatggtttttgagaaggatttgagtgcagtaagaggagaaggacaatatagaggtccaattcaggtacagagcaatgcattagctgctttggaagctattgatttagatgttgctgaggaggttatgagagctgggtgtatcactggtgataggattaatggacttgttgatggggtctctggtacttggtatgtcaagtttgataccttcactcctgcagcagaacgagggcttccggtcacaagagttattagccgaatgactttgcaacaaatcctagctcgttcagttggagatgatatgattcttaatgatagtaatgttgttagttttcaggatgatggggataaggtcactgtggttctcgagaatgggcaacaatacgaaggcgatctcctagttggtgctgatggaatatggtcaaaggtgaggaagaacttattcgggcccaaggaaccagtgtactcaggctatacatgttataccggtatagcagattttgtgcctgttgatattgagactgttgggtatcgtgtatttttgggtcacaaacaatacttcgtttcttcagacgtgggtgctggaaagatgcagtggtatgcatttcacaaggaaccacctggtggcatggatgccccccatggtaaaaaggataggctcttgaaaatatttgagggttggtgtgataatgtgatagatttgctactgaccacagatgaagattccattcttcgacgtgacatttatgacagggaacccattattacatggggaaagggccgcgtgaccttgcttggggattctgtccatgccatgcaaccgaatatgggtcaagggggatgcatggccattgaggatagctaccaactcgcatcggaacttgagagagcatggaaacaaagcattgaatcaggaacccctgttgatgttctttcgtcactaaggagctatgagaattctagaagacttcgagttgctattatccatggaatggcaagaatggcagcaattatggcttcaacatacaaggcgtatctgggtgtaggacttggtccactgtcgttcttgacaaattttcggatacctcacccaggaagagtcggaggcaggttttttattgacatagcaatgcctgtaatgcttgattgggtattgggcggaaatagttcaaaacttgaagggaggtctctgagttgccgactctcagacaaagccaatgaccagttgcgaagatggtttgtagatgatgatgccctagagcgttctcttaacggagagtggtttcttttaccatgtggaaatgatgctgttgcttcacaacctattggtttaagtagggatgagaacaaaccctgtgtggttgggagtgtctcacaagaggattttccgggaatgtccatagtgatacctgcaccgcaggtttcaaaaacacatgctcgtataacttgtaaagatggggcattttacttgattgatttgcgcagtgagcatggttcctttatcacagatattgaggggagacggtatagggcacctccaaattttcctacccgattccatccatcagacatgattgagtttggttcagataagaaggtaatatttcgagtaaaggtgatgaggtctcctccaaagatttcagagaagaaggatgagggtcaagttcttcagtcagtataa

SEQ ID NO: 3579 - protein, 662 aa, Populus balsamifera subsp. trichocarpa
  misc_feature (1)..(662): Ceres ANNOT ID no. 1510151
  misc_feature (362)..(397): Pfam Name: FAD_binding_3 Pfam Description: FAD binding domain
  misc_feature (555)..(631): Pfam Name: FHA Pfam Description: FHA domain
  misc_feature (79)..(109): Pfam Name: DAO Pfam Description: FAD dependent oxidoreductase
  misc_feature: SWISSPROT Homolog: ABA2_PRUAR Zeaxanthin epoxidase, chloroplast precursor (EC 1.14.13.90) (PA-ZE) with e-value of 1.4e-257 and BLAST sequence identity of 72.6
  misc_feature: SWISSPROT Homolog: ABA2_NICPL Zeaxanthin epoxidase, chloroplast precursor (EC 1.14.13.90) with e-value of 3.7e-250 and BLAST sequence identity of 70.7
  misc_feature: SWISSPROT Homolog: ABA2_LYCES Zeaxanthin epoxidase, chloroplast precursor (EC 1.14.13.90) with e-value of 7.4e-245 and BLAST sequence identity of 69.3
  misc_feature: SWISSPROT Homolog: ABA2_CAPAN Zeaxanthin epoxidase, chloroplast precursor (EC 1.14.13.90) (Xanthophyll epoxidase) (Beta-cyclohexenyl epoxidase) with e-value of 7.5e-236 and BLAST sequence identity of 71.1
  misc_feature: SWISSPROT Homolog: NHG2_PSEPU Salicylate hydroxylase (EC 1.14.13.1) (Salicylate 1-monooxygenase) with e-value of 3.5e-14 and BLAST sequence identity of 26.6
  misc_feature 398674:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(662): Functional Homolog of  Ceres CDNA ID no. 23461192 at SEQ ID NO. 3622 with e-value of 1.10E-258 and BLAST sequence identity of 73.6
MASSTLFGNTLTAVSSRTHFPTPIFNNNSLELLSSAHSNYNFKTKTSTSAKKLKVKAVVTETPAGSKSEGKQSEQRKLKVLVAGGGIGGLVFALAAKKKGFDVMVFEKDLSAVRGEGQYRGPIQVQSNALAALEAIDLDVAEEVMRAGCITGDRINGLVDGVSGTWYVKFDTFTPAAERGLPVTRVISRMTLQQILARSVGDDMILNDSNVVSFQDDGDKVTVVLENGQQYEGDLLVGADGIWSKVRKNLFGPKEPVYSGYTCYTGIADFVPVDIETVGYRVFLGHKQYFVSSDVGAGKMQWYAFHKEPPGGMDAPHGKKDRLLKIFEGWCDNVIDLLLTTDEDSILRRDIYDREPIITWGKGRVTLLGDSVHAMQPNMGQGGCMAIEDSYQLASELERAWKQSIESGTPVDVLSSLRSYENSRRLRVAIIHGMARMAAIMASTYKAYLGVGLGPLSFLTNFRIPHPGRVGGRFFIDIAMPVMLDWVLGGNSSKLEGRSLSCRLSDKANDQLRRWFVDDDALERSLNGEWFLLPCGNDAVASQPIGLSRDENKPCVVGSVSQEDFPGMSIVIPAPQVSKTHARITCKDGAFYLIDLRSEHGSFITDIEGRRYRAPPNFPTRFHPSDMIEFGSDKKVIFRVKVMRSPPKISEKKDEGQVLQSV

SEQ ID NO: 3580 - DNA, 2061 bp, Populus balsamifera subsp. trichocarpa
  misc_feature (1)..(2061): Ceres ANNOT ID no. 1451363
  misc_feature 398834:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atggcatcttcaactttgttttgcaacactccaacggctgttttctcaagaacccagtttccagttccaatctttagcaactcatccgtagaattctcgtcttccacgcactataactacaacttcaaaaccaagacaggtagtgctaagaaattgaaacatgtgaatgctgtagtgaccgaggcacctgctgtgagtgaatcaagagggaaacagtcagaacaaaggaagttaaaggttcttgttgctggaggtggaattggagggctggtttttgcgttggcagcaaaaaggaaagggtttgaggtgatggtttttgagaaggatttgagtgcggtaagaggagaagggcaatatagaggtccaattcagatacagagcaatgcattagctgctttggaagctattgatttagaggttgctgaagaggttatgagagctggctgtatcacgggtgataggattaatggacttgttgatggggtttctggtacttggtatgtcaagtttgataccttcactccagcagcagaaagagggcttcctgtcacgagagttattagccgaatgactttgcaacagatcctagctcgtgcagttggagatgatgtgattcttaatgatagtaatgttgttagttttcaggatgaagggaataagatcactgtggtgctcgagaatggacaacaatttgaaggtgatctcctagtgggtgctgatggaatatggtcaaaggtgaggaagaacttatttggacccaaggaggcagtgtactcaggctatacatgttatactggtatagcagattttgtgcctgtcgatatcgagactgttgggtatcgtgtatttttgggtcacaaacaatacttcgtgtcttcagatgtgggtgctggaaagatgcagtggtatgcatttcacaaggaacaacctggtggcatggatggcccccgtgtttccaatgttatcttgctgattgatatttcggcagatttgatactggccacagatgaagatgccattcttcgacgtgatatatatgacagggaacccattcttacttggggaaggggtcgtgtgaccttgcttggggattctgtccatgccatgcaaccgaatatgggtcaaggggggtgcatggccattgaggatagctaccaacttgcattggagcttgataaagcatggaaacaaagtgttgaatcaggaacctctgttgacgttatttcatcactaaggagctatgagaatgctagaagacttcgagttgccattatccatggaatggcaagaatggcggcaattatggcttcaacatacaaggcgtatctgggtgtagggcttggtccactgtcgttcttgacaaagtttcggatacctcacccaggaagagttggtggcagatttttcgttgacatagcaatgcctgtgatgctcaattgggtcttgggcggaaatagttccaaacttgaaggcaggtctctaagttgccgactctcagacaaagccagtgaccagttgcgaagatggtttgaagatgatgatgctctagagcgtgctcttgatggagagtggtttcttttaccatgtggaaatgaggctgttgcttcacaacctattggtttaagtagggatgagaacaaaccctgtgtggttgggagtgtgtcacatgatgattttccgggaatgtccatagtgatacccgcacctgaggtttcagaaatgcatgctcgtatctcttgtaaaaatggtgcattttacctaattgatttgcggagtgagcatggtacctttatcacagataatgaggggagacggtatagggcaactccgaactttcctgcccgattccatccatcagatatgattgagtttggctcggacaagaaggtgacaaataatccctgccctgttcatagcttttcttctgaaatcagattaaatccatattccaaatgcaatctaggaatcagaaccaacgcaacatttcgtgttaaggtgatgaggtctcctccgaagatttcagaaaagaaggaagaaagccaagttcttcgttcggtataa

SEQ ID NO: 3581 - protein, 686 aa, Populus balsamifera subsp. trichocarpa
  misc_feature (1)..(686): Ceres ANNOT ID no. 1451363
  misc_feature (211)..(250): Pfam Name: FAD_binding_3 Pfam Description: FAD binding domain
  misc_feature (549)..(625): Pfam Name: FHA Pfam Description: FHA domain
  misc_feature (79)..(109): Pfam Name: DAO Pfam Description: FAD dependent oxidoreductase
  misc_feature: SWISSPROT Homolog: ABA2_PRUAR Zeaxanthin epoxidase, chloroplast precursor (EC 1.14.13.90) (PA-ZE) with e-value of 1.4e-257 and BLAST sequence identity of 72.6
  misc_feature: SWISSPROT Homolog: ABA2_NICPL Zeaxanthin epoxidase, chloroplast precursor (EC 1.14.13.90) with e-value of 3.7e-250 and BLAST sequence identity of 70.7
  misc_feature: SWISSPROT Homolog: ABA2_LYCES Zeaxanthin epoxidase, chloroplast precursor (EC 1.14.13.90) with e-value of 7.4e-245 and BLAST sequence identity of 69.3
  misc_feature: SWISSPROT Homolog: ABA2_CAPAN Zeaxanthin epoxidase, chloroplast precursor (EC 1.14.13.90) (Xanthophyll epoxidase) (Beta-cyclohexenyl epoxidase) with e-value of 7.5e-236 and BLAST sequence identity of 71.1
  misc_feature: SWISSPROT Homolog: NHG2_PSEPU Salicylate hydroxylase (EC 1.14.13.1) (Salicylate 1-monooxygenase) with e-value of 3.5e-14 and BLAST sequence identity of 26.6
  misc_feature 398988:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(686): Functional Homolog of  Ceres CDNA ID no. 23461192 at SEQ ID NO. 3622 with e-value of 3.70E-246 and BLAST sequence identity of 73.0
MASSTLFCNTPTAVFSRTQFPVPIFSNSSVEFSSSTHYNYNFKTKTGSAKKLKHVNAVVTEAPAVSESRGKQSEQRKLKVLVAGGGIGGLVFALAAKRKGFEVMVFEKDLSAVRGEGQYRGPIQIQSNALAALEAIDLEVAEEVMRAGCITGDRINGLVDGVSGTWYVKFDTFTPAAERGLPVTRVISRMTLQQILARAVGDDVILNDSNVVSFQDEGNKITVVLENGQQFEGDLLVGADGIWSKVRKNLFGPKEAVYSGYTCYTGIADFVPVDIETVGYRVFLGHKQYFVSSDVGAGKMQWYAFHKEQPGGMDGPRVSNVILLIDISADLILATDEDAILRRDIYDREPILTWGRGRVTLLGDSVHAMQPNMGQGGCMAIEDSYQLALELDKAWKQSVESGTSVDVISSLRSYENARRLRVAIIHGMARMAAIMASTYKAYLGVGLGPLSFLTKFRIPHPGRVGGRFFVDIAMPVMLNWVLGGNSSKLEGRSLSCRLSDKASDQLRRWFEDDDALERALDGEWFLLPCGNEAVASQPIGLSRDENKPCVVGSVSHDDFPGMSIVIPAPEVSEMHARISCKNGAFYLIDLRSEHGTFITDNEGRRYRATPNFPARFHPSDMIEFGSDKKVTNNPCPVHSFSSEIRLNPYSKCNLGIRTNATFRVKVMRSPPKISEKKEESQVLRSV

SEQ ID NO: 3582 - DNA, 1914 bp, Populus balsamifera subsp. trichocarpa
  misc_feature (1)..(1914): Ceres ANNOT ID no. 1456957
  misc_feature 399151:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atggcatcctcaactttgtttggcaacactttaacagctgtttcttcaagaacccactttccaaccccaatctttaacaacaactcactagaattgttgtcttccgcacactctaactacaacttcaaaaccaagacaagtactagtgctaagaaattgaaagtgaaagctgtagtgactgagacacctgctgggagtaaatcagaagggaaacaatcggagcaaagaaagttaaaggttctggttgctggaggtgggattggagggctggtttttgcattggcagcaaaaaagaaagggtttgatgtgatggtttttgagaaggatttgagtgcagtaagaggagaaggacaatatagaggtccaattcaggtacagagcaatgcattagctgctttggaagctattgatttagatgttgctgaggaggttatgagagctgggtgtatcactggtgataggattaatggacttgttgatggggtctctggtacttggtatgtcaagtttgataccttcactcctgcagcagaacgagggcttccggtcacaagagttattagccgaatgactttgcaacaaatcctagctcgttcagttggagatgatatgattcttaatgatagtaatgttgttagttttcaggatgatggggataaggtcactgtggttctcgagaatgggcaacaatacgaaggcgatctcctagttggtgctgatggaatatggtcaaaggtgaggaagaacttattcgggcccaaggaaccagtgtactcaggctatacatgttataccggtatagcagattttgtgcctgttgatattgagactgttgggtatcgtgtatttttgggtcacaaacaatacttcgtttcttcagacgtgggtgctggaaagatgcagtggtatgcatttcacaaggaaccacctggtggcatggatgccccccatgtttctaatgttatctttcctattcatatttctgcagatttgctactgaccacagatgaagattccattcttcgacgtgacatttatgacagggaacccattattacatggggaaagggccgcgtgaccttgcttggggattctgtccatgccatgcaaccgaatatgggtcaagggggatgcatggccattgaggatagctaccaactcgcatcggaacttgagagagcatggaaacaaagcattgaatcaggaacccctgttgatgttctttcgtcactaaggagctatgagaattctagaagacttcgagttgctattatccatggaatggcaagaatggcagcaattatggcttcaacatacaaggcgtatctgggtgtaggacttggtccactgtcgttcttgacaaattttcggatacctcacccaggaagagtcggaggcagttcaaaacttgaagggaggtctctgagttgccgactctcagacaaagccaatgaccagttgcgaagatggtttgtagatgatgatgccctagagcgttctcttaacggagagtggtttcttttaccatgtggaaatgatgctgttgcttcacaacctattggtttaagtagggatgagaacaaaccctgtgtggttgggagtgtctcacaagaggattttccgggaatgtccatagtgatacctgcaccgcaggtttcaaaaacacatgctcgtataacttgtaaagatggggcattttacttgattgatttgcgcagtgagcatggttcctttatcacagatattgaggggagacggtatagggcacctccaaattttcctacccgattccatccatcagacatgattgagtttggttcagataagaaggtaatatttcgagtaaaggtgatgaggtctcctccaaagatttcagagaagaaggatgagggtcaagttcttcagtcagtataa

SEQ ID NO: 3583 - protein, 637 aa, Populus balsamifera subsp. trichocarpa
  misc_feature (1)..(637): Ceres ANNOT ID no. 1456957
  misc_feature (356)..(391): Pfam Name: FAD_binding_3 Pfam Description: FAD binding domain
  misc_feature (530)..(606): Pfam Name: FHA Pfam Description: FHA domain
  misc_feature (79)..(109): Pfam Name: DAO Pfam Description: FAD dependent oxidoreductase
  misc_feature: SWISSPROT Homolog: ABA2_PRUAR Zeaxanthin epoxidase, chloroplast precursor (EC 1.14.13.90) (PA-ZE) with e-value of 1.4e-257 and BLAST sequence identity of 72.6
  misc_feature: SWISSPROT Homolog: ABA2_NICPL Zeaxanthin epoxidase, chloroplast precursor (EC 1.14.13.90) with e-value of 3.7e-250 and BLAST sequence identity of 70.7
  misc_feature: SWISSPROT Homolog: ABA2_LYCES Zeaxanthin epoxidase, chloroplast precursor (EC 1.14.13.90) with e-value of 7.4e-245 and BLAST sequence identity of 69.3
  misc_feature: SWISSPROT Homolog: ABA2_CAPAN Zeaxanthin epoxidase, chloroplast precursor (EC 1.14.13.90) (Xanthophyll epoxidase) (Beta-cyclohexenyl epoxidase) with e-value of 7.5e-236 and BLAST sequence identity of 71.1
  misc_feature: SWISSPROT Homolog: NHG2_PSEPU Salicylate hydroxylase (EC 1.14.13.1) (Salicylate 1-monooxygenase) with e-value of 3.5e-14 and BLAST sequence identity of 26.6
  misc_feature 399299:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(637): Functional Homolog of  Ceres CDNA ID no. 23461192 at SEQ ID NO. 3622 with e-value of 1.79E-233 and BLAST sequence identity of 72.2
MASSTLFGNTLTAVSSRTHFPTPIFNNNSLELLSSAHSNYNFKTKTSTSAKKLKVKAVVTETPAGSKSEGKQSEQRKLKVLVAGGGIGGLVFALAAKKKGFDVMVFEKDLSAVRGEGQYRGPIQVQSNALAALEAIDLDVAEEVMRAGCITGDRINGLVDGVSGTWYVKFDTFTPAAERGLPVTRVISRMTLQQILARSVGDDMILNDSNVVSFQDDGDKVTVVLENGQQYEGDLLVGADGIWSKVRKNLFGPKEPVYSGYTCYTGIADFVPVDIETVGYRVFLGHKQYFVSSDVGAGKMQWYAFHKEPPGGMDAPHVSNVIFPIHISADLLLTTDEDSILRRDIYDREPIITWGKGRVTLLGDSVHAMQPNMGQGGCMAIEDSYQLASELERAWKQSIESGTPVDVLSSLRSYENSRRLRVAIIHGMARMAAIMASTYKAYLGVGLGPLSFLTNFRIPHPGRVGGSSKLEGRSLSCRLSDKANDQLRRWFVDDDALERSLNGEWFLLPCGNDAVASQPIGLSRDENKPCVVGSVSQEDFPGMSIVIPAPQVSKTHARITCKDGAFYLIDLRSEHGSFITDIEGRRYRAPPNFPTRFHPSDMIEFGSDKKVIFRVKVMRSPPKISEKKDEGQVLQSV

SEQ ID NO: 3584 - DNA, 1536 bp, Populus balsamifera subsp. trichocarpa
  misc_feature (1)..(1536): Ceres ANNOT ID no. 1481026
  misc_feature 399453:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atggcaacatttcattgtctgagttctagctattaccattacaagaattgcaatactggttttgtggactttagattcaaaagaagcagctttgttgtcaggtgtgaaagggcaagttgttgtaatcaaggttcttcatgtgtagagagggatgagaagaggaggctcaggatcttgattgctggtgggggtatagggggattggttttggctttagcagcaaaacatagaggatatgacgtgaaggtgtttgagaaggatttgagtgcagtaagaggggagggtaggcacaggggtcctattcaattattgagtagtgctttggcagttttgcaggttattgatgggaatgttgcaaagcaaattatggacgctggctgtgttactggtgaccgcatcaatggcgttgcagatggcgtctcaggtaaatggtttattaaatttaatctcttgaatcatgctatgaagagaggactccctgttacctctgttatatgtagaatggcattgcaagacattttactcaacggtgttggtttagacatagtaagaaacaaatctaaagttgttgacttcatgcaagattctaacaaggttacagtgatccttgaggatggacagcattatgatggtgatgttttagttggggcagatggcatatggtcaaaagttcggtcaaaactttttgggcaggaggatgcaaaatattcagattatacatgctatagtggacttgcaaactttgtcccacattatgttgactctattgggtatcgggtgttcttaggattgaaccagtactttgttgcttcagatgttggaaatggaaagatgcaatggtatgctttccacaaggagcctcctaataacacagatcctccaagaggcaaatctctgaactgcgcgtgttcttcgaatgctgcaggaaagaagaagaggctgctaaatttgtttggacattggtgcaaggaagtagttgaactaatatcagaaacacaagaggatatgattctacgaagggacatttatgatagagacatgatctacacctgggggattggaagggtgactctgctaggcgatgctgctcatccgatgcaaccaaatctggggcaagggggttgcatggcaattgaggactgctaccaacttattctcgagctcgataaggttgtcaagagtggcttagattttcaacagtcaaacgaaatttccaccatgcttcgaaggtacgagaagaaaagaatgttccgcattagtacagttcatgcagccagcagaatggcatcgaaagcgctcaccgcttaccgaccttacatggaatttggatctggctccttgtcttttatgctgtcacagtatatatcatctccaaagataaccaaaccctcagttcttgtgattttggtgaaagaggaacagaagaatttgaactcatgctaccttcaatggcctcacctatgttttgaaattagtccagttcttagaaaatgcctacttcctgtgatgggatttcaagttaagcaggagcagtaa

SEQ ID NO: 3585 - protein, 511 aa, Populus balsamifera subsp. trichocarpa
  misc_feature (1)..(511): Ceres ANNOT ID no. 1481026
  misc_feature (55)..(426): Pfam Name: FAD_binding_3 Pfam Description: FAD binding domain
  misc_feature: SWISSPROT Homolog: ABA2_PRUAR Zeaxanthin epoxidase, chloroplast precursor (EC 1.14.13.90) (PA-ZE) with e-value of 1.4e-257 and BLAST sequence identity of 72.6
  misc_feature: SWISSPROT Homolog: ABA2_NICPL Zeaxanthin epoxidase, chloroplast precursor (EC 1.14.13.90) with e-value of 3.7e-250 and BLAST sequence identity of 70.7
  misc_feature: SWISSPROT Homolog: ABA2_LYCES Zeaxanthin epoxidase, chloroplast precursor (EC 1.14.13.90) with e-value of 7.4e-245 and BLAST sequence identity of 69.3
  misc_feature: SWISSPROT Homolog: ABA2_CAPAN Zeaxanthin epoxidase, chloroplast precursor (EC 1.14.13.90) (Xanthophyll epoxidase) (Beta-cyclohexenyl epoxidase) with e-value of 7.5e-236 and BLAST sequence identity of 71.1
  misc_feature: SWISSPROT Homolog: NHG2_PSEPU Salicylate hydroxylase (EC 1.14.13.1) (Salicylate 1-monooxygenase) with e-value of 3.5e-14 and BLAST sequence identity of 26.6
  misc_feature 399577:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(511): Functional Homolog of  Ceres CDNA ID no. 23461192 at SEQ ID NO. 3622 with e-value of 1.19E-126 and BLAST sequence identity of 55.1
MATFHCLSSSYYHYKNCNTGFVDFRFKRSSFVVRCERASCCNQGSSCVERDEKRRLRILIAGGGIGGLVLALAAKHRGYDVKVFEKDLSAVRGEGRHRGPIQLLSSALAVLQVIDGNVAKQIMDAGCVTGDRINGVADGVSGKWFIKFNLLNHAMKRGLPVTSVICRMALQDILLNGVGLDIVRNKSKVVDFMQDSNKVTVILEDGQHYDGDVLVGADGIWSKVRSKLFGQEDAKYSDYTCYSGLANFVPHYVDSIGYRVFLGLNQYFVASDVGNGKMQWYAFHKEPPNNTDPPRGKSLNCACSSNAAGKKKRLLNLFGHWCKEVVELISETQEDMILRRDIYDRDMIYTWGIGRVTLLGDAAHPMQPNLGQGGCMAIEDCYQLILELDKVVKSGLDFQQSNEISTMLRRYEKKRMFRISTVHAASRMASKALTAYRPYMEFGSGSLSFMLSQYISSPKITKPSVLVILVKEEQKNLNSCYLQWPHLCFEISPVLRKCLLPVMGFQVKQEQ

SEQ ID NO: 3586 - protein, 460 aa, Arabidopsis thaliana
  misc_feature (1)..(460): Ceres CDNA ID no. 23467433
  misc_feature (1)..(460): Also Known As Ceres GEMINI ID 5110E7
  misc_feature (178)..(203): Pfam Name: zf-MYND Pfam Description: MYND finger
  misc_feature (388)..(435): Pfam Name: SET Pfam Description: SET domain
  misc_feature 399727:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
MDSVYKTDENFAADVAALLAPLPTPQLQEYFNKLITSRRCNGIEVKNNGTIGKGVYANSEFDEDELILKDEILVGIQHSSNKVDCLVCSFCFRFIGSIEKQIGRKLYFKNLGVSGCCDDDSSEEDECVKYNGNEEQCGGSSSSHNTLPEGVVSSLMNGEMALPHTDKFPLPSPLSCPGGCQEAFYCSESCAAADWESSHSLLCTGERSESISREALGEFIKHANDTNDIFLLAAKAIAFTILRYRKLKAEHVDKKAKQSEPKQSLLLEAWKPVSIGYKRRWWDCIALPDDVDPTDEGAFRMQIKNLACTSLELLKIAIFDKECEARIPPSQDLVVASPVEDYFLYIDDLPDAEKEETEEITRPFLDALGDEYSDCCQGTAFFPLQSCMNHSCCPNAKAFKREEDRDGQAVIIALRRISKNEEVTISYIDEELPYKERQALLADYGFSCKCSKCLEDSSSI

SEQ ID NO: 3587 - DNA, 1365 bp, Populus balsamifera subsp. trichocarpa
  misc_feature (1)..(1365): Ceres ANNOT ID no. 1488031
  misc_feature 399840:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atggaaacaaagtgtccagtagatgcaaagtgcgcagctgaaatatctgccatgctcacccctccttctcctcttcaactccaggagtatttcgaggagattatatctgaaaggaaatgccatggcattgaagtcaaacaagatggaaacttgagcaaaggggtttatgcaactatggaacttaaagaaggagaacttatactgaaggacaagatacttgtgggtttacagcatgttccaaataagcttgactgtctggtgtgtggctattgtttccaatttattgagtcagttgaatatcagattgggaggaaactttatttgcaaagtctaggcgtgcccagctgcaatggatgtgatgaggatgattctcatagaaaagcttatgaaattctaggggaatgtagttccagcagctcatacaataaagcttgtttgcctgaaggagttatagaagcattaatgaatggtgaattggtattgccttactctgacaaatttcccttgccttcaactgttccttgtcctggggggtgtcaagaagcttattattgcagcaaatcttgtgcgcagactgattgggaatcttcacattctttactttgcaccggggagaggtcagaatcattatctatagaggcactttcaaaatttatacagcatgctactgaaacaaatgatattttcctcctagcagccaagacaatttctttcaccattttaaggtataggaagctgaaagcagctaatgcagatcgttctgaactttccttacttttggaggcatggaagccaatatcaatgggatacaagagaaggtggtgggagtgcatttcatttccagatgatgttgatcgttctgatgacactgcatttaggatgcaaatacagcagcttgcattcaagtcactgcagcttctcaaggctgccatatttgatgaggaatgcgagccatttccattttctggcagtgatctggtcgtagcatctccagttgaggattattttctgtacattgatgatcttccagatcctgaaaaggaaaaggccgaaaaaattgcacggcaacttctagatgctcttggagatgactattcaatttgttgccaaggtactgcgttctatcctttacagagctgcatgaatcactcctgctgcccaaatgcacacgccttcaaaagagatgaggacagagatggccaggcagcaatcatcaccctgaaaccaattcgaaagggagaagaggttaccgtttcatacatagacgaggaccttccatttgaagacagacaggcattgctagcagattatggattcaaatgcaggtgcaacgcttgcttagagcaagaccccaacaaaaagtag

SEQ ID NO: 3588 - protein, 454 aa, Populus balsamifera subsp. trichocarpa
  misc_feature (1)..(454): Ceres ANNOT ID no. 1488031
  misc_feature (177)..(202): Pfam Name: zf-MYND Pfam Description: MYND finger
  misc_feature (381)..(428): Pfam Name: SET Pfam Description: SET domain
  misc_feature: SWISSPROT Homolog: SMYD5_MOUSE SET and MYND domain-containing protein 5 (Protein NN8-4AG) with e-value of 3.1e-13 and BLAST sequence identity of 36.1
  misc_feature: SWISSPROT Homolog: SMYD5_CHICK SET and MYND domain-containing protein 5 with e-value of 6.4e-13 and BLAST sequence identity of 33.6
  misc_feature: SWISSPROT Homolog: SMYD5_XENLA SET and MYND domain-containing protein 5 with e-value of 5.1e-11 and BLAST sequence identity of 26.3
  misc_feature: SWISSPROT Homolog: SMYD5_HUMAN SET and MYND domain-containing protein 5 (Protein NN8-4AG) with e-value of 1.2e-10 and BLAST sequence identity of 26.4
  misc_feature: SWISSPROT Homolog: SMYD2_HUMAN SET and MYND domain-containing protein 2 (HSKM-B) with e-value of 5.2e-09 and BLAST sequence identity of 40.3
  misc_feature 399962:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(454): Functional Homolog of  Ceres CDNA ID no. 23467433 at SEQ ID NO. 3633 with e-value of 6.69E-163 and BLAST sequence identity of 68.3
METKCPVDAKCAAEISAMLTPPSPLQLQEYFEEIISERKCHGIEVKQDGNLSKGVYATMELKEGELILKDKILVGLQHVPNKLDCLVCGYCFQFIESVEYQIGRKLYLQSLGVPSCNGCDEDDSHRKAYEILGECSSSSSYNKACLPEGVIEALMNGELVLPYSDKFPLPSTVPCPGGCQEAYYCSKSCAQTDWESSHSLLCTGERSESLSIEALSKFIQHATETNDIFLLAAKTISFTILRYRKLKAANADRSELSLLLEAWKPISMGYKRRWWECISFPDDVDRSDDTAFRMQIQQLAFKSLQLLKAAIFDEECEPFPFSGSDLVVASPVEDYFLYIDDLPDPEKEKAEKIARQLLDALGDDYSICCQGTAFYPLQSCMNHSCCPNAHAFKRDEDRDGQAAIITLKPIRKGEEVTVSYIDEDLPFEDRQALLADYGFKCRCNACLEQDPNKK

SEQ ID NO: 3589 - protein, 359 aa, Arabidopsis thaliana
  misc_feature (1)..(359): Ceres CDNA ID no. 23467847
  misc_feature (1)..(359): Also Known As Ceres GEMINI ID 5109D1
  misc_feature (10)..(141): Pfam Name: NAM Pfam Description: No apical meristem (NAM) protein
  misc_feature 400097:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
MISKDPRSSLPPGFRFHPTDEELILHYLRKKVSSSPVPLSIIADVDIYKSDPWDLPAKAPFGEKEWYFFSPRDRKYPNGARPNRAAASGYWKATGTDKLIAVPNGEGFHENIGIKKALVFYRGKPPKGVKTNWIMHEYRLADSLSPKRINSSRSGGSEVNNNFGDRNSKEYSMRLDDWVLCRIYKKSHASLSSPDVALVTSNQEHEENDNEPFVDRGTFLPNLQNDQPLKRQKSSCSFSNLLDATDLTFLANFLNETPENRSESDFSFMIGNFSNPDIYGNHYLDQKLPQLSSPTSETSGIGSKRERVDFAEETINASKKMMNTYSYNNSIDQMDHSMMQQPSFLNQELMMSSHLQYQG

SEQ ID NO: 3590 - DNA, 1107 bp, Populus balsamifera subsp. trichocarpa
  misc_feature (1)..(1107): Ceres ANNOT ID no. 1469679
  misc_feature 400192:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atgaagaacccacaatcaagcttgcccccagggtttaggttccacccgacagatgaggagctcatcctccattaccttaagaagaagttggcatccacaccgtttcctgtgtctatcatagcagatgttgacatctataagtttgatccgtgggacttgccagctaaagcttccttgggggagaaagagtggtactttttcagtcctagagatcgcaagtaccccaatggagcaaggcctaacagagcagctgcatctggatattggaaggcaactgggacagacaaaatcataatggcatcaacaatggcaccaggaggtgtagttggagggcaagagaacattggagttaaaaaggctcttgttttctacaagggaaagcctccaaagggtgtcaagactaattggatcatgcatgagtatcgcctagcagataaccccgcctgcaacaacaacaagaaatccatgaagccaaaagattcatccatgaggttagatgattgggttctttgccggatttacaagaaatcccatgccttgacttcatctccaagggcattaatatccagtgaacatgaccaagaagaagaagaagaagaacaacaacaacaacaatttgtccaagaaacccttttacccataagcaacaagaataatctcatgtcccagaaatcttgttctttctccaacttgttcgatgccatggactactccatgtggagtagtttcctggcagataccccattcaatccaacagggtttgagtcaaatcctacattgaatagtactgcaacacagttggaccaacctttcttcagtaacagcaactctgcaagcaacagtaacagcacgagcagcggttcctttcttcagaagttacctcagttgaacacttcaatgccaaacatgcaggagaataaactcaagcgccagcttccacacattgacgaggacttgctgcacccatcaaaaaagttcatgaactcttgcagtttcactaacaccaacaataatactcaaactgatatgggtcaatacaatttcgtaagccagccattcttggaccagcaattgcttttgagcccacatcttcaatttctaggttaa

SEQ ID NO: 3591 - protein, 368 aa, Populus balsamifera subsp. trichocarpa
  misc_feature (1)..(368): Ceres ANNOT ID no. 1469679
  misc_feature (8)..(144): Pfam Name: NAM Pfam Description: No apical meristem (NAM) protein
  misc_feature: SWISSPROT Homolog: NAC18_ARATH NAC domain-containing protein 18 (ANAC018) NO APICAL MERISTEM protein (AtNAM) with e-value of 2.2e-64 and BLAST sequence identity of 57.9
  misc_feature: SWISSPROT Homolog: NAC68_ORYSA NAC domain-containing protein 68 (ONAC068) with e-value of 2.5e-59 and BLAST sequence identity of 71.9
  misc_feature: SWISSPROT Homolog: NAC2_ARATH NAC domain-containing protein 2 (ANAC002) with e-value of 1.1e-58 and BLAST sequence identity of 66.7
  misc_feature: SWISSPROT Homolog: NAC48_ORYSA NAC domain-containing protein 48 (ONAC048) with e-value of 5.8e-58 and BLAST sequence identity of 65.5
  misc_feature: SWISSPROT Homolog: NAC29_ARATH NAC domain-containing protein 29 (ANAC029) (NAC2) (NAC-LIKE, ACTIVATED BY AP3/PI protein) (NAP) with e-value of 4.1e-54 and BLAST sequence identity of 69.1
  misc_feature 400302:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(368): Functional Homolog of  Ceres CDNA ID no. 23467847 at SEQ ID NO. 3636 with e-value of 2.00E-92 and BLAST sequence identity of 61.7
MKNPQSSLPPGFRFHPTDEELILHYLKKKLASTPFPVSIIADVDIYKFDPWDLPAKASLGEKEWYFFSPRDRKYPNGARPNRAAASGYWKATGTDKIIMASTMAPGGVVGGQENIGVKKALVFYKGKPPKGVKTNWIMHEYRLADNPACNNNKKSMKPKDSSMRLDDWVLCRIYKKSHALTSSPRALISSEHDQEEEEEEQQQQQFVQETLLPISNKNNLMSQKSCSFSNLFDAMDYSMWSSFLADTPFNPTGFESNPTLNSTATQLDQPFFSNSNSASNSNSTSSGSFLQKLPQLNTSMPNMQENKLKRQLPHIDEDLLHPSKKFMNSCSFTNTNNNTQTDMGQYNFVSQPFLDQQLLLSPHLQFLG

SEQ ID NO: 3592 - DNA, 1161 bp, Populus balsamifera subsp. trichocarpa
  misc_feature (1)..(1161): Ceres ANNOT ID no. 1479180
  misc_feature 400408:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atgaagaaccaacaatcaagcttgccaccagggtttaggttccaccccacagacgaggagctcatcctccattaccttaggaagaaggtagcatccacaccctttcctgtgtctatcattgcagatgttgatatctacaagtttgatccatgggacttgccagccaaagctgccttgggagagaaagagtggtactttttcagtcccagagatcgtaagtaccccaatggagctaggcctaacagagctgctgcctctggatattggaaggcgacgggaacagacaaggtcataatggcgtcaacaatcacgcctggaggtgtaattatacaaggacaagagaacgttggtgtaaaaaaggctcttgtcttctacaagggaaagcctccgaagggagtcaagactgactggattatgcatgagtatcgcctagcagatacctccagctacagctacaacaaacccatgaagccaagagattcatccatgagggtaggcttcattaacaattatatgccaacttttactcttattagcgtctgcaaacaattggatgactgggttctttgccggatttacaagaaagcccatgctttaacttcatgtgcgagagcagaaatgtccagtgaacatgagcaggaagaagaagaggaacattttgtcccagaaaaccctttaccaagcttgaaaggtcccataagcaacaagagcgcgctcatgtcccagaaatcttgctccttctccaacttattagatgccatggactattccctattgagcagtttactagcagatacccagttcaacccaacagggtttgagtcaaatcctgcactgaatagcactgcttcccaactggaccagcctcctttcttcagtaacagcaatattgcaggcggcgggggcgggggctgctttcttcaaaagttacctcagttgagcgcctcagcgcccaacaacgtggacaacaaactcaagcgccagctttcacacattgatgaggacatgctgcatccatcaaagaagttcatgaactcttgcagtttcactaacaccaacaacattagtacccaaactgataatggtcaatacaacttcctaagccagccattcttgaaccagcaattccttctgagcccacatcttcaatttcaaggttaa

SEQ ID NO: 3593 - protein, 386 aa, Populus balsamifera subsp. trichocarpa
  misc_feature (1)..(386): Ceres ANNOT ID no. 1479180
  misc_feature (8)..(145): Pfam Name: NAM Pfam Description: No apical meristem (NAM) protein
  misc_feature: SWISSPROT Homolog: NAC18_ARATH NAC domain-containing protein 18 (ANAC018) NO APICAL MERISTEM protein (AtNAM) with e-value of 2.2e-64 and BLAST sequence identity of 57.9
  misc_feature: SWISSPROT Homolog: NAC68_ORYSA NAC domain-containing protein 68 (ONAC068) with e-value of 2.5e-59 and BLAST sequence identity of 71.9
  misc_feature: SWISSPROT Homolog: NAC2_ARATH NAC domain-containing protein 2 (ANAC002) with e-value of 1.1e-58 and BLAST sequence identity of 66.7
  misc_feature: SWISSPROT Homolog: NAC48_ORYSA NAC domain-containing protein 48 (ONAC048) with e-value of 5.8e-58 and BLAST sequence identity of 65.5
  misc_feature: SWISSPROT Homolog: NAC29_ARATH NAC domain-containing protein 29 (ANAC029) (NAC2) (NAC-LIKE, ACTIVATED BY AP3/PI protein) (NAP) with e-value of 4.1e-54 and BLAST sequence identity of 69.1
  misc_feature 400520:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(386): Functional Homolog of  Ceres CDNA ID no. 23467847 at SEQ ID NO. 3636 with e-value of 2.99E-89 and BLAST sequence identity of 59.3
MKNQQSSLPPGFRFHPTDEELILHYLRKKVASTPFPVSIIADVDIYKFDPWDLPAKAALGEKEWYFFSPRDRKYPNGARPNRAAASGYWKATGTDKVIMASTITPGGVIIQGQENVGVKKALVFYKGKPPKGVKTDWIMHEYRLADTSSYSYNKPMKPRDSSMRVGFINNYMPTFTLISVCKQLDDWVLCRIYKKAHALTSCARAEMSSEHEQEEEEEHFVPENPLPSLKGPISNKSALMSQKSCSFSNLLDAMDYSLLSSLLADTQFNPTGFESNPALNSTASQLDQPPFFSNSNIAGGGGGGCFLQKLPQLSASAPNNVDNKLKRQLSHIDEDMLHPSKKFMNSCSFTNTNNISTQTDNGQYNFLSQPFLNQQFLLSPHLQFQG

SEQ ID NO: 3594 - protein, 419 aa, Arabidopsis thaliana
  misc_feature (1)..(419): Ceres CDNA ID no. 23477523
  misc_feature (1)..(419): Also Known As Ceres GEMINI ID 5110B9
  misc_feature (16)..(82): Pfam Name: dsrm Pfam Description: Double-stranded RNA binding motif
  misc_feature 400643:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
MTSTDVSSGVSNCYVFKSRLQEYAQKYKLPTPVYEIVKEGPSHKSLFQSTVILDGVRYNSLPGFFNRKAAEQSAAEVALRELAKSSELSQCVSQPVHETGLCKNLLQEYAQKMNYAIPLYQCQKVETLGRVTQFTCTVEIGGIKYTGAATRTKKDAEISAGRTALLAIQSDTKNNLANYNTQLTVLPCEKKTIQAAIPLKETVKTLKARKAQFKKKAQKGKRTVAKNPEDIIIPPQPTDHCQNDQSEKIETTPNLEPSSCMNGLKEAAFGSVETEKIETTPNLEPPSCMNGLKEAAFGSVETEKIETTPNLEPPSCMNGLKEAAFGSVETEKIETTPNLEPSSCMNGLKEAAFGSVETEKIETTPNLEPPSCMNGLKEAAFGSVETEKIETTPNLESSSCMSGLKEAAFGSVETEASHA

SEQ ID NO: 3595 - DNA, 1068 bp, Populus balsamifera subsp. trichocarpa; identical to SEQ ID NO: 2875
  misc_feature (1)..(1068): Ceres ANNOT ID no. 1443651
  misc_feature 400750:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature 400763:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (788)..(788): n is a, c, t, g, unknown, or other
  misc_feature 400781:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (789)..(789): n is a, c, t, g, unknown, or other
  misc_feature 400799:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (857)..(857): n is a, c, t, g, unknown, or other

SEQ ID NO: 3596 - protein, 355 aa, Populus balsamifera subsp. trichocarpa; identical to SEQ ID NO: 2876
  misc_feature (1)..(355): Ceres ANNOT ID no. 1443651
  misc_feature (102)..(168): Pfam Name: dsrm Pfam Description: Double-stranded RNA binding motif
  misc_feature 400872:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (1)..(355): Functional Homolog of  Ceres CDNA ID no. 23477523 at SEQ ID NO. 3641 with e-value of 6.20E-73 and BLAST sequence identity of 49.4

SEQ ID NO: 3597 - DNA, 1068 bp, Populus balsamifera subsp. trichocarpa
  misc_feature (1)..(1068): Ceres ANNOT ID no. 1451622
  misc_feature 400975:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
atgcccaccaacgaaggattctcaggtgtatccaattgctatgtgttcaagagtagattgcaggagtatgcacaaaaggcaggcttgcctactcctgtatatgagacaatcaaagaaggcccttctcatgagccatccttcaggtcgacagtgattgtgaaggaagttagatatgattctttacctggttttttcaatcggaaggcggcagagcaatctgctgctgaggttgctcttgtggagttggctaaagctggccaaattaatgaatccacttctcaacctgttcatgaaacaggattatgcaagaatctacttcaggagtatgcacaaaagatgaattatgcaattccgttatatgagtgccaaaaggatgaaacaccaggtcgagggctcgtttttaaatgtactgttgagattggggggattcggtatattggagcatcagcaaaaaccaaaaaagaagcggagatcaaagctgctagaactgctttgttagcaatccaatcgagtggatctgataaaccaagtggcaactctcaattaacggtaattccatgtagaaagaggggagttgagactagtgttcaagaggagatggcaaatattcccaagcctaagaaggcccggtttaagaagaaaaggttgaaaaacaaactctccggggacaggatagacaatgctcaaagtgaacttactgaaaacttggatactatggatggtcaatctggatcagaaacagatcaaactgatggttctatcatccgaggagcaaattgcaaacctctagcaatgggaacaacgatgactgcccatgatggaaagcctgacactgacttgaatgagagagaaacttctgatactaaaggtgctttgacttccaatgactctggtaatcctggaagtggacagtcagcatctccaaattttaatcaaatcaatcatgggactggtgcggaaatatcagctgagtctaatgcaggaaaaggtaaggttactggaattatagaggctacttcaatggcaaacactcctgtgctcgctcagataggagcttcaaatgcttaa

SEQ ID NO: 3598 - protein, 355 aa, Populus balsamifera subsp. trichocarpa
  misc_feature (1)..(355): Ceres ANNOT ID no. 1451622
  misc_feature (16)..(82): Pfam Name: dsrm Pfam Description: Double-stranded RNA binding motif
  misc_feature 401043:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (1)..(355): Functional Homolog of  Ceres CDNA ID no. 23477523 at SEQ ID NO. 3641 with e-value of 1.29E-72 and BLAST sequence identity of 66.6
MPTNEGFSGVSNCYVFKSRLQEYAQKAGLPTPVYETIKEGPSHEPSFRSTVIVKEVRYDSLPGFFNRKAAEQSAAEVALVELAKAGQINESTSQPVHETGLCKNLLQEYAQKMNYAIPLYECQKDETPGRGLVFKCTVEIGGIRYIGASAKTKKEAEIKAARTALLAIQSSGSDKPSGNSQLTVIPCRKRGVETSVQEEMANIPKPKKARFKKKRLKNKLSGDRIDNAQSELTENLDTMDGQSGSETDQTDGSIIRGANCKPLAMGTTMTAHDGKPDTDLNERETSDTKGALTSNDSGNPGSGQSASPNFNQINHGTGAEISAESNAGKGKVTGIIEATSMANTPVLAQIGASNA

SEQ ID NO: 3599 - protein, 378 aa, Arabidopsis thaliana
  misc_feature (1)..(378): Ceres CDNA ID no. 23480178
  misc_feature (1)..(378): Also Known As Ceres GEMINI ID 5111C1
  misc_feature (206)..(327): Pfam Name: TFIIS_M Pfam Description: Transcription factor S-II (TFIIS) central domain
  misc_feature (338)..(376): Pfam Name: TFIIS_C Pfam Description: Transcription factor S-II (TFIIS)
  misc_feature 401167:<222: Transcription Factor
  misc_feature: Phenotype: Activates expression of the gene endogenous to the AtPES (SEQ ID NO 4142) regalutory region Useful for modulating Terpenoid Biosynthesis
MESDLIDLFEGAKKAADAAALDGVTSSGPEVSQCIDALKQLKKFPVTYDTLVATQVGKKLRSLAKHPVEDIKSVATDLLEIWKKVVIEETAKAKKTEGTNGCKEAKVNKMDVEKPSNPAPVKVQKLQRGDSAKSIKVERKEPDNKVVTGVKIERKVPDIKVTNGTKIDYRGQAVKDEKVSKDNQSSMKAPAKAANAPPKLTAMLKCNDPVRDKIRELLVEALCRVAGEADDYERESVNASDPLRVAVSVESLMFEKLGRSTGAQKLKYRSIMFNLRDSNNPDLRRRVLTGEISPEKLITLSAEDMASDKRKQENNQIKEKALFDCERGLAAKASTDQFKCGRCGQRKCTYYQMQTRSADEPMTTYVTCVNCDNHWKFC

SEQ ID NO: 3600 - DNA, 1053 bp, Populus balsamifera subsp. trichocarpa
  misc_feature (1)..(1053): Ceres ANNOT ID no. 1529639
  misc_feature 401264:<222: Transcription Factor
  misc_feature: Phenotype: Activates expression of the gene endogenous to the AtPES (SEQ ID NO 4142) regalutory region Useful for modulating Terpenoid Biosynthesis
atggagaaggagttggtggagttatttgataaagcaaagaaagctgcagatgcttctctcaatgacgacaagtcgtctagtggaccggaggtgtctcggtgtgttgattcgttgaaacagctcaggaagtttaaagttaccagtgaaattctggtttccacacaggttgggaaaaaacttcgaccccttgcaaagcatcctaaggataaaatccgagctgtggcctctgacttgcttgagacgtggaaaaagatagtcattgatgagactatgagaaagaaaaatggtagcattgacaataatagttcagtaacagctgaggtatcaaaatcagcgactgtcaaagttgagaagcttcaaaagactagtatggtaaaggtttcaacctcagaaactgtcaaagttgagaagatggatcaggataagactgtcaaggttgcgcagacatgcaaggaggaaatccagacttcaagtgtgaagaaaccatcacaagcacctactggtccaccaaagctgaagacactggttaaatgcaatgatgctttacgcgacaaaattcgtgaacttcttgcagaggctttgtccaaagttgccagtgaagctgatgaggacattagagatgaagtagaggcatgtgacccaatccgagttgctgtctcagtagaatctgcgatgtttgaaaagctgggtcggtcaaatggagctcaaaaaatgaagtacagatccataatgttcaacatcaaggaccaaaacaacccggatttgaggagaaaagttcttcttggacaggttcaaccacagaggcttgttacaatgccccctgaagaaatggcaagtgaacaacggaaacgtgagaataaccaaattaaagagaaagcattgtttgattgtgaacgtggtggtaaagcggaagccacaactgatcagtttaagtgtggtcgttgtggacagcgcaagtgcacttactatcagatgcagaccaggagtgcggatgaacctatgacaacttatgtgacatgtgtaaactgtaacaaccactggaagttctgctaa

SEQ ID NO: 3601 - protein, 350 aa, Populus balsamifera subsp. trichocarpa
  misc_feature (1)..(350): Ceres ANNOT ID no. 1529639
  misc_feature (178)..(299): Pfam Name: TFIIS_M Pfam Description: Transcription factor S-II (TFIIS) central domain
  misc_feature (310)..(348): Pfam Name: TFIIS_C Pfam Description: Transcription factor S-II (TFIIS)
  misc_feature: SWISSPROT Homolog: TCEA3_MOUSE Transcription elongation factor A protein 3 with e-value of 1.1e-39 and BLAST sequence identity of 39.5
  misc_feature: SWISSPROT Homolog: TCEA3_MOUSE Transcription elongation factor S-II protein 3 Transcription elongation factor TFIIS.h
  misc_feature: SWISSPROT Homolog: TCEA2_HUMAN Transcription elongation factor A protein 2 with e-value of 3.8e-35 and BLAST sequence identity of 31.5
  misc_feature: SWISSPROT Homolog: TCEA2_HUMAN Transcription elongation factor S-II protein 2 Testis-specific S-II Transcription elongation factor TFIIS.l
  misc_feature: SWISSPROT Homolog: TCEA3_HUMAN Transcription elongation factor A protein 3 with e-value of 2.4e-33 and BLAST sequence identity of 32.5
  misc_feature: SWISSPROT Homolog: TCEA3_HUMAN Transcription elongation factor S-II protein 3 Transcription elongation factor TFIIS.h
  misc_feature: SWISSPROT Homolog: TCEA2_RAT Transcription elongation factor A protein 2 with e-value of 2.2e-32 and BLAST sequence identity of 31.5
  misc_feature: SWISSPROT Homolog: TCEA2_RAT Transcription elongation factor S-II protein 2 Testis-specific S-II (Protein S-II-T1) Transcription elongation factor TFIIS.l
  misc_feature: SWISSPROT Homolog: TCEA2_MOUSE Transcription elongation factor A protein 2 with e-value of 9.4e-32 and BLAST sequence identity of 31.4
  misc_feature: SWISSPROT Homolog: TCEA2_MOUSE Transcription elongation factor S-II protein 2 Testis-specific S-II (Protein S-II-T1) Transcription elongation factor TFIIS.l
  misc_feature 401416:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(350): Functional Homolog of  Ceres CDNA ID no. 23480178 at SEQ ID NO. 3646 with e-value of 1.69E-111 and BLAST sequence identity of 64.5
MEKELVELFDKAKKAADASLNDDKSSSGPEVSRCVDSLKQLRKFKVTSEILVSTQVGKKLRPLAKHPKDKIRAVASDLLETWKKIVIDETMRKKNGSIDNNSSVTAEVSKSATVKVEKLQKTSMVKVSTSETVKVEKMDQDKTVKVAQTCKEEIQTSSVKKPSQAPTGPPKLKTLVKCNDALRDKIRELLAEALSKVASEADEDIRDEVEACDPIRVAVSVESAMFEKLGRSNGAQKMKYRSIMFNIKDQNNPDLRRKVLLGQVQPQRLVTMPPEEMASEQRKRENNQIKEKALFDCERGGKAEATTDQFKCGRCGQRKCTYYQMQTRSADEPMTTYVTCVNCNNHWKFC

SEQ ID NO: 3602 - DNA, 1059 bp, Populus balsamifera subsp. trichocarpa
  misc_feature (1)..(1059): Ceres ANNOT ID no. 1507454
  misc_feature 401515:<222: Transcription Factor
  misc_feature: Phenotype: Activates expression of the gene endogenous to the AtPES (SEQ ID NO 4142) regalutory region Useful for modulating Terpenoid Biosynthesis
atggagatggagtttgtggagttatttgatgaagcaaagaaagctgcagatgcttctctcaatgatgacgtatcgtctagtggaccggaggtgactcggtgtgttgattcgctgaaacagctcaggaagtttaaagttactagtgaacttcttgtttctactcaggttgggaaaaaacttcgacctcttgcaaagcatcctaaggagaaaatccgagctgtggcctctgacttgcttgagatgtggaaaaagatggtcattgatgagacgagaaaaaaaaatggcagcattgacagtaaaagttcagtaaaagctgaggtatcaaaatcggagactgtcaaagttgagaagcttcgaaagactagtgtggtaaaggttgaaagggcttcaacctcagaaactgttaaagttgagaaaatggatcaggataagactgtcaaggttgagaagatgagcaagcaggaaatccagacttccagtgtgaagcaaccatcacaatcacctattggtccaccaaagctgaagacactggttaaatgtaatgatgctttacgcgacaaaatccgcgaacttcttgcagaggccttgtccaaagttgccagcgaggctgatgaggacatcagggatgaagtagaagcatgcgaccctattcgagttgctgtgtctgtagaatccatgatgtttgaaaaacttggtcggtcaaatggagcacaaaaattgaagtacagatctataatgttcaatatcaaggaccaaaacaacccagattttaggagaaaagttcttcttggagaggtccaacctgagaggcttgttaccatgggccctgaagaaatggcaagtgaacaaaggaagcgagagaataaccaaattaaagagaaagtgttgtttgattgtgagcgtagtggtcaagcacaagccacaactgatcagtttaagtgtggtcgttgtagacagcgcaaatgcacttactatcagatgcagaccaggagtgcagatgaacctatgacaacatatgtaacatgtgtaaactgcaacaaccattggaaattctgctaa

SEQ ID NO: 3603 - protein, 352 aa, Populus balsamifera subsp. trichocarpa
  misc_feature (1)..(352): Ceres ANNOT ID no. 1507454
  misc_feature (180)..(301): Pfam Name: TFIIS_M Pfam Description: Transcription factor S-II (TFIIS) central domain
  misc_feature (312)..(350): Pfam Name: TFIIS_C Pfam Description: Transcription factor S-II (TFIIS)
  misc_feature: SWISSPROT Homolog: TCEA3_MOUSE Transcription elongation factor A protein 3 with e-value of 1.1e-39 and BLAST sequence identity of 39.5
  misc_feature: SWISSPROT Homolog: TCEA3_MOUSE Transcription elongation factor S-II protein 3 Transcription elongation factor TFIIS.h
  misc_feature: SWISSPROT Homolog: TCEA2_HUMAN Transcription elongation factor A protein 2 with e-value of 3.8e-35 and BLAST sequence identity of 31.5
  misc_feature: SWISSPROT Homolog: TCEA2_HUMAN Transcription elongation factor S-II protein 2 Testis-specific S-II Transcription elongation factor TFIIS.l
  misc_feature: SWISSPROT Homolog: TCEA3_HUMAN Transcription elongation factor A protein 3 with e-value of 2.4e-33 and BLAST sequence identity of 32.5
  misc_feature: SWISSPROT Homolog: TCEA3_HUMAN Transcription elongation factor S-II protein 3 Transcription elongation factor TFIIS.h
  misc_feature: SWISSPROT Homolog: TCEA2_RAT Transcription elongation factor A protein 2 with e-value of 2.2e-32 and BLAST sequence identity of 31.5
  misc_feature: SWISSPROT Homolog: TCEA2_RAT Transcription elongation factor S-II protein 2 Testis-specific S-II (Protein S-II-T1) Transcription elongation factor TFIIS.l
  misc_feature: SWISSPROT Homolog: TCEA2_MOUSE Transcription elongation factor A protein 2 with e-value of 9.4e-32 and BLAST sequence identity of 31.4
  misc_feature: SWISSPROT Homolog: TCEA2_MOUSE Transcription elongation factor S-II protein 2 Testis-specific S-II (Protein S-II-T1) Transcription elongation factor TFIIS.l
  misc_feature 401667:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(352): Functional Homolog of  Ceres CDNA ID no. 23480178 at SEQ ID NO. 3646 with e-value of 3.49E-111 and BLAST sequence identity of 65.0
MEMEFVELFDEAKKAADASLNDDVSSSGPEVTRCVDSLKQLRKFKVTSELLVSTQVGKKLRPLAKHPKEKIRAVASDLLEMWKKMVIDETRKKNGSIDSKSSVKAEVSKSETVKVEKLRKTSVVKVERASTSETVKVEKMDQDKTVKVEKMSKQEIQTSSVKQPSQSPIGPPKLKTLVKCNDALRDKIRELLAEALSKVASEADEDIRDEVEACDPIRVAVSVESMMFEKLGRSNGAQKLKYRSIMFNIKDQNNPDFRRKVLLGEVQPERLVTMGPEEMASEQRKRENNQIKEKVLFDCERSGQAQATTDQFKCGRCRQRKCTYYQMQTRSADEPMTTYVTCVNCNNHWKFC

SEQ ID NO: 3604 - protein, 365 aa, Arabidopsis thaliana
  misc_feature (1)..(365): Ceres CDNA ID no. 23486285
  misc_feature (1)..(365): Also Known As Ceres GEMINI ID 5110C4
  misc_feature (155)..(310): Pfam Name: HhH-GPD Pfam Description: HhH-GPD superfamily base excision DNA repair protein
  misc_feature (42)..(154): Pfam Name: OGG_N Pfam Description: 8-oxoguanine DNA glycosylase, N-terminal domain
  misc_feature 401790:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MKRPRPTSQPSISSTVKPPLSPPVTPILKQKLHRTGTPKWFPLKLTHTELTLPLTFPTGQTFRWKKTGAIQYSGTIGPHLVSLRQRPGDDAVSYCVHCSTSPKSAELALLDFLNAEISLAELWSDFSKKDPRFGELARHLRGARVLRQDPLECLIQFLCSSNNNIARITKMVDFVSSLGLHLGDIDGFEFHQFPSLDRLSRVSEEEFRKAGFGYRAKYITGTVNALQAKPGGGNEWLLSLRKVELQEAVAALCTLPGVGPKVAACIALFSLDQHSAIPVDTHVWQIATNYLLPDLAGAKLTPKLHGRVAEAFVSKYGEYAGWAQTLLFIAELPAQKTLLQSFSQPINKLDESAEVNETSCDTLKP

SEQ ID NO: 3605 - DNA, 1104 bp, Populus balsamifera subsp. trichocarpa
  misc_feature (1)..(1104): Ceres ANNOT ID no. 1452123
  misc_feature 401892:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atgaagcgagccagacccacgccgccacccgccacccccaccaccagcagatcatcaccaataccacctctgccaacaccaccacaaccccgccactcctccaaaaaacaccaaaaaataattttcaagccaacaaactgggccccagtcaacctgacccagtcagaactctcactcccactcacattccccaccggccaaaccttccgttggaaacaaaccggtcccctccaatacacaggcagtctcggtcgtcacttaatctcccttaagcaccatcaaaacggcgacgtttattaccaaatccaccattccccctcccaatccgctgccaaatcagctctcctcagtttcctcaacaccaacatctcactaaccgaaatgtggcacgggttcgccgccgctgattcgcggttcgctgaattggcacagcattttaaaggagctagggttttgaggcaggatccacttgagtgcttgattcaatttttatgctcttcgaataataacatttcgaggatcactaaaatggtggatttcgtgtcctcattaggtgatcatttggggaatgttgagggttttgagttccacgcgtttccttccctggagagattggctttggttacggagcagcagctaagagaggctggttttggttatagagctaaatacgttactggaacggtgaatgctttgcaatcgaaaccggaaggaggtgtgaaatggcttgaatctcttcgaaaattacaactccaaatggtgattgattcactttgtacattacctggaattggtttaaaagtggcatcctgtattgctctgttttctctcgatcaacatcatgccatccctgttgatacgcacgtgtggcggattgctacgacacaccttgtacctgagcttgctggtgctagcctgacacctaagctctgcggccgtgtggcagatgcgtttgtgactaagtatgggaaatatgctggatgggctcagacgttacttttcattgctgaattgccctcgcagaaggcccttctaccatcagtgactgtcaatgaaaagaaatcctctaagaaaagaggcagcaaagcacaacgtggtaattga

SEQ ID NO: 3606 - protein, 367 aa, Populus balsamifera subsp. trichocarpa
  misc_feature (1)..(367): Ceres ANNOT ID no. 1452123
  misc_feature (255)..(275): Pfam Name: HHH Pfam Description: Helix-hairpin-helix motif
  misc_feature (49)..(160): Pfam Name: OGG_N Pfam Description: 8-oxoguanine DNA glycosylase, N-terminal domain
  misc_feature: SWISSPROT Homolog: OGG1_HUMAN N-glycosylase/DNA lyase [Includes: 8-oxoguanine DNA glycosylase with e-value of 2.3e-53 and BLAST sequence identity of 39.1
  misc_feature: SWISSPROT Homolog: OGG1_HUMAN EC 3.2.2.- DNA-(apurinic or apyrimidinic site) lyase EC 4.2.99.18 (AP lyase)]
  misc_feature: SWISSPROT Homolog: OGG1_MOUSE N-glycosylase/DNA lyase [Includes: 8-oxoguanine DNA glycosylase with e-value of 2.0e-52 and BLAST sequence identity of 41.0
  misc_feature: SWISSPROT Homolog: OGG1_MOUSE EC 3.2.2.- DNA-(apurinic or apyrimidinic site) lyase EC 4.2.99.18 (AP lyase)]
  misc_feature: SWISSPROT Homolog: OGG1_RAT N-glycosylase/DNA lyase [Includes: 8-oxoguanine DNA glycosylase with e-value of 1.8e-51 and BLAST sequence identity of 39.9
  misc_feature: SWISSPROT Homolog: OGG1_RAT EC 3.2.2.- DNA-(apurinic or apyrimidinic site) lyase EC 4.2.99.18 (AP lyase)]
  misc_feature: SWISSPROT Homolog: OGG1_DROME N-glycosylase/DNA lyase (dOgg1) [ Includes: 8-oxoguanine DNA glycosylase with e-value of 6.1e-44 and BLAST sequence identity of 34.7
  misc_feature: SWISSPROT Homolog: OGG1_DROME EC 3.2.2.- DNA-(apurinic or apyrimidinic site) lyase EC 4.2.99.18 (AP lyase)]
  misc_feature: SWISSPROT Homolog: OGG1_YEAST N-glycosylase/DNA lyase [Includes: 8-oxoguanine DNA glycosylase with e-value of 5.2e-31 and BLAST sequence identity of 35.3
  misc_feature: SWISSPROT Homolog: OGG1_YEAST EC 3.2.2.- DNA-(apurinic or apyrimidinic site) lyase EC 4.2.99.18 (AP lyase)]
  misc_feature 402051:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(367): Functional Homolog of  Ceres CDNA ID no. 23486285 at SEQ ID NO. 3651 with e-value of 9.00E-120 and BLAST sequence identity of 67.0
MKRARPTPPPATPTTSRSSPIPPLPTPPQPRHSSKKHQKIIFKPTNWAPVNLTQSELSLPLTFPTGQTFRWKQTGPLQYTGSLGRHLISLKHHQNGDVYYQIHHSPSQSAAKSALLSFLNTNISLTEMWHGFAAADSRFAELAQHFKGARVLRQDPLECLIQFLCSSNNNISRITKMVDFVSSLGDHLGNVEGFEFHAFPSLERLALVTEQQLREAGFGYRAKYVTGTVNALQSKPEGGVKWLESLRKLQLQMVIDSLCTLPGIGLKVASCIALFSLDQHHAIPVDTHVWRIATTHLVPELAGASLTPKLCGRVADAFVTKYGKYAGWAQTLLFIAELPSQKALLPSVTVNEKKSSKKRGSKAQRGN

SEQ ID NO: 3607 - protein, 217 aa, Arabidopsis thaliana
  misc_feature (1)..(217): Ceres CDNA ID no. 23492765
  misc_feature (1)..(217): Also Known As Ceres GEMINI ID 5110C3
  misc_feature (80)..(197): Pfam Name: SSB Pfam Description: Single-strand binding protein family
  misc_feature 402175:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MANSMATLSRRLYRSLLSNPRISQASMSFCTNNITSPEDSDFDELESPIEPKASDPVSRFSGEERVMEERPLENGLDSGIFKAILVGQVGQLPLQKKLKSGRTVTLFSVGTGGIRNNRRPLINEDPREYASRSAVQWHRVSVYPERLADLVLKNVEPGTVIYLEGNLETKIFTDPVTGLVRRIREVAIRRNGRVVFLGKAGDMQQPSSAELRGVGYY

SEQ ID NO: 3608 - DNA, 663 bp, Populus balsamifera subsp. trichocarpa
  misc_feature (1)..(663): Ceres ANNOT ID no. 1521278
  misc_feature 402251:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggcaaattcaatggctgttctctcacgcaggctttaccgttcccttctctcatcaaacccaaaaatttcacagctttcaatgcccttttgcacctcctcctccaccaccaccaccaccaccaccactaacaacctctcttttcgtgaagaagagtctgaattggacggctcagacactcactcagtccccaactcaaccacctcaagttcaccatcatcatcaacaacaacatctgaaggatcgagcgggtcacgaatggtccaggatcgtccccttgaaaatggccttgatgctggcgtttacaaggcgatattggtggggcaggtggggcagaatccattgcagaagaagttgaggagtgggagggagataacgattttctcaatggggacaggtgggattcgcaataatcgaaggccattgcagaatgaggatccaagggagtatgcaaataggtgtgctgttcagtggcatcgagtttcagtctacccagagagattaggtcgtgttgtaatgcagaatgttttgcccggttcaattctatatgtggaggggaatctggagactaaagtcttcactgatccaataactggtcttgtacgacgtataagagaaattgcagttcgtcaaaatggtacgttcacatctgtagtcccttga

SEQ ID NO: 3609 - protein, 220 aa, Populus balsamifera subsp. trichocarpa
  misc_feature (1)..(220): Ceres ANNOT ID no. 1521278
  misc_feature (101)..(215): Pfam Name: SSB Pfam Description: Single-strand binding protein family
  misc_feature: SWISSPROT Homolog: SSB_ARATH Single-stranded DNA-binding protein, with e-value of 2.3e-21 and BLAST sequence identity of 34.2
  misc_feature: SWISSPROT Homolog: SSB_WIGBR Single-stranded DNA-binding protein (SSB) (Helix-destabilizing protein) with e-value of 4.3e-11 and BLAST sequence identity of 31.3
  misc_feature: SWISSPROT Homolog: SSB7_ECOLI Plasmid-derived single-stranded DNA-binding protein (SSB) (Helix-destabilizing protein) with e-value of 1.5e-10 and BLAST sequence identity of 30.1
  misc_feature: SWISSPROT Homolog: SSB2_ECOLI Plasmid-derived single-stranded DNA-binding protein (SSB) (Helix-destabilizing protein) with e-value of 5.0e-10 and BLAST sequence identity of 29.3
  misc_feature: SWISSPROT Homolog: SSB2_SALTI Single-stranded DNA-binding protein 2 (SSB 2) (Helix-destabilizing protein 2) with e-value of 5.0e-10 and BLAST sequence identity of 31.5
  misc_feature 402354:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(220): Functional Homolog of  Ceres CDNA ID no. 23492765 at SEQ ID NO. 3654 with e-value of 4.90E-64 and BLAST sequence identity of 69.2
MANSMAVLSRRLYRSLLSSNPKISQLSMPFCTSSSTTTTTTTTNNLSFREEESELDGSDTHSVPNSTTSSSPSSSTTTSEGSSGSRMVQDRPLENGLDAGVYKAILVGQVGQNPLQKKLRSGREITIFSMGTGGIRNNRRPLQNEDPREYANRCAVQWHRVSVYPERLGRVVMQNVLPGSILYVEGNLETKVFTDPITGLVRRIREIAVRQNGTFTSVVP

SEQ ID NO: 3610 - DNA, 612 bp, Populus balsamifera subsp. trichocarpa
  misc_feature (1)..(612): Ceres ANNOT ID no. 1467911
  misc_feature 402438:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggcaaattcaatggctgttctctcacgcaggctttaccgttcccttctctcatcaaacccaaaaatttcacagctttcaatgcccttttgcacctcctcctccaccaccaccaccaccaccaccactaacaacctctcttttcgtgaagaagagtctgaattggacggctcagacactcactcagtccccaactcaaccacctcaagttcaccatcatcatcaacaacaacatctgaaggatcgagcgggtcacgaatggtccaggatcgtccccttgaaaatggccttgatgctggcgtttacaaggcgatattggtggggcaggtggggcagaatccattgcagaagaagttgaggagtgggagggagataacgattttctcaatggggacaggtgggattcgcaataatcgaaggccattgcagaatgaggatccaagggagtatgcaaataggtgtgctgttcagtggcatcgagtttcagtctacccagagagattaggtcgtgttgtaatgcagaatgttttgcccggggatgaaaagagaccagtagatacgaacaaaggcaacagagatggtgatggtgatatcattattgcggaggattaa

SEQ ID NO: 3611 - protein, 203 aa, Populus balsamifera subsp. trichocarpa
  misc_feature (1)..(203): Ceres ANNOT ID no. 1467911
  misc_feature (101)..(203): Pfam Name: SSB Pfam Description: Single-strand binding protein family
  misc_feature: SWISSPROT Homolog: SSB_ARATH Single-stranded DNA-binding protein, with e-value of 2.3e-21 and BLAST sequence identity of 34.2
  misc_feature: SWISSPROT Homolog: SSB_WIGBR Single-stranded DNA-binding protein (SSB) (Helix-destabilizing protein) with e-value of 4.3e-11 and BLAST sequence identity of 31.3
  misc_feature: SWISSPROT Homolog: SSB7_ECOLI Plasmid-derived single-stranded DNA-binding protein (SSB) (Helix-destabilizing protein) with e-value of 1.5e-10 and BLAST sequence identity of 30.1
  misc_feature: SWISSPROT Homolog: SSB2_ECOLI Plasmid-derived single-stranded DNA-binding protein (SSB) (Helix-destabilizing protein) with e-value of 5.0e-10 and BLAST sequence identity of 29.3
  misc_feature: SWISSPROT Homolog: SSB2_SALTI Single-stranded DNA-binding protein 2 (SSB 2) (Helix-destabilizing protein 2) with e-value of 5.0e-10 and BLAST sequence identity of 31.5
  misc_feature 402539:<222: Transcription Factor
  misc_feature: Phenotype: Activates expression of the gene endogenous to the AtFPPS (SEQ ID NO 4145) regalutory region and/or the AtHMGR(SEQ ID NO 4164)  regulatory region. Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(203): Functional Homolog of  Ceres CDNA ID no. 23492765 at SEQ ID NO. 3654 with e-value of 5.00E-48 and BLAST sequence identity of 68.3
MANSMAVLSRRLYRSLLSSNPKISQLSMPFCTSSSTTTTTTTTNNLSFREEESELDGSDTHSVPNSTTSSSPSSSTTTSEGSSGSRMVQDRPLENGLDAGVYKAILVGQVGQNPLQKKLRSGREITIFSMGTGGIRNNRRPLQNEDPREYANRCAVQWHRVSVYPERLGRVVMQNVLPGDEKRPVDTNKGNRDGDGDIIIAED

SEQ ID NO: 3612 - protein, 391 aa, Arabidopsis thaliana
  misc_feature (1)..(391): Ceres CDNA ID no. 23493156
  misc_feature (1)..(391): Also Known As Ceres GEMINI ID 5109B1
  misc_feature (33)..(268): Pfam Name: TCP Pfam Description: TCP family transcription factor
  misc_feature 402634:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
MAPDNDHFLDSPSPPLLEMRHHQSATENGGGCGEIVEVQGGHIVRSTGRKDRHSKVCTAKGPRDRRVRLSAPTAIQFYDVQDRLGFDRPSKAVDWLITKAKSAIDDLAQLPPWNPADTLRQHAAAAANAKPRKTKTLISPPPPQPEETEHHRIGEEEDNESSFLPASMDSDSIADTIKSFFPVASTQQSYHHQPPSRGNTQNQDLLRLSLQSFQNGPPFPNQTEPALFSGQSNNQLAFDSSTASWEQSHQSPEFGKIQRLVSWNNVGAAESAGSTGGFVFASPSSLHPVYSQSQLLSQRGPLQSINTPMIRAWFDPHHHHHHHQQSMTTDDLHHHHPYHIPPGIHQSAIPGIAFASSGEFSGFRIPARFQGEQEEHGGDNKPSSASSDSRH

SEQ ID NO: 3613 - protein, 195 aa, Arabidopsis thaliana
  misc_feature (1)..(195): Ceres CDNA ID no. 23493481
  misc_feature (145)..(194): Pfam Name: CDI Pfam Description: Cyclin-dependent kinase inhibitor
  misc_feature: Phenotype: WHOLE PLANT - Early Senescence Useful for modulating crop development and harvest
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Serrate Margins Useful for making plants with increased biomass and foliage
MSETKPKRDSEYEGSNIKRMRLDDDDDVLRSPTRTLSSSSSSSLAYSVSDSGGFCSVALSEEEDDHLSSSISSGCSSSETNEIATRLPFSDLEAHEISETEISTLLTNNFRKQGISSSENLGETAEMDSATTEMRDQRKTEKKKKMEKSPTQAELDDFFSAAERYEQKRFTEKYNYDIVNDTPLEGRYQWVSLKP

SEQ ID NO: 3614 - DNA, 621 bp, Populus balsamifera subsp. trichocarpa
  misc_feature (1)..(621): Ceres ANNOT ID no. 1460973
  misc_feature 402830:<222: Transcription Factor
  misc_feature: Phenotype: WHOLE PLANT - Early Senescence Useful for modulating crop development and harvest
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Serrate Margins Useful for making plants with increased biomass and foliage
atgggagagagcgcgaggaatagtaagcgaatagctgaaactggaattctagaatcttcagtcacaagtttctctaagaaaatgaaatttgattttgacgagtttagcttaccttcgtttaatttcaagctccaagctcatctttgcaccactatgtcaccggaaaatttgatttcttcggcggcttcatcgaattctgatcgctttataaccggcaattccagctgtggcgactctccggtttcctgctgctccagcaatgaatcgatcaaggttgtgaaggacagcttgaggtttatagatctggaggcgaagagttccgaaacggaaagctcgacgtgcaatgacaggaaattcagtagagacaccactccttcaagcgagtttcacgggatgtactcgccggcagccgtggagaagaaagagaattctcacaggagaaagtcaccggctgtgaaaatgccgagtcaggctgagatcgatgcgtttttcgcgggggcagagagagaggagcagaaaagatttgcagagaagtacaactacgatgttgtgaaggatttgccagtggagggtcgctaccagtggatttgtttgaagccacagaggaaaatagagaattga

SEQ ID NO: 3615 - protein, 206 aa, Populus balsamifera subsp. trichocarpa
  misc_feature (1)..(206): Ceres ANNOT ID no. 1460973
  misc_feature (150)..(199): Pfam Name: CDI Pfam Description: Cyclin-dependent kinase inhibitor
  misc_feature 402911:<222: Transcription Factor
  misc_feature: Phenotype: WHOLE PLANT - Early Senescence Useful for modulating crop development and harvest
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Serrate Margins Useful for making plants with increased biomass and foliage
  misc_feature (1)..(206): Functional Homolog of  Ceres CDNA ID no. 23493481 at SEQ ID NO. 3660 with e-value of 8.20E-23 and BLAST sequence identity of 42.8
MGESARNSKRIAETGILESSVTSFSKKMKFDFDEFSLPSFNFKLQAHLCTTMSPENLISSAASSNSDRFITGNSSCGDSPVSCCSSNESIKVVKDSLRFIDLEAKSSETESSTCNDRKFSRDTTPSSEFHGMYSPAAVEKKENSHRRKSPAVKMPSQAEIDAFFAGAEREEQKRFAEKYNYDVVKDLPVEGRYQWICLKPQRKIEN

SEQ ID NO: 3616 - protein, 442 aa, Arabidopsis thaliana
  misc_feature (1)..(442): Ceres CDNA ID no. 23494371
  misc_feature (47)..(92): Pfam Name: F-box Pfam Description: F-box domain
  misc_feature: Phenotype: WHOLE PLANT - Small Useful for modulating plant size
  misc_feature: Phenotype: ROSETTE LEAVES - Serrate Margins Useful for making plants with increased biomass and foliage
  misc_feature: Phenotype: ROSETTE LEAVES - Undulate Shaped Useful for making plants with increased biomass and foliage
MDSTVFINNPSLTLPFSYTFTSSSNSSTTTSTTTDSSSGQWMDGRIWSKLPPPLLDRVIAFLPPPAFFRTRCVCKRFYSLLFSNTFLETYLQLLPLRHNCFLFFKHKTLKSYIYKRGGTNDDDSNKAEGFLFDPNEIRWYRLSFAYIPSGFYPSGSSGGLVSWVSEEAGLKTILLCNPLVGSVSQLPPISRPRLFPSIGLSVTPTSIDVTVAGDDLISPYAVKNLSSESFHVDAGGFFSLWAMTSSLPRLCSLESGKMVYVQGKFYCMNYSPFSVLSYEVTGNRWIKIQAPMRRFLRSPSLLESKGRLILVAAVEKSKLNVPKSLRLWSLQQDNATWVEIERMPQPLYTQFAAEEGGKGFECVGNQEFVMIVLRGTSLQLLFDIVRKSWLWVPPCPYSGSGGGSSGGGSDGEVLQGFAYDPVLTTPVVSLLDQLTLPFPGVC

SEQ ID NO: 3617 - DNA, 1320 bp, Populus balsamifera subsp. trichocarpa
  misc_feature (1)..(1320): Ceres ANNOT ID no. 1485236
  misc_feature 403137:<222: Transcription Factor
  misc_feature: Phenotype: WHOLE PLANT - Small Useful for modulating plant size
  misc_feature: Phenotype: ROSETTE LEAVES - Serrate Margins Useful for making plants with increased biomass and foliage
  misc_feature: Phenotype: ROSETTE LEAVES - Undulate Shaped Useful for making plants with increased biomass and foliage
atggaaggtgctttcagcaattccatgccctcacacttctcctacactttcacccctgggactagtagtgcttatgttacagatactgtcaccaatacttggatggacaccaggatatggagtaagctcccgcaatcgctgattgatcgtgtaatcgcctttcttccacctccagccttttttagagctcgttgtgtctgcaagagatggtatagtctcttgttctccaacaattttcttgaactctatatccaaatatccccacgccgccattggttcttattcttcaagcacaaaagcttaaaaagctacatctgtggaaacaacagtaacaccactcgtggcagtggcggccaaactagtacaaccaatatatttgaagggtacctctttgatccttacgatattgcatggtatagaatttcttttcccttggttccatctgggttctcgcctgctgctgcttctggtggcttaatatgttgggtctcagatgaggctggtgcaaagagtatcattttatgcaacccacttattggctctctatctcagttgccgccaacgttaagaccacgtctctttccttcaactggcttaaaagttgggccatcctcaattgatgtggctgttgcaggtgatgacttgatttctccatatgcagtcaagaatttatccactgaaagttttcatattgatgctggtgggttttactctctatggggtactacttcttctcttccaaggctttgtagccttgaatcaggtcaaatggtttgtgttgatgacagattttactgcatgaattacaacccatttagcgttttggcttatgaaatagcagcaaacagctggtgcaagattcaagctccaatgaggagatttctgcgctcgccaagcttggttgagagcatggaaaaactcattcttgttgcagcagtggagaagagcaagctcaacgtgccaaagagcttgagactttggagtttgcaagcttgtggaacaacatgggtagagattgaaaggatgccccagcaactttaccaacaatttgaggagatggaagctggtcacgggtttgattgtgttggacatggtgagtttattgctatcattatcagaggatcggacaaggctttgctgtttgatatcttaaggaaggcgtggcagtggattcctccatgtccttacatgaatcacggaggtggaggtgatgatgaattgcatggttttgcttatgagcctacagtcactactccagttacaggcctccttgatcagctcacaatcccatttcagtcattcagtgggttaattggctag

SEQ ID NO: 3618 - protein, 439 aa, Populus balsamifera subsp. trichocarpa
  misc_feature (1)..(439): Ceres ANNOT ID no. 1485236
  misc_feature (40)..(85): Pfam Name: F-box Pfam Description: F-box domain
  misc_feature: SWISSPROT Homolog: UFO_ARATH UNUSUAL FLORAL ORGANS protein (F-box only protein 1) (AtFBX1) with e-value of 1.2e-242 and BLAST sequence identity of 100.0
  misc_feature 403236:<222: Transcription Factor
  misc_feature: Phenotype: WHOLE PLANT - Small Useful for modulating plant size
  misc_feature: Phenotype: ROSETTE LEAVES - Serrate Margins Useful for making plants with increased biomass and foliage
  misc_feature: Phenotype: ROSETTE LEAVES - Undulate Shaped Useful for making plants with increased biomass and foliage
  misc_feature (1)..(439): Functional Homolog of  Ceres CDNA ID no. 23494371 at SEQ ID NO. 3663 with e-value of 3.20E-156 and BLAST sequence identity of 70.0
MEGAFSNSMPSHFSYTFTPGTSSAYVTDTVTNTWMDTRIWSKLPQSLIDRVIAFLPPPAFFRARCVCKRWYSLLFSNNFLELYIQISPRRHWFLFFKHKSLKSYICGNNSNTTRGSGGQTSTTNIFEGYLFDPYDIAWYRISFPLVPSGFSPAAASGGLICWVSDEAGAKSIILCNPLIGSLSQLPPTLRPRLFPSTGLKVGPSSIDVAVAGDDLISPYAVKNLSTESFHIDAGGFYSLWGTTSSLPRLCSLESGQMVCVDDRFYCMNYNPFSVLAYEIAANSWCKIQAPMRRFLRSPSLVESMEKLILVAAVEKSKLNVPKSLRLWSLQACGTTWVEIERMPQQLYQQFEEMEAGHGFDCVGHGEFIAIIIRGSDKALLFDILRKAWQWIPPCPYMNHGGGGDDELHGFAYEPTVTTPVTGLLDQLTIPFQSFSGLIG

SEQ ID NO: 3619 - DNA, 1311 bp, Populus balsamifera subsp. trichocarpa
  misc_feature (1)..(1311): Ceres ANNOT ID no. 1446740
  misc_feature 403367:<222: Transcription Factor
  misc_feature: Phenotype: WHOLE PLANT - Small Useful for modulating plant size
  misc_feature: Phenotype: ROSETTE LEAVES - Serrate Margins Useful for making plants with increased biomass and foliage
  misc_feature: Phenotype: ROSETTE LEAVES - Undulate Shaped Useful for making plants with increased biomass and foliage
atggaaggtgctttcaacaatgctatgctcttacccttctcctacactttcactcctggcactagcagtactaatgttacagatagtgttaccagtccttggatggacaccaggatatggagcaaactcccacaaacgctgattgatcgtgttctcgcctttcttcctcctccagccttttttagagctcgttgtgtctgcaagagatggtatggtctcttgttctccaataattttcttgaactctatatccagatatcaccacgccgccattggttcctattcttcaagcacaaaagcctaaaaagctgcatctatagaaacaacaatagcaccagtgatagcggcggaaaaactatgacagccaatatttgtgaaggatacctctttgatccatatgatattgcatggtatagaatttctttttccttggttccatctgggttctctcctgctgctgcttctggtggcttaatatgttgggtctcagacgaggctggtgcaaagagtatcattttatgcaacccacttagtggttctctatctcagttgccaccaactttaaggccacgtctctttccttcaattggcttaaaagttgggccatcctcaattgatgtggctgttgcaggtgatgacttgatttctccatacgcagtcaagaatttatccactgaaagctttcatattgatgtcggtgggttttactcactatggggcactacttcttctcttccaaggctttgtagccttgaatcaggacaaatggtttgtgttgacgacagattctactgcatgaattacaacccgtttagcgttttggcttatgaaatagcagcaaacagttggtgcaagattcaagctccaatgcggagatttctacgctcgccaagattggttgagagcatgggaaaactcattcttgttgcagcagtggagaagagcaagctcaacgtgccaaagagcttgagactttggcgcttgcaaccttgtggaacaacatggatagagattgaaaggatgccacagcaactttacttacaatttgcggagctgggaggtggtcatgggtttgattgtgttgggcatggtgagtttattgctatcattatccgaggatcgatcaaggttttgttgtttgatatcttgagaaagatgtggcagtggattcctccttgttcttgcattgatggagtgggagatgatgatgatgaattgcatggttttgcttacgaacctacagtcaccaccccagttacaggcctccttgatcagatcacaattccaatattccagtcctttactagttaa

SEQ ID NO: 3620 - protein, 436 aa, Populus balsamifera subsp. trichocarpa
  misc_feature (1)..(436): Ceres ANNOT ID no. 1446740
  misc_feature (40)..(85): Pfam Name: F-box Pfam Description: F-box domain
  misc_feature: SWISSPROT Homolog: UFO_ARATH UNUSUAL FLORAL ORGANS protein (F-box only protein 1) (AtFBX1) with e-value of 1.2e-242 and BLAST sequence identity of 100.0
  misc_feature 403464:<222: Transcription Factor
  misc_feature: Phenotype: WHOLE PLANT - Small Useful for modulating plant size
  misc_feature: Phenotype: ROSETTE LEAVES - Serrate Margins Useful for making plants with increased biomass and foliage
  misc_feature: Phenotype: ROSETTE LEAVES - Undulate Shaped Useful for making plants with increased biomass and foliage
  misc_feature (1)..(436): Functional Homolog of  Ceres CDNA ID no. 23494371 at SEQ ID NO. 3663 with e-value of 6.79E-154 and BLAST sequence identity of 67.7
MEGAFNNAMLLPFSYTFTPGTSSTNVTDSVTSPWMDTRIWSKLPQTLIDRVLAFLPPPAFFRARCVCKRWYGLLFSNNFLELYIQISPRRHWFLFFKHKSLKSCIYRNNNSTSDSGGKTMTANICEGYLFDPYDIAWYRISFSLVPSGFSPAAASGGLICWVSDEAGAKSIILCNPLSGSLSQLPPTLRPRLFPSIGLKVGPSSIDVAVAGDDLISPYAVKNLSTESFHIDVGGFYSLWGTTSSLPRLCSLESGQMVCVDDRFYCMNYNPFSVLAYEIAANSWCKIQAPMRRFLRSPRLVESMGKLILVAAVEKSKLNVPKSLRLWRLQPCGTTWIEIERMPQQLYLQFAELGGGHGFDCVGHGEFIAIIIRGSIKVLLFDILRKMWQWIPPCSCIDGVGDDDDELHGFAYEPTVTTPVTGLLDQITIPIFQSFTS

SEQ ID NO: 3621 - protein, 173 aa, Arabidopsis thaliana
  misc_feature (1)..(173): Ceres CDNA ID no. 23494432
  misc_feature: Phenotype: WHOLE PLANT - Dark Green Useful for increasing chlorophyll and photosynthetic capacity
  misc_feature: Phenotype: WHOLE PLANT - Small Useful for modulating plant size
MTRDWDRKIKVFSRFFQDLKRQGLLSKDSKCLCLGARVGQEVEALKRVGVNDSVGMDLVPYPPLVVKGDFHHQPFDDETFDFEFSNVFDHALYPDKFVGEIERTLRPGGLCVLHVALSTRSDKYSANDLFSVEALVKLFRQSEVVHVRNVDGFGLDTEVVFRKKRDSSILVRS

SEQ ID NO: 3622 - protein, 115 aa, Arabidopsis thaliana
  misc_feature (1)..(115): Ceres CDNA ID no. 23495481
  misc_feature (32)..(112): Pfam Name: Tryp_alpha_amyl Pfam Description: Protease inhibitor/seed storage/LTP family
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Serrate Margins Useful for making plants with increased biomass and foliage
  misc_feature: Phenotype: ROSETTE LEAVES - Trident Shaped Useful for making plants with increased biomass and foliage
MFFAHVSGCNTCFPPTPIPNLNPISNPTTPSCSRDAIKLGVCAKILDVAVGTVIGNPSDTLCCSVLQGLVDLDAAVCLCTTIKANILGINIDLPISLSLLINTCGKKLPSDCICA

SEQ ID NO: 3623 - DNA, 399 bp, Populus balsamifera subsp. trichocarpa
  misc_feature (1)..(399): Ceres ANNOT ID no. 1485271
  misc_feature 403737:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Serrate Margins Useful for making plants with increased biomass and foliage
  misc_feature: Phenotype: ROSETTE LEAVES - Trident Shaped Useful for making plants with increased biomass and foliage
atggcttccaaaagcacgacatcacttgctctctttcttgcagtcaaccttctcttcttctccctagtcaccgccaagagaagcagttgcccccctcctcctaaacccaaaccaacaccaacaccaagcccttccggtggaaagtgcccaaaggatgcacttaaattaggtgtatgtgctgatttgctcggttcattgcttaatgtcaccgttggcactcccccagtagaaccttgctgtagtctcattcaaggccttcttgatctcgaggctgctgtttgcctttgcactgccatcaaagctaacatcttgggcatcaaccttaatatccctgtatctctaagcttgcttctcaatgtctgtggaaagaaggtccccaaagatttccagtgcgcctaa

SEQ ID NO: 3624 - protein, 132 aa, Populus balsamifera subsp. trichocarpa
  misc_feature (1)..(132): Ceres ANNOT ID no. 1485271
  misc_feature (49)..(131): Pfam Name: Tryp_alpha_amyl Pfam Description: Protease inhibitor/seed storage/LTP family
  misc_feature: SWISSPROT Homolog: 14KD_DAUCA 14 kDa proline-rich protein DC2.15 precursor with e-value of 4.8e-28 and BLAST sequence identity of 52.1
  misc_feature: SWISSPROT Homolog: PRF1_LYCES 36.4 kDa proline-rich protein with e-value of 7.5e-23 and BLAST sequence identity of 50.5
  misc_feature: SWISSPROT Homolog: CCDP_MAIZE Cortical cell-delineating protein precursor (Root-specific protein ZRP3) with e-value of 2.0e-22 and BLAST sequence identity of 45.3
  misc_feature: SWISSPROT Homolog: HPSE_SOYBN Hydrophobic seed protein (HPS) (Allergen Gly m 1) with e-value of 1.1e-10 and BLAST sequence identity of 40.2
  misc_feature 403840:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Serrate Margins Useful for making plants with increased biomass and foliage
  misc_feature: Phenotype: ROSETTE LEAVES - Trident Shaped Useful for making plants with increased biomass and foliage
  misc_feature (1)..(132): Functional Homolog of  Ceres CDNA ID no. 23495481 at SEQ ID NO. 3669 with e-value of 2.50E-30 and BLAST sequence identity of 52.1
MASKSTTSLALFLAVNLLFFSLVTAKRSSCPPPPKPKPTPTPSPSGGKCPKDALKLGVCADLLGSLLNVTVGTPPVEPCCSLIQGLLDLEAAVCLCTAIKANILGINLNIPVSLSLLLNVCGKKVPKDFQCA

SEQ ID NO: 3625 - DNA, 432 bp, Populus balsamifera subsp. trichocarpa
  misc_feature (1)..(432): Ceres ANNOT ID no. 1447245
  misc_feature 403928:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Serrate Margins Useful for making plants with increased biomass and foliage
  misc_feature: Phenotype: ROSETTE LEAVES - Trident Shaped Useful for making plants with increased biomass and foliage
atggcttccaaaagcacagcatcagttgctctctttcttgcactcaacctcctcttcttttccctagtcacggcctgtggagggggttgcccgtctccaaaaccaaagccaaagccaaagccaaagccaaagccaacaccaacaccaacaccaacaccaagcccttccggtggaaagtgccctaaagatgcacttaaattaggtgtatgtgctgatttgctcggttcattgcttaatgtcaccgttggcagtccccctgtaaagccttgctgcagtgtcattcaaggccttcttgatctcgaggctgctgtttgcctttgcactgccatcaaagctaacatcctgggtatcaaccttaacatcccactctctctaagcttgcttctcaatgtctgtggaaagaaagtccccaaagacttccaatgttcctaa

SEQ ID NO: 3626 - protein, 143 aa, Populus balsamifera subsp. trichocarpa
  misc_feature (1)..(143): Ceres ANNOT ID no. 1447245
  misc_feature (60)..(142): Pfam Name: Tryp_alpha_amyl Pfam Description: Protease inhibitor/seed storage/LTP family
  misc_feature: SWISSPROT Homolog: 14KD_DAUCA 14 kDa proline-rich protein DC2.15 precursor with e-value of 4.8e-28 and BLAST sequence identity of 52.1
  misc_feature: SWISSPROT Homolog: PRF1_LYCES 36.4 kDa proline-rich protein with e-value of 7.5e-23 and BLAST sequence identity of 50.5
  misc_feature: SWISSPROT Homolog: CCDP_MAIZE Cortical cell-delineating protein precursor (Root-specific protein ZRP3) with e-value of 2.0e-22 and BLAST sequence identity of 45.3
  misc_feature: SWISSPROT Homolog: HPSE_SOYBN Hydrophobic seed protein (HPS) (Allergen Gly m 1) with e-value of 1.1e-10 and BLAST sequence identity of 40.2
  misc_feature 404033:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Serrate Margins Useful for making plants with increased biomass and foliage
  misc_feature: Phenotype: ROSETTE LEAVES - Trident Shaped Useful for making plants with increased biomass and foliage
  misc_feature (1)..(143): Functional Homolog of  Ceres CDNA ID no. 23495481 at SEQ ID NO. 3669 with e-value of 5.89E-29 and BLAST sequence identity of 56.5
MASKSTASVALFLALNLLFFSLVTACGGGCPSPKPKPKPKPKPKPTPTPTPTPSPSGGKCPKDALKLGVCADLLGSLLNVTVGSPPVKPCCSVIQGLLDLEAAVCLCTAIKANILGINLNIPLSLSLLLNVCGKKVPKDFQCS

SEQ ID NO: 3627 - protein, 172 aa, Arabidopsis thaliana
  misc_feature (1)..(172): Ceres CDNA ID no. 23495742
  misc_feature (1)..(172): Also Known As Ceres GEMINI ID 5109D9
  misc_feature (9)..(59): Pfam Name: SRF-TF Pfam Description: SRF-type transcription factor DNA-binding and dimerisation domain)
  misc_feature 404136:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MGRRKIKMEMVQDMNTRQVTFSKRRTGLFKKASELATLCNAELGIVVFSPGGKPFSYGKPNLDSVAERFMREYDDSDSGDEEKSGNYRPKLKRLSERLDLLNQEVEAEKERGEKSQEKLESAGDERFKESIETLTLDELNEYKDRLQTVHGRIEGQVNHLQASSCLMLLSRK

SEQ ID NO: 3628 - DNA, 537 bp, Populus balsamifera subsp. trichocarpa
  misc_feature (1)..(537): Ceres ANNOT ID no. 1449879
  misc_feature 404202:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atgggcaggcgaaagatagagatagagatggtgaaagatagcaactctcggcaagtgactttctcaaagcgccgaacaggggttttcaagaaagccaacgagcttgctaccttgtgtggtgtgcaaattgccatcatcgtcttctctccaggggggaaaccattttcatttggccaccccaatgtcgagtttgtggctcagaggtttctaaatcgggataagaaacccaaggtttcggctggtagccttgttgattctcaacaagaggctagattggagaagcttaatagtcaactcaatgatattctcaggaaacttcagtatgaaagaaagaggggggaattgctagagaaggcaatgaaattaaagggttcggaacccaaacttattggtgagctaaatcttgatgaacttcggaagatgaagggagaactggaggagcttcaagaaaagttgcgagggcgtgttacagaaatggaggcgtcctcttcactgctacttctgtctaagaaacctactagagagaaacatcagtag

SEQ ID NO: 3629 - protein, 178 aa, Populus balsamifera subsp. trichocarpa
  misc_feature (1)..(178): Ceres ANNOT ID no. 1449879
  misc_feature (9)..(59): Pfam Name: SRF-TF Pfam Description: SRF-type transcription factor DNA-binding and dimerisation domain)
  misc_feature: SWISSPROT Homolog: MAD29_ORYSA MADS-box transcription factor 29 (OsMADS29) with e-value of 1.2e-18 and BLAST sequence identity of 56.7
  misc_feature: SWISSPROT Homolog: AGL6_ARATH Agamous-like MADS-box protein AGL6 with e-value of 6.4e-17 and BLAST sequence identity of 35.7
  misc_feature: SWISSPROT Homolog: MAD15_ORYSA MADS-box transcription factor 15 (OsMADS15) Protein APETALA1-like A  (FDRMADS3) (RMADS215) with e-value of 6.4e-17 and BLAST sequence identity of 31.5
  misc_feature: SWISSPROT Homolog: CAL_ARATH Transcription factor CAULIFLOWER (Agamous-like MADS-box protein AGL10) with e-value of 8.2e-17 and BLAST sequence identity of 33.0
  misc_feature: SWISSPROT Homolog: MAD17_ORYSA MADS-box transcription factor 17 (OsMADS17) (NMADS3) (RMADS213) with e-value of 9.2e-17 and BLAST sequence identity of 33.6
  misc_feature 404299:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(178): Functional Homolog of  Ceres CDNA ID no. 23495742 at SEQ ID NO. 3674 with e-value of 1.80E-36 and BLAST sequence identity of 46.4
MGRRKIEIEMVKDSNSRQVTFSKRRTGVFKKANELATLCGVQIAIIVFSPGGKPFSFGHPNVEFVAQRFLNRDKKPKVSAGSLVDSQQEARLEKLNSQLNDILRKLQYERKRGELLEKAMKLKGSEPKLIGELNLDELRKMKGELEELQEKLRGRVTEMEASSSLLLLSKKPTREKHQ

SEQ ID NO: 3630 - protein, 99 aa, Arabidopsis thaliana
  misc_feature (1)..(99): Ceres CDNA ID no. 23497949
  misc_feature (1)..(99): Also Known As Ceres GEMINI ID 5109C2
  misc_feature (3)..(99): Pfam Name: GASA Pfam Description: Gibberellin regulated protein
  misc_feature 404390:<222: Transcription Factor
  misc_feature: Phenotype: Activates expression of the gene endogenous to the AtPES (SEQ ID NO 4142) regalutory region Useful for modulating Terpenoid Biosynthesis
MAIFRSTLVLLLILFCLTTFELHVHAAEDSQVGEGVVKIDCGGRCKGRCSKSSRPNLCLRACNSCCYRCNCVPPGTAGNHHLCPCYASITTRGGRLKCP

SEQ ID NO: 3631 - DNA, 312 bp, Populus balsamifera subsp. trichocarpa
  misc_feature (1)..(312): Ceres ANNOT ID no. 1452863
  misc_feature 404436:<222: Transcription Factor
  misc_feature: Phenotype: Activates expression of the gene endogenous to the AtPES (SEQ ID NO 4142) regalutory region Useful for modulating Terpenoid Biosynthesis
atggctatatcgaagcttttgattgtttttcttgtcgcatctctccttgtgctccgccttgttgaagctgatcagaaggtggtgaactcaaatattcaagctgctagctatcctcctgggaagaatatcgattgtggtggcgcttgcaatgctaggtgttccttatcctccaggccacgtctttgcaagagggcttgcgggacttgctgtgcacgatgcaagtgtgtccccccaggcacttccggcaaccattatacctgcccttgctatgccaccatgactactcgaggtggccgactcaagtgtccttga

SEQ ID NO: 3632 - protein, 103 aa, Populus balsamifera subsp. trichocarpa
  misc_feature (1)..(103): Ceres ANNOT ID no. 1452863
  misc_feature (3)..(103): Pfam Name: GASA Pfam Description: Gibberellin regulated protein
  misc_feature: SWISSPROT Homolog: GASA3_ARATH Gibberellin-regulated protein 3 precursor with e-value of 4.1e-54 and BLAST sequence identity of 100.0
  misc_feature: SWISSPROT Homolog: GASA2_ARATH Gibberellin-regulated protein 2 precursor with e-value of 7.5e-46 and BLAST sequence identity of 84.8
  misc_feature: SWISSPROT Homolog: GASA1_ARATH Gibberellin-regulated protein 1 precursor with e-value of 4.4e-25 and BLAST sequence identity of 55.0
  misc_feature: SWISSPROT Homolog: GASA4_ARATH Gibberellin-regulated protein 4 precursor with e-value of 5.9e-14 and BLAST sequence identity of 36.0
  misc_feature: SWISSPROT Homolog: RSI1_LYCES RSI-1 protein precursor (TR132) with e-value of 3.3e-13 and BLAST sequence identity of 39.0
  misc_feature 404515:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(103): Functional Homolog of  Ceres CDNA ID no. 23497949 at SEQ ID NO. 3677 with e-value of 6.99E-26 and BLAST sequence identity of 75.4
MAISKLLIVFLVASLLVLRLVEADQKVVNSNIQAASYPPGKNIDCGGACNARCSLSSRPRLCKRACGTCCARCKCVPPGTSGNHYTCPCYATMTTRGGRLKCP

SEQ ID NO: 3633 - DNA, 306 bp, Populus balsamifera subsp. trichocarpa
  misc_feature (1)..(306): Ceres ANNOT ID no. 1442568
  misc_feature 404569:<222: Transcription Factor
  misc_feature: Phenotype: Activates expression of the gene endogenous to the AtPES (SEQ ID NO 4142) regalutory region Useful for modulating Terpenoid Biosynthesis
atggctatttcaaagcttttgattgcttccctgctcgtatctcttcttgtgctccatcttgccgaagctgatcagaaggtgaactcaaatcaagctgcaagccatgttcctggaaacaatatcgactgtggtggcgcttgccatgctaggtgttcgttgtcctctaggcctcgtctttgcaagagggcttgcgggtcatgctgtgcccgatgcaaatgtgtccctcaaggcacttccggcaacctggatacctgcccttgctatgccaccttgactactcgtggaggcagacgcaagtgtccttga

SEQ ID NO: 3634 - protein, 101 aa, Populus balsamifera subsp. trichocarpa
  misc_feature (1)..(101): Ceres ANNOT ID no. 1442568
  misc_feature (3)..(101): Pfam Name: GASA Pfam Description: Gibberellin regulated protein
  misc_feature: SWISSPROT Homolog: GASA3_ARATH Gibberellin-regulated protein 3 precursor with e-value of 4.1e-54 and BLAST sequence identity of 100.0
  misc_feature: SWISSPROT Homolog: GASA2_ARATH Gibberellin-regulated protein 2 precursor with e-value of 7.5e-46 and BLAST sequence identity of 84.8
  misc_feature: SWISSPROT Homolog: GASA1_ARATH Gibberellin-regulated protein 1 precursor with e-value of 4.4e-25 and BLAST sequence identity of 55.0
  misc_feature: SWISSPROT Homolog: GASA4_ARATH Gibberellin-regulated protein 4 precursor with e-value of 5.9e-14 and BLAST sequence identity of 36.0
  misc_feature: SWISSPROT Homolog: RSI1_LYCES RSI-1 protein precursor (TR132) with e-value of 3.3e-13 and BLAST sequence identity of 39.0
  misc_feature 404648:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(101): Functional Homolog of  Ceres CDNA ID no. 23497949 at SEQ ID NO. 3677 with e-value of 5.59E-24 and BLAST sequence identity of 55.7
MAISKLLIASLLVSLLVLHLAEADQKVNSNQAASHVPGNNIDCGGACHARCSLSSRPRLCKRACGSCCARCKCVPQGTSGNLDTCPCYATLTTRGGRRKCP

SEQ ID NO: 3635 - DNA, 276 bp, Populus balsamifera subsp. trichocarpa
  misc_feature (1)..(276): Ceres ANNOT ID no. 1486734
  misc_feature 404702:<222: Transcription Factor
  misc_feature: Phenotype: Activates expression of the gene endogenous to the AtPES (SEQ ID NO 4142) regalutory region Useful for modulating Terpenoid Biosynthesis
atggtcagtgccaagacaacatttatcttggcaatactttgcctggccctaatgcatgagcttcagatccgtactgttgaagctgggaaaataaattgcaagtccaagtgtgaatacaggtgcagcaaggcatcgaggcacaaaatgtgcataagggcttgcaacacatgctgtcagaggtgcaattgcgttccacctggaacttctggtaacgaagatacctgcccttgctatgccaacatgaccacccatgggggtagacacaagtgcccctga

SEQ ID NO: 3636 - protein, 91 aa, Populus balsamifera subsp. trichocarpa
  misc_feature (1)..(91): Ceres ANNOT ID no. 1486734
  misc_feature (2)..(91): Pfam Name: GASA Pfam Description: Gibberellin regulated protein
  misc_feature: SWISSPROT Homolog: GASA3_ARATH Gibberellin-regulated protein 3 precursor with e-value of 4.1e-54 and BLAST sequence identity of 100.0
  misc_feature: SWISSPROT Homolog: GASA2_ARATH Gibberellin-regulated protein 2 precursor with e-value of 7.5e-46 and BLAST sequence identity of 84.8
  misc_feature: SWISSPROT Homolog: GASA1_ARATH Gibberellin-regulated protein 1 precursor with e-value of 4.4e-25 and BLAST sequence identity of 55.0
  misc_feature: SWISSPROT Homolog: GASA4_ARATH Gibberellin-regulated protein 4 precursor with e-value of 5.9e-14 and BLAST sequence identity of 36.0
  misc_feature: SWISSPROT Homolog: RSI1_LYCES RSI-1 protein precursor (TR132) with e-value of 3.3e-13 and BLAST sequence identity of 39.0
  misc_feature 404779:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(91): Functional Homolog of  Ceres CDNA ID no. 23497949 at SEQ ID NO. 3677 with e-value of 9.20E-24 and BLAST sequence identity of 53.8
MVSAKTTFILAILCLALMHELQIRTVEAGKINCKSKCEYRCSKASRHKMCIRACNTCCQRCNCVPPGTSGNEDTCPCYANMTTHGGRHKCP

SEQ ID NO: 3637 - DNA, 282 bp, Populus balsamifera subsp. trichocarpa
  misc_feature (1)..(282): Ceres ANNOT ID no. 1468322
  misc_feature 404830:<222: Transcription Factor
  misc_feature: Phenotype: Activates expression of the gene endogenous to the AtPES (SEQ ID NO 4142) regalutory region Useful for modulating Terpenoid Biosynthesis
atggcagtacgttcgcttcttgctatgatggttttgcttttctgccttgctgagcttgttgtgagaggtggaaacaggaggctcatgcaagacatagattgtggagggttatgcaagcagagatgcagtcttcactcaaggcctaatctgtgcaacagggcatgtggcacctgctgtgtgagatgcaagtgcgtgcctcctgggacctcagggaacagagaagtgtgtgggacatgctatactgacatgaccacccatgggaacaagaccaagtgcccatag

SEQ ID NO: 3638 - protein, 93 aa, Populus balsamifera subsp. trichocarpa
  misc_feature (1)..(93): Ceres ANNOT ID no. 1468322
  misc_feature (1)..(93): Pfam Name: GASA Pfam Description: Gibberellin regulated protein
  misc_feature: SWISSPROT Homolog: GASA3_ARATH Gibberellin-regulated protein 3 precursor with e-value of 4.1e-54 and BLAST sequence identity of 100.0
  misc_feature: SWISSPROT Homolog: GASA2_ARATH Gibberellin-regulated protein 2 precursor with e-value of 7.5e-46 and BLAST sequence identity of 84.8
  misc_feature: SWISSPROT Homolog: GASA1_ARATH Gibberellin-regulated protein 1 precursor with e-value of 4.4e-25 and BLAST sequence identity of 55.0
  misc_feature: SWISSPROT Homolog: GASA4_ARATH Gibberellin-regulated protein 4 precursor with e-value of 5.9e-14 and BLAST sequence identity of 36.0
  misc_feature: SWISSPROT Homolog: RSI1_LYCES RSI-1 protein precursor (TR132) with e-value of 3.3e-13 and BLAST sequence identity of 39.0
  misc_feature 404907:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(93): Functional Homolog of  Ceres CDNA ID no. 23497949 at SEQ ID NO. 3677 with e-value of 1.19E-23 and BLAST sequence identity of 56.5
MAVRSLLAMMVLLFCLAELVVRGGNRRLMQDIDCGGLCKQRCSLHSRPNLCNRACGTCCVRCKCVPPGTSGNREVCGTCYTDMTTHGNKTKCP

SEQ ID NO: 3639 - DNA, 282 bp, Populus balsamifera subsp. trichocarpa
  misc_feature (1)..(282): Ceres ANNOT ID no. 1473531
  misc_feature 404958:<222: Transcription Factor
  misc_feature: Phenotype: Activates expression of the gene endogenous to the AtPES (SEQ ID NO 4142) regalutory region Useful for modulating Terpenoid Biosynthesis
atggcagtgcgttcgcttcttgctttgatggtttttgttttctgccttgcagagcttgttgtgagaggtggaaacaggaggctcatgcaagacatagactgtggagggttatgcaagcagaggtgcagtcttcactcaaggcctaatgtgtgcaccagggcatgtggcacctgctgtgtaaggtgcaagtgtgtgccgcctgggacctcagggaacagagaagtatgtggaacatgctatactgacatgaccacccatgggaacaagaccaagtgtccatag

SEQ ID NO: 3640 - protein, 93 aa, Populus balsamifera subsp. trichocarpa
  misc_feature (1)..(93): Ceres ANNOT ID no. 1473531
  misc_feature (1)..(93): Pfam Name: GASA Pfam Description: Gibberellin regulated protein
  misc_feature: SWISSPROT Homolog: GASA3_ARATH Gibberellin-regulated protein 3 precursor with e-value of 4.1e-54 and BLAST sequence identity of 100.0
  misc_feature: SWISSPROT Homolog: GASA2_ARATH Gibberellin-regulated protein 2 precursor with e-value of 7.5e-46 and BLAST sequence identity of 84.8
  misc_feature: SWISSPROT Homolog: GASA1_ARATH Gibberellin-regulated protein 1 precursor with e-value of 4.4e-25 and BLAST sequence identity of 55.0
  misc_feature: SWISSPROT Homolog: GASA4_ARATH Gibberellin-regulated protein 4 precursor with e-value of 5.9e-14 and BLAST sequence identity of 36.0
  misc_feature: SWISSPROT Homolog: RSI1_LYCES RSI-1 protein precursor (TR132) with e-value of 3.3e-13 and BLAST sequence identity of 39.0
  misc_feature 405035:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(93): Functional Homolog of  Ceres CDNA ID no. 23497949 at SEQ ID NO. 3677 with e-value of 3.09E-23 and BLAST sequence identity of 55.4
MAVRSLLALMVFVFCLAELVVRGGNRRLMQDIDCGGLCKQRCSLHSRPNVCTRACGTCCVRCKCVPPGTSGNREVCGTCYTDMTTHGNKTKCP

SEQ ID NO: 3641 - protein, 442 aa, Arabidopsis thaliana
  misc_feature (1)..(442): Ceres CDNA ID no. 23498145
  misc_feature (3)..(438): Pfam Name: p450 Pfam Description: Cytochrome P450
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
MKPTDDLISLVMPYSFHMLNTYGKTFFTWSGPIPAITIMNPQLIKEVYNKFYDFEKTHTFPLTSLLTDGLANADGDKWVKHRKIINPAFHFEKIKNMVPTFYKSCIEVMCEWEKLVSDKGSSCELDVWPWIVNMTGDVISRTAFGSSYKEGQRIFILQAELAHLIILALGKNYIPAYRHFPTKNNRRMKTIVKEIQVILRGIISHREKARDAGEAPSDDLLGILLKSNSEQSKGNGLNMEEIMEECKLFYFAGQETTSVLLAWTMVLLSQHQDWQARAREEVMQVFGHNKPDLQGINQLKVMTMIIYEVLRLYPPVIQMNRATHKEIKLGDMTLPGGIQVHMPVLLIHRDTKLWGDDAAEFKPERFKDGIAKATKNQVCFLPFGWGPRICIGQNFALLEAKMALALILQRFSFELSPSYVHSPYRVFTIHPQCGAHLILHKL

SEQ ID NO: 3642 - DNA, 1557 bp, Populus balsamifera subsp. trichocarpa
  misc_feature (1)..(1557): Ceres ANNOT ID no. 1482362
  misc_feature 405261:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgactgtaacagtcacttcaattctagtctccattgtttatgttgcagtgctaagatgggcatggagagttttgaactgggtttggtttcggccgaagaaggtcgagaggtgcttgagacaacaaggttttgcaggcaagccttacaggcttttgttcggagactggaaagaaagttcagatatgttgaaagaagcaaggaccaaacccattggtttatcagacgctcttctacctcgtgtcatgcccttcctccatcaactggtcaaggattatggtaagaattcatttatgtgggttgggccgaaaccaagagtgaacatcatgaaccctgatcagataagggacgtattcatgaagataaatgaatatcagaaggcctctcacccgctgttgaaacttatagtatgtggacttgcaagtcacgagggtgaaaaatgggctaaacatagaaagataatcaacccagcattccatcaagagaagctaaagcttatgatacctgcgttttccgaaagttgtagcgggatgattaacaagtgggagaagctggtctctgtagacgagggctcatgtgaattggatgtctggcctgatcttcaaggcttaacatgtgatgctatttctcgaacgtcgtttggaagtaattacgaagaaggaaaaagaatatttgatctcctcaaggaacttaccgatcttacagctcatgttataataaaagctattgtcataccagggtacaggtttctgccgatcccatctaatagaaggctaaaagctattgacaaagaaataaaagcttctcttaatgctctcatcaacaaaagagagaaagcaatgagtgctggtgaagatgcaaagaaagacttgttgggtttacttctggaatccaattttagagaaatacaagagcatggaaataccaagagcgtcggaatgagcattgaagatgtgattgatgaatgtaaaatattctactttgctggacaagaaacaaccttagttcttcttacctggaccatggttttattggctcagtatccgaattggcaagcacgcgcaagagaagaggttgtgcaagtctttggtaacaaaaaaccagatttcgatgggctaaatcaccttaaagttgttaccatgattttgtatgaagttcttaggttatacccgccggtaattatgcttaatcgagatgttcatgaagaaataaagcttggaaatttgctattacctgccggagtgcaggtctcgttgccaataatcctccttcaccaagatcatgaactatggggtgatgatgcctctgagttcaaaccagagaggtttgctgaaggtatttcaaaggcaacaaagagtcaggtctcattccttccatttggatggggtcctcgaatatgcgttggacaaaactttgctttgattgaagcaaaaatggctttggcaatggttttacagcgctactcttttgagctctctccgtcgtatattcatgctcctcgcacagtcataactcttcagccacagcacggtgctccaatgatattacgtaaactctaa

SEQ ID NO: 3643 - protein, 457 aa, Populus balsamifera subsp. trichocarpa
  misc_feature (1)..(457): Ceres ANNOT ID no. 1482362
  misc_feature (23)..(432): Pfam Name: p450 Pfam Description: Cytochrome P450
  misc_feature: SWISSPROT Homolog: C72A1_CATRO Cytochrome P450 72A1 (EC 1.3.3.9) (CYPLXXII) Secologanin synthase (SLS) with e-value of 3.6e-126 and BLAST sequence identity of 51.3
  misc_feature: SWISSPROT Homolog: CP4F8_HUMAN Cytochrome P450 4F8 (EC 1.14.14.1) (CYPIVF8) with e-value of 1.4e-44 and BLAST sequence identity of 31.2
  misc_feature: SWISSPROT Homolog: CP4FE_MOUSE Cytochrome P450 4F14 with e-value of 2.1e-43 and BLAST sequence identity of 31.8
  misc_feature: SWISSPROT Homolog: CP4FE_MOUSE EC 1.14.13.30 (Leukotriene-B4 omega-hydroxylase) Leukotriene-B4 20-monooxygenase Cytochrome P450-LTB-omega (Cyp4f-14)
  misc_feature: SWISSPROT Homolog: CP4FC_HUMAN Cytochrome P450 4F12 (EC 1.14.14.1) (CYPIVF12) with e-value of 2.6e-43 and BLAST sequence identity of 30.1
  misc_feature: SWISSPROT Homolog: CP4F6_RAT Cytochrome P450 4F6 (EC 1.14.14.1) (CYPIVF6) with e-value of 7.0e-43 and BLAST sequence identity of 29.6
  misc_feature 405455:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(457): Functional Homolog of  Ceres CDNA ID no. 23498145 at SEQ ID NO. 3688 with e-value of 1.00E-141 and BLAST sequence identity of 61.0
MLKEARTKPIGLSDALLPRVMPFLHQLVKDYGKNSFMWVGPKPRVNIMNPDQIRDVFMKINEYQKASHPLLKLIVCGLASHEGEKWAKHRKIINPAFHQEKLKLMIPAFSESCSGMINKWEKLVSVDEGSCELDVWPDLQGLTCDAISRTSFGSNYEEGKRIFDLLKELTDLTAHVIIKAIVIPGYRFLPIPSNRRLKAIDKEIKASLNALINKREKAMSAGEDAKKDLLGLLLESNFREIQEHGNTKSVGMSIEDVIDECKIFYFAGQETTLVLLTWTMVLLAQYPNWQARAREEVVQVFGNKKPDFDGLNHLKVVTMILYEVLRLYPPVIMLNRDVHEEIKLGNLLLPAGVQVSLPIILLHQDHELWGDDASEFKPERFAEGISKATKSQVSFLPFGWGPRICVGQNFALIEAKMALAMVLQRYSFELSPSYIHAPRTVITLQPQHGAPMILRKL

SEQ ID NO: 3644 - DNA, 1557 bp, Populus balsamifera subsp. trichocarpa
  misc_feature (1)..(1557): Ceres ANNOT ID no. 1489077
  misc_feature 405638:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
atgactgtgacagtcacttcaattctagtctccattgtttatgttgcagtgctaagatgggcatggagggttttgaactgggtttggtttcggccgaagaaggtcgagaggtgcttgagacaacaaggttttgcaggcaagccttacaggcttttgtttggagactggaaagaaaattcagatatgttgaaggaagcaaggaccaaacccattggtttatcagacgctcttctacctcgtgtcatgcccttcctccatcaactggtcaaggattatggtaagaattcatttatgtggattgggccgaaaccaagagtgaacatcatgaaccctgatcagataagggacgtattcatgaagataaatgaatatcagaagccctcgcacccgctgttgaaacctctagcatgtggacttgcaagtcacgagggtgaaaaatgggctaaacatagaaagataatcaacccagcattccatcaagagaagctaaagcttatgattcctgcgttttacgaaagttgtagtgggatgattaacaagtgggagaagctggtctctgtagacgagggttcatgtgaattggatgtctggcctgatcttcaaggcttaacatgtgatgctatttctcgaacgtcgtttggaagtaattacgaagaaggaaaaagaatatttgatctcctcaaggaacttaccgatcttacagttcatgttataataaaagcatttgtcataccagggtacaggtttctgccgatcccaactaatagaaggctaaaagctattgacaaagaaataaaagcttctcttaatgctctcatcaacaaaagagagaaagcaatgagtgctggtgaagatgcaaagaatgacttgttgggtttacttctggaatccaattttagagaaatacaagagcatggaaataccaagagcgtccgaatgagcattgaagatgtgattgacgaatgtaaaatattctactttgctggacaagaaacaacctcagttcttcttacctggaccatggttttattggctcagtatccgaattggcaagcacgcgcaagagaagaggttgtgcaagtctttggtaacaaaaaaccagatttcgatgggctaaatcaccttaaagttgttaccatgattttgtatgaagttcttaggttatacccgccagtaattatgcttaatcgagatgttcatgaagaaataaagcttggaaatttgctattacctgccggagtgcagatctcgttgccaacaatcctccttcaccaagatcatgaactatggggtgatgatgcctctgagttcaaaccagagaggtttgctgaaggtgtttcaaaggcaacaaagagtcaagtctcattccttccatttggatggggtcctcgaatatgcgttggacaaaactttgctttgattgaagcaaaaatggctttggcaatggttttacagcgctactcttttgagctctctccgtcgtatattcatgctcctcgcacagtcataactcttcagccacagcacggtgctccaatgatattacgtaaactctaa

SEQ ID NO: 3645 - protein, 518 aa, Populus balsamifera subsp. trichocarpa
  misc_feature (1)..(518): Ceres ANNOT ID no. 1489077
  misc_feature (84)..(493): Pfam Name: p450 Pfam Description: Cytochrome P450
  misc_feature: SWISSPROT Homolog: C72A1_CATRO Cytochrome P450 72A1 (EC 1.3.3.9) (CYPLXXII) Secologanin synthase (SLS) with e-value of 3.6e-126 and BLAST sequence identity of 51.3
  misc_feature: SWISSPROT Homolog: CP4F8_HUMAN Cytochrome P450 4F8 (EC 1.14.14.1) (CYPIVF8) with e-value of 1.4e-44 and BLAST sequence identity of 31.2
  misc_feature: SWISSPROT Homolog: CP4FE_MOUSE Cytochrome P450 4F14 with e-value of 2.1e-43 and BLAST sequence identity of 31.8
  misc_feature: SWISSPROT Homolog: CP4FE_MOUSE EC 1.14.13.30 (Leukotriene-B4 omega-hydroxylase) Leukotriene-B4 20-monooxygenase Cytochrome P450-LTB-omega (Cyp4f-14)
  misc_feature: SWISSPROT Homolog: CP4FC_HUMAN Cytochrome P450 4F12 (EC 1.14.14.1) (CYPIVF12) with e-value of 2.6e-43 and BLAST sequence identity of 30.1
  misc_feature: SWISSPROT Homolog: CP4F6_RAT Cytochrome P450 4F6 (EC 1.14.14.1) (CYPIVF6) with e-value of 7.0e-43 and BLAST sequence identity of 29.6
  misc_feature 405832:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Short Petioles Useful for modulating plant size
  misc_feature: Phenotype: SILIQUES - Other Useful for increasing seed/fruit yield or modifying fruit content
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Serrate Margins Useful for making plants with increased biomass and foliage
  misc_feature (1)..(518): Functional Homolog of  Ceres CDNA ID no. 23498145 at SEQ ID NO. 3688 with e-value of 1.70E-141 and BLAST sequence identity of 59.7
MTVTVTSILVSIVYVAVLRWAWRVLNWVWFRPKKVERCLRQQGFAGKPYRLLFGDWKENSDMLKEARTKPIGLSDALLPRVMPFLHQLVKDYGKNSFMWIGPKPRVNIMNPDQIRDVFMKINEYQKPSHPLLKPLACGLASHEGEKWAKHRKIINPAFHQEKLKLMIPAFYESCSGMINKWEKLVSVDEGSCELDVWPDLQGLTCDAISRTSFGSNYEEGKRIFDLLKELTDLTVHVIIKAFVIPGYRFLPIPTNRRLKAIDKEIKASLNALINKREKAMSAGEDAKNDLLGLLLESNFREIQEHGNTKSVRMSIEDVIDECKIFYFAGQETTSVLLTWTMVLLAQYPNWQARAREEVVQVFGNKKPDFDGLNHLKVVTMILYEVLRLYPPVIMLNRDVHEEIKLGNLLLPAGVQISLPTILLHQDHELWGDDASEFKPERFAEGVSKATKSQVSFLPFGWGPRICVGQNFALIEAKMALAMVLQRYSFELSPSYIHAPRTVITLQPQHGAPMILRKL

SEQ ID NO: 3646 - protein, 261 aa, Arabidopsis thaliana
  misc_feature (1)..(261): Ceres CDNA ID no. 23498294
  misc_feature (1)..(261): Also Known As Ceres GEMINI ID 5109F2
  misc_feature (152)..(169): Pfam Name: zf-CCHC Pfam Description: Zinc knuckle
  misc_feature (59)..(130): Pfam Name: RRM_1 Pfam Description: RNA recognition motif. (a.k.a. RRM RBD, or RNP domain)
  misc_feature 406048:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
MKKRKIHHSDDEEDDTFYYRYSSVAAPPPSNPKHQPSSSAKSSAPGGGSGGLAPSKSTLYVSNLDFSLTNSDIHTLFSTFGKVARVTVLKDRHTRQSRGVAFVLYVSREDAAKAARSMDAKILNGRKLTVSIAADNGRASEFIKKRVYKDKSRCYECGDEGHLSYECPKNQLGPRERPPPPKKRGRRKEEEGEAEEISWSAAAPSLAVAEEEFEEENWASVVDNEAGERLRKREAEEEEERRMKRKEKKVSYFSDESDDED

SEQ ID NO: 3647 - DNA, 741 bp, Populus balsamifera subsp. trichocarpa
  misc_feature (1)..(741): Ceres ANNOT ID no. 1465158
  misc_feature 406125:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atggggaagaagcaaaaacacaacagtgacagtgacgaagacgaaatattttaccaccgctactcctccgccaccacatcatcacaacacccaccttcctccaccaaaccccacggcggatccggcggtttagcaccatcaaaatcaaccctgtacgtatccaatttggacttctcccttacaaactcagacctccacacactcttctccaccttcggcaaagtagcacgtgtaactgtcttaaaagaccgaacaacacggaaatctcgcggtgtcgcattcatccaattcgtatctcgcagcgacgcggtcaccgccgttgaacagatggacaagaagattctcaatgggagaactctgtcggcgtcgattgcggcagataatggtagagcggcggagtttattaagaagagggtttataaggataagagtaagtgttatgagtgtggagaagatggacatttgagttatgagtgtccgaggaatcgattggggattagagagaggcctgtggtgaagagagggaggggaggcggtggtggaggaggtggcggcggcggaaggggcgggggagattgggaggaggaggaagaagagggtgagtttgaggaggagaagtgggctgcggcggtggatggaggggtggaggagaggttgttgaaggggggagaggtggagaaaaagaaggtgaaggttaagaaagctagttacttcagtgatgagagtgatgaagaggagtga

SEQ ID NO: 3648 - protein, 246 aa, Populus balsamifera subsp. trichocarpa
  misc_feature (1)..(246): Ceres ANNOT ID no. 1465158
  misc_feature (144)..(161): Pfam Name: zf-CCHC Pfam Description: Zinc knuckle
  misc_feature (51)..(122): Pfam Name: RRM_1 Pfam Description: RNA recognition motif. (a.k.a. RRM RBD, or RNP domain)
  misc_feature: SWISSPROT Homolog: RSP4_CAEEL Probable splicing factor, arginine/serine-rich 4 (RNA-binding protein srp-2) (CeSC35) with e-value of 1.4e-14 and BLAST sequence identity of 34.0
  misc_feature: SWISSPROT Homolog: ROC1_NICPL 30 kDa ribonucleoprotein, chloroplast precursor (CP-RBP30) with e-value of 3.5e-12 and BLAST sequence identity of 40.5
  misc_feature: SWISSPROT Homolog: SFRS7_HUMAN Splicing factor, arginine/serine-rich 7 (Splicing factor 9G8) with e-value of 4.0e-12 and BLAST sequence identity of 29.7
  misc_feature: SWISSPROT Homolog: RBM3_MOUSE Putative RNA-binding protein 3 (RNA-binding motif protein 3) with e-value of 4.7e-12 and BLAST sequence identity of 31.0
  misc_feature: SWISSPROT Homolog: SFRS7_MOUSE Splicing factor, arginine/serine-rich 7 with e-value of 5.0e-12 and BLAST sequence identity of 30.2
  misc_feature 406229:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(246): Functional Homolog of  Ceres CDNA ID no. 23498294 at SEQ ID NO. 3693 with e-value of 5.40E-74 and BLAST sequence identity of 65.9
MGKKQKHNSDSDEDEIFYHRYSSATTSSQHPPSSTKPHGGSGGLAPSKSTLYVSNLDFSLTNSDLHTLFSTFGKVARVTVLKDRTTRKSRGVAFIQFVSRSDAVTAVEQMDKKILNGRTLSASIAADNGRAAEFIKKRVYKDKSKCYECGEDGHLSYECPRNRLGIRERPVVKRGRGGGGGGGGGGGRGGGDWEEEEEEGEFEEEKWAAAVDGGVEERLLKGGEVEKKKVKVKKASYFSDESDEEE

SEQ ID NO: 3649 - protein, 172 aa, Arabidopsis thaliana; identical to SEQ ID NO: 3541
  misc_feature (1)..(172): Ceres CDNA ID no. 23498685
  misc_feature (1)..(172): Also Known As Ceres GEMINI ID 5109H3
  misc_feature (2)..(47): Pfam Name: zf-B_box Pfam Description: B-box zinc finger
  misc_feature 406325:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis

SEQ ID NO: 3650 - DNA, 666 bp, Populus balsamifera subsp. trichocarpa; identical to SEQ ID NO: 3544
  misc_feature (1)..(666): Ceres ANNOT ID no. 1460742
  misc_feature 406391:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis

SEQ ID NO: 3651 - protein, 221 aa, Populus balsamifera subsp. trichocarpa; identical to SEQ ID NO: 3545
  misc_feature (1)..(221): Ceres ANNOT ID no. 1460742
  misc_feature (53)..(96): Pfam Name: zf-B_box Pfam Description: B-box zinc finger
  misc_feature: SWISSPROT Homolog: STHY_ARATH Putative salt tolerance-like protein At1g78600 with e-value of 6.5e-24 and BLAST sequence identity of 51.5
  misc_feature: SWISSPROT Homolog: STHX_ARATH Putative salt tolerance-like protein At1g75540 with e-value of 3.2e-22 and BLAST sequence identity of 48.0
  misc_feature: SWISSPROT Homolog: STO_ARATH Salt-tolerance protein with e-value of 5.3e-22 and BLAST sequence identity of 38.9
  misc_feature: SWISSPROT Homolog: STH_ARATH Salt tolerance-like protein with e-value of 1.6e-20 and BLAST sequence identity of 47.1
  misc_feature: SWISSPROT Homolog: COL1_ARATH Zinc finger protein CONSTANS-LIKE 1 with e-value of 1.2e-18 and BLAST sequence identity of 42.7
  misc_feature 406489:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature (1)..(221): Functional Homolog of  Ceres CDNA ID no. 23498685 at SEQ ID NO. 3696 with e-value of 1.29E-54 and BLAST sequence identity of 73.4

SEQ ID NO: 3652 - protein, 304 aa, Arabidopsis thaliana
  misc_feature (1)..(304): Ceres CDNA ID no. 23499964
  misc_feature (1)..(304): Also Known As Ceres GEMINI ID 5110D4
  misc_feature (123)..(172): Pfam Name: HLH Pfam Description: Helix-loop-helix DNA-binding domain
  misc_feature 406586:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MNSLVGDVPQSLSSLDDTTTCYNLDASCNKSLVEERPSKILKTTHISPNLHPFSSSNPPPPKHQPSSRILSFEKTGLHVMNHNSPNLIFSPKDEEIGLPEHKKAELIIRGTKRAQSLTRSQSNAQDHILAERKRREKLTQRFVALSALIPGLKKMDKASVLGDAIKHIKYLQESVKEYEEQKKEKTMESVVLVKKSSLVLDENHQPSSSSSSDGNRNSSSSNLPEIEVRVSGKDVLIKILCEKQKGNVIKIMGEIEKLGLSITNSNVLPFGPTFDISIIAQNNNFDMKIEDVVKNLSFGLSKLT

SEQ ID NO: 3653 - DNA, 954 bp, Populus balsamifera subsp. trichocarpa
  misc_feature (1)..(954): Ceres ANNOT ID no. 1441358
  misc_feature 406672:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggaggattcaagcttcaccaaccagtggttcatgaactctcttgatgataccagcttactaccatttgctgctgcatttggagagaacatacatcactctttctctcaccaaaacttcaacctcaaaacctccatggatagtgttagaccaacaaaacaactgagaactgatcatttgtcaaacccacaacctgccttttctcctaacattctttcctttgtcaattccaaccacgcaaatcaaatgggattgatgaagcctaaagaggaggcagtgtgttctaagagcatcaacaatctcccttctgacatggtagtttctcaagattcctttgggaaccaatactatgcattcaaggcctcccaaggacctaagatgattagcgcgaacggtactagactttctcaaagtcaagatcacattatagcagaaaggaagcggcgggagaagctcagtcaacgattcatagctttatctgctgtagttcctggactaaaaaagatggataaagcttctgttctaggagatgctatcaagtacttgaaacaattgcaagagagagttaagacacttgaggaacaaacaaaaaggaaaaccatggaatcagtggttattgtgaagaaatctcatgtctatgttgatgagggtggtgaaaactcttcctcagatgtgtctaaaggacctattcatgagacattgccagaacttgaagcaagattctgcgacaaacatgtcctcataagaattcactgcaagaaaaacaaaggagttttggagaaaacagtggctgaagttgagaaactccacctatcagttatcaatagcagtgtccttacatttgggacttgtgctcttgatgttactattattgcacagatggatatagacttcaacatgtcagtgaaggatctagtgaagactttacactcagctttccagtatttcatgtga

SEQ ID NO: 3654 - protein, 306 aa, Populus balsamifera subsp. trichocarpa
  misc_feature (1)..(306): Ceres ANNOT ID no. 1441358
  misc_feature (126)..(175): Pfam Name: HLH Pfam Description: Helix-loop-helix DNA-binding domain
  misc_feature: SWISSPROT Homolog: RAP1_ARATH Transcription factor AtMYC2 (R-homologous Arabidopsis protein 1) with e-value of 1.3e-18 and BLAST sequence identity of 30.5
  misc_feature: SWISSPROT Homolog: RAP1_ARATH RAP-1 (Basic helix-loop-helix protein 6) bHLH6 (AtbHLH006) (rd22BP1)
  misc_feature: SWISSPROT Homolog: EGL1_ARATH Transcription factor EGL1 (ENHANCER OF GLABRA3) (Basic helix-loop-helix protein 2) (bHLH2) (AtbHLH002) (AtMyc-146) with e-value of 2.8e-13 and BLAST sequence identity of 30.7
  misc_feature: SWISSPROT Homolog: TT8_ARATH TRANSPARENT TESTA 8 protein (Basic helix-loop-helix protein 42) (bHLH42) (AtbHLH042) with e-value of 2.8e-11 and BLAST sequence identity of 44.1
  misc_feature: SWISSPROT Homolog: ICE1_ARATH Transcription factor ICE1 (Inducer of CBF expression 1) (Basic helix-loop-helix protein 116) (bHLH116) (AtbHLH116) with e-value of 9.2e-10 and BLAST sequence identity of 26.4
  misc_feature: SWISSPROT Homolog: ARLC_MAIZE Anthocyanin regulatory Lc protein with e-value of 1.7e-09 and BLAST sequence identity of 27.4
  misc_feature 406782:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(306): Functional Homolog of  Ceres CDNA ID no. 23499964 at SEQ ID NO. 3699 with e-value of 1.69E-47 and BLAST sequence identity of 49.2
MNSLDDTSLLPFAAAFGENIHHSFSHQNFNLKTSMDSVRPTKQLRTDHLSNPQPAFSPNILSFVNSNHANQMGLMKPKEEAVCSKSINNLPSDMVVSQDSFGNQYYAFKASQGPKMISANGTRLSQSQDHIIAERKRREKLSQRFIALSAVVPGLKKMDKASVLGDAIKYLKQLQERVKTLEEQTKRKTMESVVIVKKSHVYVDEGGENSSSDVSKGPIHETLPELEARFCDKHVLIRIHCKKNKGVLEKTVAEVEKLHLSVINSSVLTFGTCALDVTIIAQMDIDFNMSVKDLVKTLHSAFQYFM

SEQ ID NO: 3655 - DNA, 1053 bp, Populus balsamifera subsp. trichocarpa
  misc_feature (1)..(1053): Ceres ANNOT ID no. 1457434
  misc_feature 406876:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggatatagcagcagggaaatggcttagtgagatgggcatggatgattacaaattcatccatcaatgcaatatcaactctcttgccgagttcaccgcacaaaacatggcaactactctactgggagaaaacctccaacgatctttctcttccgagagtttctcctcgaaacccagtttaatgatgaccagaaacaccacgatcaccagtacttcaaatggttcctcctctgaaacgtctcagaccagcattgaaacacctggaaaacagcagagaactaacagctggaactctagcatctccaccctgcaccaatcgccaaaaccaccttctcctattcctgaaagtttttctttcaacaactcagctccaccacctacggccagttcccagcagttttacggaaatcttggccgcttgatcaagtctaaggatgaggctgcatctccaataaacatgcactttcaaacttcaatttcaaaagctgcttgtgagagatcagaaagttatgccccagaggctaagcaagggatcaagaggccttactcaatgactagaagtgctatgcatgttcaagatcacataatggctgagagaaagcgcagagaaaagcttagccagcagttcatagctctttcagcccttgttccaggtcttaaaaagatggacaaggcttctgtccttgatggcgctatgaagtacatgaaacaactccaagaacaactgaaacaactccaggatcagaccaagacaaaaaccatggaatccgtggttctgctgaagaagtctaagctctctgttgatgatgaatgtacttcatctgatgagaactttgatggcctccctggctcaccgctcccagaaattgaagcaagaacaactgataaggatgtactgattcggatccattgcaagaaccagcaaggagttgggattaaaatactaagcgagatagagaatcttcatctatcagtagtcaatagcagtgtattggtatttgggaattccactcttgacgtaacagtaattgcccagattattttaatgcgttaa

SEQ ID NO: 3656 - protein, 337 aa, Populus balsamifera subsp. trichocarpa
  misc_feature (1)..(337): Ceres ANNOT ID no. 1457434
  misc_feature (177)..(226): Pfam Name: HLH Pfam Description: Helix-loop-helix DNA-binding domain
  misc_feature: SWISSPROT Homolog: RAP1_ARATH Transcription factor AtMYC2 (R-homologous Arabidopsis protein 1) with e-value of 1.3e-18 and BLAST sequence identity of 30.5
  misc_feature: SWISSPROT Homolog: RAP1_ARATH RAP-1 (Basic helix-loop-helix protein 6) bHLH6 (AtbHLH006) (rd22BP1)
  misc_feature: SWISSPROT Homolog: EGL1_ARATH Transcription factor EGL1 (ENHANCER OF GLABRA3) (Basic helix-loop-helix protein 2) (bHLH2) (AtbHLH002) (AtMyc-146) with e-value of 2.8e-13 and BLAST sequence identity of 30.7
  misc_feature: SWISSPROT Homolog: TT8_ARATH TRANSPARENT TESTA 8 protein (Basic helix-loop-helix protein 42) (bHLH42) (AtbHLH042) with e-value of 2.8e-11 and BLAST sequence identity of 44.1
  misc_feature: SWISSPROT Homolog: ICE1_ARATH Transcription factor ICE1 (Inducer of CBF expression 1) (Basic helix-loop-helix protein 116) (bHLH116) (AtbHLH116) with e-value of 9.2e-10 and BLAST sequence identity of 26.4
  misc_feature: SWISSPROT Homolog: ARLC_MAIZE Anthocyanin regulatory Lc protein with e-value of 1.7e-09 and BLAST sequence identity of 27.4
  misc_feature 406990:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(337): Functional Homolog of  Ceres CDNA ID no. 23499964 at SEQ ID NO. 3699 with e-value of 4.39E-47 and BLAST sequence identity of 50.2
MDDYKFIHQCNINSLAEFTAQNMATTLLGENLQRSFSSESFSSKPSLMMTRNTTITSTSNGSSSETSQTSIETPGKQQRTNSWNSSISTLHQSPKPPSPIPESFSFNNSAPPPTASSQQFYGNLGRLIKSKDEAASPINMHFQTSISKAACERSESYAPEAKQGIKRPYSMTRSAMHVQDHIMAERKRREKLSQQFIALSALVPGLKKMDKASVLDGAMKYMKQLQEQLKQLQDQTKTKTMESVVLLKKSKLSVDDECTSSDENFDGLPGSPLPEIEARTTDKDVLIRIHCKNQQGVGIKILSEIENLHLSVVNSSVLVFGNSTLDVTVIAQIILMR

SEQ ID NO: 3657 - DNA, 1053 bp, Populus balsamifera subsp. trichocarpa
  misc_feature (1)..(1053): Ceres ANNOT ID no. 1514509
  misc_feature 407090:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggaggatccaggcttcaccaaccagtggtacatgaactcccttgatgatatcagcttactaccattagctgctgctgcatttggagagaacgtacaccatcctttctctaaccagaatttcaacctcaaaacctccatggatagtactcctacaagcattaatgtcagaccaacaaaacaaatgaaaacttttcatttgtcagacccccaatctgccttttctcctaactttctttcatttgtcaatcccaaccacgcaaatcaaatgggattggtgaagcctaaagaggaggcagtatgttccaaaagcatcaataacttcccttctgacatggtagtttcccaagatatctttgggagccaaaactatgtaatcaagggttgccaaggacctgagaggattagcacaaacactcctagactttctcaaagtcaagatcacattattgcagaaaggaagcggcgagagaagcttagtcaacgattcatagctctatctgctgtagttcctggcctgaagaagatggacaaagcttctgttttaggagatgctatcaagtacttgaaacaactgcaagagaaagttaagacacttgaggaacaaacaaaaaggaaaaccatggaatcagtggtcattgtgaagaaatctcatatctatgtcgatgagggtgatgtcaacgcttcctcagacgagtccaaaggccctattcatgaaactttgccagaaattgaagcaagattctgtgacaaacatgtcctcataagaatccattgtgagaaaaggaaaggagttttggagaaaacagtggctgaaattgagaaactccacctatcagtaatcaatagcagtgttctcgcatttgggacatctgctcttcatgttacttttattgcacaggtaagttctgtcctcaaccagttctttcaaacatctagtttaacatgtgcattcaaacagtttcttccaagaaaaggcactagaaatgggcggtcctcgactttctcagaatgtatgttccatgggagaattcctaaatcagcgtcttgctaa

SEQ ID NO: 3658 - protein, 339 aa, Populus balsamifera subsp. trichocarpa
  misc_feature (1)..(339): Ceres ANNOT ID no. 1514509
  misc_feature (133)..(182): Pfam Name: HLH Pfam Description: Helix-loop-helix DNA-binding domain
  misc_feature: SWISSPROT Homolog: RAP1_ARATH Transcription factor AtMYC2 (R-homologous Arabidopsis protein 1) with e-value of 1.3e-18 and BLAST sequence identity of 30.5
  misc_feature: SWISSPROT Homolog: RAP1_ARATH RAP-1 (Basic helix-loop-helix protein 6) bHLH6 (AtbHLH006) (rd22BP1)
  misc_feature: SWISSPROT Homolog: EGL1_ARATH Transcription factor EGL1 (ENHANCER OF GLABRA3) (Basic helix-loop-helix protein 2) (bHLH2) (AtbHLH002) (AtMyc-146) with e-value of 2.8e-13 and BLAST sequence identity of 30.7
  misc_feature: SWISSPROT Homolog: TT8_ARATH TRANSPARENT TESTA 8 protein (Basic helix-loop-helix protein 42) (bHLH42) (AtbHLH042) with e-value of 2.8e-11 and BLAST sequence identity of 44.1
  misc_feature: SWISSPROT Homolog: ICE1_ARATH Transcription factor ICE1 (Inducer of CBF expression 1) (Basic helix-loop-helix protein 116) (bHLH116) (AtbHLH116) with e-value of 9.2e-10 and BLAST sequence identity of 26.4
  misc_feature: SWISSPROT Homolog: ARLC_MAIZE Anthocyanin regulatory Lc protein with e-value of 1.7e-09 and BLAST sequence identity of 27.4
  misc_feature 407204:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(339): Functional Homolog of  Ceres CDNA ID no. 23499964 at SEQ ID NO. 3699 with e-value of 1.09E-45 and BLAST sequence identity of 47.2
MNSLDDISLLPLAAAAFGENVHHPFSNQNFNLKTSMDSTPTSINVRPTKQMKTFHLSDPQSAFSPNFLSFVNPNHANQMGLVKPKEEAVCSKSINNFPSDMVVSQDIFGSQNYVIKGCQGPERISTNTPRLSQSQDHIIAERKRREKLSQRFIALSAVVPGLKKMDKASVLGDAIKYLKQLQEKVKTLEEQTKRKTMESVVIVKKSHIYVDEGDVNASSDESKGPIHETLPEIEARFCDKHVLIRIHCEKRKGVLEKTVAEIEKLHLSVINSSVLAFGTSALHVTFIAQVSSVLNQFFQTSSLTCAFKQFLPRKGTRNGRSSTFSECMFHGRIPKSASC

SEQ ID NO: 3659 - DNA, 1059 bp, Populus balsamifera subsp. trichocarpa
  misc_feature (1)..(1059): Ceres ANNOT ID no. 1461236
  misc_feature 407304:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggaggatccaggcttcaccaaccagtggtacatgaactcccttgatgatatcagcttactaccattagctgctgctgcatttggagagaacgtacaccatcctttctctaaccagaatttcaacctcaaaacctccatggatagtactcctacaagcattaatgtcagaccaacaaaacaaatgaaaacttttcatttgtcagacccccaatctgccttttctcctaactttctttcatttgtcaatcccaaccacgcaaatcaaatgggattggtgaagcctaaagaggaggcagtatgttccaaaagcatcaataacttcccttctgacatggtagtttcccaagatatctttgggagccaaaactatgtaatcaagggttgccaaggacctgagaggattagcacaaacactcctagactttctcaaagtcaagatcacattattgcagaaaggaagcggcgagagaagcttagtcaacgattcatagctctatctgctgtagttcctggcctgaagaagatggacaaagcttctgttttaggagatgctatcaagtacttgaaacaactgcaagagaaagttaagacacttgaggaacaaacaaaaaggaaaaccatggaatcagtggtcattgtgaagaaatctcatatctatgtcgatgagggtgatgtcaacgcttcctcagacgagtccaaaggccctattcatgaaactttgccagaaattgaagcaagattctgtgacaaacatgtcctcataagaatccattgtgagaaaaggaaaggagttttggagaaaacagtggctgaaattgagaaactccacctatcagtaatcaatagcagtgttctcgcatttgggacatctgctcttcatgttacttttattgcacaggtaagttctgtcctcaaccagttctttcaaacatctagtttaacatgtgcatatggatatcgacttcaacatgtcattgaaggatctagtgaagactttacgctcagctttcgagttcttcatgtgaaaaagaagctgctccaagctcagttagtatga

SEQ ID NO: 3660 - protein, 352 aa, Populus balsamifera subsp. trichocarpa
  misc_feature (1)..(352): Ceres ANNOT ID no. 1461236
  misc_feature (144)..(193): Pfam Name: HLH Pfam Description: Helix-loop-helix DNA-binding domain
  misc_feature: SWISSPROT Homolog: RAP1_ARATH Transcription factor AtMYC2 (R-homologous Arabidopsis protein 1) with e-value of 1.3e-18 and BLAST sequence identity of 30.5
  misc_feature: SWISSPROT Homolog: RAP1_ARATH RAP-1 (Basic helix-loop-helix protein 6) bHLH6 (AtbHLH006) (rd22BP1)
  misc_feature: SWISSPROT Homolog: EGL1_ARATH Transcription factor EGL1 (ENHANCER OF GLABRA3) (Basic helix-loop-helix protein 2) (bHLH2) (AtbHLH002) (AtMyc-146) with e-value of 2.8e-13 and BLAST sequence identity of 30.7
  misc_feature: SWISSPROT Homolog: TT8_ARATH TRANSPARENT TESTA 8 protein (Basic helix-loop-helix protein 42) (bHLH42) (AtbHLH042) with e-value of 2.8e-11 and BLAST sequence identity of 44.1
  misc_feature: SWISSPROT Homolog: ICE1_ARATH Transcription factor ICE1 (Inducer of CBF expression 1) (Basic helix-loop-helix protein 116) (bHLH116) (AtbHLH116) with e-value of 9.2e-10 and BLAST sequence identity of 26.4
  misc_feature: SWISSPROT Homolog: ARLC_MAIZE Anthocyanin regulatory Lc protein with e-value of 1.7e-09 and BLAST sequence identity of 27.4
  misc_feature 407418:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(352): Functional Homolog of  Ceres CDNA ID no. 23499964 at SEQ ID NO. 3699 with e-value of 1.09E-45 and BLAST sequence identity of 47.2
MEDPGFTNQWYMNSLDDISLLPLAAAAFGENVHHPFSNQNFNLKTSMDSTPTSINVRPTKQMKTFHLSDPQSAFSPNFLSFVNPNHANQMGLVKPKEEAVCSKSINNFPSDMVVSQDIFGSQNYVIKGCQGPERISTNTPRLSQSQDHIIAERKRREKLSQRFIALSAVVPGLKKMDKASVLGDAIKYLKQLQEKVKTLEEQTKRKTMESVVIVKKSHIYVDEGDVNASSDESKGPIHETLPEIEARFCDKHVLIRIHCEKRKGVLEKTVAEIEKLHLSVINSSVLAFGTSALHVTFIAQVSSVLNQFFQTSSLTCAYGYRLQHVIEGSSEDFTLSFRVLHVKKKLLQAQLV

SEQ ID NO: 3661 - protein, 202 aa, Arabidopsis thaliana
  misc_feature (1)..(202): Ceres CDNA ID no. 23500996
  misc_feature (1)..(202): Also Known As Ceres GEMINI ID 5110C11
  misc_feature (1)..(50): Pfam Name: HLH Pfam Description: Helix-loop-helix DNA-binding domain
  misc_feature 407535:<222: Transcription Factor
  misc_feature: Phenotype: Activates expression of the gene endogenous to the AtHMGS (SEQ ID NO 4144) regalutory region Useful for modulating Terpenoid Biosynthesis
MSHIAVERNRRRQMNEHLKSLRSLTPCFYIKRGDQASIIGGVIEFIKELQQLVQVLESKKRRKTLNRPSFPYDHQTIEPSSLGAATTRVPFSRIENVMTTSTFKEVGACCNSPHANVEAKISGSNVVLRVVSRRIVGQLVKIISVLEKLSFQVLHLNISSMEETVLYFFVVKIGLECHLSLEELTLEVQKSFVSDEVIVSTN

SEQ ID NO: 3662 - DNA, 621 bp, Populus balsamifera subsp. trichocarpa; identical to SEQ ID NO: 3190
  misc_feature (1)..(621): Ceres ANNOT ID no. 1459998
  misc_feature 407599:<222: Transcription Factor
  misc_feature: Phenotype: Activates expression of the gene endogenous to the AtHMGS (SEQ ID NO 4144) regalutory region Useful for modulating Terpenoid Biosynthesis

SEQ ID NO: 3663 - protein, 206 aa, Populus balsamifera subsp. trichocarpa; identical to SEQ ID NO: 3191
  misc_feature (1)..(206): Ceres ANNOT ID no. 1459998
  misc_feature (1)..(50): Pfam Name: HLH Pfam Description: Helix-loop-helix DNA-binding domain
  misc_feature: SWISSPROT Homolog: RAP1_ARATH Transcription factor AtMYC2 (R-homologous Arabidopsis protein 1) with e-value of 1.0e-06 and BLAST sequence identity of 35.0
  misc_feature: SWISSPROT Homolog: RAP1_ARATH RAP-1 (Basic helix-loop-helix protein 6) bHLH6 (AtbHLH006) (rd22BP1)
  misc_feature 407667:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(206): Functional Homolog of  Ceres CDNA ID no. 23500996 at SEQ ID NO. 3708 with e-value of 4.59E-61 and BLAST sequence identity of 71.2

SEQ ID NO: 3664 - DNA, 603 bp, Populus balsamifera subsp. trichocarpa; identical to SEQ ID NO: 3192
  misc_feature (1)..(603): Ceres ANNOT ID no. 1513263
  misc_feature 407739:<222: Transcription Factor
  misc_feature: Phenotype: Activates expression of the gene endogenous to the AtHMGS (SEQ ID NO 4144) regalutory region Useful for modulating Terpenoid Biosynthesis

SEQ ID NO: 3665 - protein, 200 aa, Populus balsamifera subsp. trichocarpa; identical to SEQ ID NO: 3193
  misc_feature (1)..(200): Ceres ANNOT ID no. 1513263
  misc_feature (1)..(50): Pfam Name: HLH Pfam Description: Helix-loop-helix DNA-binding domain
  misc_feature: SWISSPROT Homolog: RAP1_ARATH Transcription factor AtMYC2 (R-homologous Arabidopsis protein 1) with e-value of 1.0e-06 and BLAST sequence identity of 35.0
  misc_feature: SWISSPROT Homolog: RAP1_ARATH RAP-1 (Basic helix-loop-helix protein 6) bHLH6 (AtbHLH006) (rd22BP1)
  misc_feature 407807:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(200): Functional Homolog of  Ceres CDNA ID no. 23500996 at SEQ ID NO. 3708 with e-value of 2.70E-56 and BLAST sequence identity of 70.8

SEQ ID NO: 3666 - protein, 207 aa, Arabidopsis thaliana; identical to SEQ ID NO: 3534
  misc_feature (1)..(207): Ceres CDNA ID no. 23502516
  misc_feature (1)..(207): Also Known As Ceres GEMINI ID 5109A11
  misc_feature (21)..(71): Pfam Name: SRF-TF Pfam Description: SRF-type transcription factor DNA-binding and dimerisation domain)
  misc_feature 407894:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis

SEQ ID NO: 3667 - DNA, 585 bp, Populus balsamifera subsp. trichocarpa; identical to SEQ ID NO: 3535
  misc_feature (1)..(585): Ceres ANNOT ID no. 1449874
  misc_feature 407966:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis

SEQ ID NO: 3668 - protein, 194 aa, Populus balsamifera subsp. trichocarpa; identical to SEQ ID NO: 3536
  misc_feature (1)..(194): Ceres ANNOT ID no. 1449874
  misc_feature (15)..(65): Pfam Name: SRF-TF Pfam Description: SRF-type transcription factor DNA-binding and dimerisation domain)
  misc_feature: SWISSPROT Homolog: MAD23_ORYSA MADS-box transcription factor 23 (OsMADS23) with e-value of 2.8e-16 and BLAST sequence identity of 34.8
  misc_feature: SWISSPROT Homolog: MAD14_ORYSA MADS-box transcription factor 14 (OsMADS14) (Protein APETALA1- like B)(Protein AGAMOUS-like 10) (FDRMADS6) (RMADS211) with e-value of 5.2e-15 and BLAST sequence identity of 31.9
  misc_feature: SWISSPROT Homolog: PIST_ARATH Floral homeotic protein PISTILLATA (Transcription factor PI) with e-value of 6.9e-15 and BLAST sequence identity of 44.3
  misc_feature: SWISSPROT Homolog: AGL5_ARATH Agamous-like MADS-box protein AGL5 with e-value of 8.4e-15 and BLAST sequence identity of 33.9
  misc_feature: SWISSPROT Homolog: MAD56_ORYSA MADS-box transcription factor 56 (OsMADS56) (FDRMADS8) (RMADS214) with e-value of 1.1e-14 and BLAST sequence identity of 35.1
  misc_feature 408065:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature (1)..(194): Functional Homolog of  Ceres CDNA ID no. 23502516 at SEQ ID NO. 3713 with e-value of 3.00E-32 and BLAST sequence identity of 42.6

SEQ ID NO: 3669 - DNA, 609 bp, Populus balsamifera subsp. trichocarpa; identical to SEQ ID NO: 3537
  misc_feature (1)..(609): Ceres ANNOT ID no. 1492655
  misc_feature 408145:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis

SEQ ID NO: 3670 - protein, 202 aa, Populus balsamifera subsp. trichocarpa; identical to SEQ ID NO: 3538
  misc_feature (1)..(202): Ceres ANNOT ID no. 1492655
  misc_feature (15)..(65): Pfam Name: SRF-TF Pfam Description: SRF-type transcription factor DNA-binding and dimerisation domain)
  misc_feature: SWISSPROT Homolog: MAD23_ORYSA MADS-box transcription factor 23 (OsMADS23) with e-value of 2.8e-16 and BLAST sequence identity of 34.8
  misc_feature: SWISSPROT Homolog: MAD14_ORYSA MADS-box transcription factor 14 (OsMADS14) (Protein APETALA1- like B)(Protein AGAMOUS-like 10) (FDRMADS6) (RMADS211) with e-value of 5.2e-15 and BLAST sequence identity of 31.9
  misc_feature: SWISSPROT Homolog: PIST_ARATH Floral homeotic protein PISTILLATA (Transcription factor PI) with e-value of 6.9e-15 and BLAST sequence identity of 44.3
  misc_feature: SWISSPROT Homolog: AGL5_ARATH Agamous-like MADS-box protein AGL5 with e-value of 8.4e-15 and BLAST sequence identity of 33.9
  misc_feature: SWISSPROT Homolog: MAD56_ORYSA MADS-box transcription factor 56 (OsMADS56) (FDRMADS8) (RMADS214) with e-value of 1.1e-14 and BLAST sequence identity of 35.1
  misc_feature 408246:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature (1)..(202): Functional Homolog of  Ceres CDNA ID no. 23502516 at SEQ ID NO. 3713 with e-value of 6.49E-30 and BLAST sequence identity of 42.2

SEQ ID NO: 3671 - DNA, 570 bp, Populus balsamifera subsp. trichocarpa; identical to SEQ ID NO: 3539
  misc_feature (1)..(570): Ceres ANNOT ID no. 1439788
  misc_feature 408326:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis

SEQ ID NO: 3672 - protein, 189 aa, Populus balsamifera subsp. trichocarpa; identical to SEQ ID NO: 3540
  misc_feature (1)..(189): Ceres ANNOT ID no. 1439788
  misc_feature (15)..(56): Pfam Name: SRF-TF Pfam Description: SRF-type transcription factor DNA-binding and dimerisation domain)
  misc_feature: SWISSPROT Homolog: MAD23_ORYSA MADS-box transcription factor 23 (OsMADS23) with e-value of 2.8e-16 and BLAST sequence identity of 34.8
  misc_feature: SWISSPROT Homolog: MAD14_ORYSA MADS-box transcription factor 14 (OsMADS14) (Protein APETALA1- like B)(Protein AGAMOUS-like 10) (FDRMADS6) (RMADS211) with e-value of 5.2e-15 and BLAST sequence identity of 31.9
  misc_feature: SWISSPROT Homolog: PIST_ARATH Floral homeotic protein PISTILLATA (Transcription factor PI) with e-value of 6.9e-15 and BLAST sequence identity of 44.3
  misc_feature: SWISSPROT Homolog: AGL5_ARATH Agamous-like MADS-box protein AGL5 with e-value of 8.4e-15 and BLAST sequence identity of 33.9
  misc_feature: SWISSPROT Homolog: MAD56_ORYSA MADS-box transcription factor 56 (OsMADS56) (FDRMADS8) (RMADS214) with e-value of 1.1e-14 and BLAST sequence identity of 35.1
  misc_feature 408425:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsBBE (SEQ ID NO 4160) regalutory region Useful for modulating Alkaloid Biosynthesis
  misc_feature (1)..(189): Functional Homolog of  Ceres CDNA ID no. 23502516 at SEQ ID NO. 3713 with e-value of 2.20E-22 and BLAST sequence identity of 42.5

SEQ ID NO: 3673 - protein, 2006 aa, Arabidopsis thaliana
  misc_feature (1)..(2006): Ceres CDNA ID no. 23503138
  misc_feature (1)..(2006): Also Known As Ceres GEMINI ID 5110A8
  misc_feature (119)..(188): Pfam Name: zf-UBR1 Pfam Description: Putative zinc finger in N-recognin
  misc_feature (1394)..(1442): Pfam Name: PHD Pfam Description: PHD-finger
  misc_feature 408522:<222: Transcription Factor
  misc_feature: Phenotype: Activates expression of the gene endogenous to the AtPES (SEQ ID NO 4142) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
METNSSLFGLVSPSSHDLVIERLASVGVPKKYRSKRGLVEFVRANPAKISELVSALLPTDDDVKLGLKEARERPRKSAVSPTMKKRFRESMNMLQWLMFQDEPDVSLRNLAKLNLDQRGVCGSVWGQNDIAYRCRTCENDPTCAICVPCFQNGDHNSHDYSIIYTGGGCCDCGDETAWKPDGFCSNHKGSEQIRPLSENLANSVGPILDALFTCWNNKLLSAESSGQKGARSNDTLVILQKMSNELTFIVVEMLLEFSMSSESLLSFVSRRIISSSGLLSILLKAERFLDQDVMKKLHDLFLKLIGDPVFKCEFAKAFVSYYPVVISEVVKQGTDNAFKKYPLLSTFSVQILTVPTLTPFLVKEMNLLAMLLGCLSDIFVSCSGEDGLLQATKLERLCETSERVIGDLKFVMSHAIVSKYATHEHRELSRSWLTLLTFAQGMNPLKRETGIPIDEENDYMHLFFVLGHSIAVIHSLLVNGTYSAASDEEIENDRNAKEEFDKCDGDGERYAKVGRLSHEDSVCTAIVSSSSFDSSMASEVHKIDPFHALLPSSAIYLIRECLKVLETCLGNDEGISKFLCKLSSSSGRNIPESKMSWPRRDLLNVETGGSVSSNLASSSRDPSTGLSPLCGDIQTNLSLDNVCGPYGVVQTDVTADSKRVSCNSADLTKNASGLRILGLCDWPDIHYDVSSQAISVHLPLHRLLSLLIQKALRICYGESASYNGVSISHEIPHADFFSSVIGDFHPCGFSALVMEHVLQIRVFCAQVIAGMWKKNGDSALVSCEWYRSVRWSEQGLELDLFLLQCCAALAPADSYVDKLLSRFGLSSYLSLNPDITNEYEPVLVQEMLGLLIQILQERRFCGLSTAESLRREIIFKLATGDFTHSQLVKSLPRDLSKSDELQEVLDDVSVYCNPSGMNQGKYSLQSSCWKELDLYHPRWQSRDLQSAEERFSRYCGVSALTTQLPRWRMIYPPLKGLARIGTCKATFQIISSALYYALQSGTSVKSRAPDGVLITALQLLSLSLDICTQQRQSNSQDCCLENSIPILELAGLEIIGIAQGTEKESLLSLLVSLMKTRMGDGRHQFPEPGSCNISSWIGNLLKKFSAIDSVCMNLLQSLAPEVVGQSGFDKVMSGSTSDEKRKAKAKERQAAIMAKMKAEQSKFLSTLSSSMDDDDPRSEFETSDSVMEHDSEIAVREVCSLCHDPDSKDPVSFLIFLQKSKLLSFVDRGPPSWDQCPQSEKKISVDGAPDLLRMNASSDSLRISSPLMLQLSDDTISESANMIESIKARLIGNGQTEKRSSDGRGKDESNMESLEIAMYQTVRNKIENMINQSLTRVDHQPHEAENCSEKNSVGGPSTLQGRFPDIRSRQTSRRPDAGSDGFHPIDCDGVYLSSCGHAVHQSCLERYLKSLKERSGRRTVFEGAHIVDLKKKEFLCPVCRRLANSVLPECPGDLCSVSKLQDSPRTKLRRKDALQPSLWLSEALCLLRSAAEVIEDGDRGKTVTPQGDGPRRKDLKSVSKMLWDFYFPKPEDKTLKRLWLPPQSIVMWDTLKYSLISMEIGTRFAKNSMLPVYCIDSLYEELKTSKGTILSVLLRVVQSSRTKNTIHVRQRFVGMKHLAESICYGVSSSSSSSIFGSEGTTGSLKNIDLLWNRASDPVLAHDPFSSLMWALFCLPFPFLTCEESLLSLVHIFHSVSLVQTVIAYCACRPSELSELNFGENLLNDISNALRESGGWEYFRSNNMDLSCDIKDTIRKYSLPFLRRCALLWKLLKSTPRKLHEESDMFDLPSDPTTDNMDFIYSPQSELNHVQELEKMFNIPPIDIILNDELLRSSTQIWLQHFQREYRVNRVKRSLCITPVVPFQLMKLPNLYQDLLQRCIKKRCVNCTKVIEEPVLCLLCGSLCSPIWSPCCRESGCPNHAITCGAGTGVFLLIRRTTILLQRFARQSPWPSPYLDTFGEEDIDMIRGKRLYLNEERYAALTYLVGSHGLDRSSKVLGQTTIGAVLH

SEQ ID NO: 3674 - DNA, 6081 bp, Populus balsamifera subsp. trichocarpa
  misc_feature (1)..(6081): Ceres ANNOT ID no. 1507158
  misc_feature 408933:<222: Transcription Factor
  misc_feature: Phenotype: Activates expression of the gene endogenous to the AtPES (SEQ ID NO 4142) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atggcggttacagtgatggtggtggttcgggaagaggagtgggagacgaggcttactcagtttggagttcccaaggagtaccgtgttatgttgcattctggcctggttgattatatcatggataattggtctcgcataccagagctagtggcagcaatcttgcctattgatgatgaagtggcagagattctccaaaatgctaagctagcctctaaaaaatctgctagccagacaatgaaatactgtttcagggaatgcatggtttggttacaatggctgatgtttttgggcgaaccagctgttgcacttaagaacctatctaagatgagtgctgggcgtggtgtttgcggagctgtttggggaaataatgatatagcatatcggtgccaaacttgtgaaaatgaccccacatgtgcaatttgtgttccttgttttcagaatgggaaccacaaggatcatgactattctattatatacacaggcggaggttgctgtgattgtggggatgtgacagcatggaaacgagaggggttctgctcaaagcataaaggtgctgaacaaatacaaccccttccagaggagtttgcaagatctgtagggcctgtcctcgatgctcttctagggtgttggaaaaataagctagtgtctgctgaaaccatctcccagaaaaatccaaatgcagctgatcgtgctgctatgggcaaaaagattgcaaatcagctagcatttgcagttgttgagatgctactagagttctgtaaatgcagtgagagtttgcttagttttgtttccaggagggtgatttctctaggaggtttattggagattcttgtgaggtcggagaggttcttgagtgagggtgttgtgaagaaacttcatgagctgctcctgaaattgttgggagagcccattttcaagtacgagttcgccaaagaatttttgcgttattatccatttgttgtacatgaagcgatgaaagaaactgttgatgatatgcacaagaaatatcctttgctatcaatattctctgtgcaaatttttactgtgcccactctcaccccccgacttgtgaaggagatgaacttgctaggcttgttgttggggtgcttggaagatatatttatccagtgtgctggagaagatggtcgtttacagtttaccaagtgggcacatttgtatgagatcggtatacgtgtagttgaagatgttcgatttgttatgagccatggtgttgtaccaaaaaatgggatgggacccttaaagagagaaactagcctctatgtagaagaagaaagtgagaatattaatttgctttttattttgtgtcattctattgccaacatccattctcttttggtggatggagcattttctatgtgtgaggaggcagatgatgctacttttcttaacatgcttggaaaagatatggatgaacaagatagcataagacacacaaaaattggacggctgtctcaggaaagctctgtatgtagtgtgacagaaagtacttcattcatttctgcagagaaggttgttgaagttgattcagattccacttaccatcacctacttccttcctcagtgacgtggttaacctatgagtgcttgagggccattgagaattgtttgggagctgatgattcatctggggctcaagtctctggaggtactagcagcatttccaatagcaacttttcagcatttaagaaaaaattgtataagattagaaaaggcaaatatatatttggtggccatggcagtacaagcaaagatgaatgtttttcagttgcatatagtcgctgccatgcgagtgtcaatgtagataatgctaatgtagtaaaggactgcaaaacaacagttcctggtgatactgactgtgcaggctccagtgacggtttgatggaaggcagcagttcatcagaattggacctcctacgatttttaagtttgtctgattggccagacataatttatgatgttagttcacatgatgtatctgttcacactcctttgcatcgattactttccatgcttttacaaaaagcattaagaaggtgttatggtggatctgtggttataaatgcaatcaatgctagcacctcaacttcattatctagaactgatgatgatttctttggatgtcttcttgagggttgccacccttgtgggttttctgcctttgttatggagcaccctttgcggactagggtgttttgtgcccaggtccatgctggaatgtggaggaagaatggggatgctgccattttatgctgtgagtggtaccgctcagtacgccggtctgaacaaggtttagagtttgatctatttcttctgcagtgctgtgctgtgctggctccacctgacctctatgtcagtagaattctagaacgttttgggttgtcagactacctttctctgaaagctgagcaatctacagagtatgaaccagttttgatgcaggaaatgctcatgcttcttatacaaattgtccaggaaaggcggttttctgggttgactcctgctgaaaatttgaagagagagttggttcataagttagcaattggagatgccactcgcagtcaattagttaaatccttgccccgtgatctctccaagattgaccaacttcaggaagttttggatacagttgctgtatattctaatccatccggcttcaatcaggggatgtattctttgcgctgggcatattggaaagagctagatctgtaccaccctcgttggaattcacgggatttacaagttgcagaagaaagatatttgcgctactgtagtgcttctgcaggaacaacacagcttcctaggtggacaaatatttaccctcctcttaagggcatagctagaatagctagtagtaaagtggtcattaaaatcatccgtgctgtattattttatgctattttcatgcataagcgtgctcctgatggtgttcttctaactgcactgcacttgctctcattagcattagacatctgtattcagcagaaagaaatggatatgtcatttcacattgaaaacacctcttctatgtttgcttttgtgggtgaagaaatccaagagggattaaattacggctctggtggccagagcttgctgtcacttcttgtcttgctcatgaggatacacaagagagagagttctgacaacctcttggaagcaggcagttacaacttctcttctttgattgaaagtttgttgaagaggtttgcagagatagatgctggatgtatgaccaaactgcagcaacttgcccctgagatggccattcatttatcacaatcagttccaaatattgagaaaaatacattgggttcagcttctgatagtgagaaacgcaaagccaaagctctcgagagacaggctgccatattggcaaaaatgaaagctgagcagtccaaatttttgttgagtatgaactctgctactgatgatgtttcaaatactggagcagaaggaattgactcagatggcacacagaatttggaagagttgacgcaagatgtttgttctctttgccatgatcccaattccaaaaatcctgtgtccttcttggttctgcttcaggtaagctactgctttgtagttttgattgttgaccgagtttccttctgcaatgtgaatttgatactgatttcttggaccaagaaatcaaggcttttgagcttcattgacagaggccctccatcatgggatcaagatcagctgcctgacaaggggcaaaactctgtaattgcaaaggcattgaccaatcaatctggaataagctcttcaagtggttcgggaatgatttcatctacccaactaacacattttgttcaggatgtagtcaaccaatttgctaattatgctcaacctggggaagtaaatgctattattgaattcatcaaggctcggttccctttattaaggagttcccaagtatcttctgcatccaaggatgggaaagataagactatgaatacttttgagatgttagaacaagacatgtacttctccatgcggaaagaaatgcatgataatatgctcgcttcaaattctggattgcagactgagaaatttacagctgctgaaggtggtcagataagcagtcctgttgaatctgtattgcttggaaaatatatagcagctctttctagagagataacagagcacccttcttcttctgaaaattgtgatggggttcatctatcttcctgtggacatgctgtgcatcaggaatgtcttgatcgctatttgtcatcattgaaggaacgatatgtcagaagaattgtttttgaaggagggcatattgtcgacccagatcagggggaatttctctgccctgtatgtcgtcaactagcaaattctgtcttgccttcattgcctggggatttccaaaaggtttggagacagcccatgatttcaactgtcagttcactgcatgctgtgggggctttggtctcatcaagtgaaggatgtgattctcttcagcttcaacatgccttgtttctcttgaaatctgctgcaaaaatggttgaaaagggagatatcttgaaagctattcccttgcaaaggggtgaaaaaatgtggccgaatcttgattcaatttcccgtctccttattaaactatatttcccaaacagatgggataaattctcaggatctgcaagggtaaaccattccatgattatgtgggatactcttaagtattcccttgtatctatggagattgcagcacgttgtggaggaactcaaatgactcctacatatagcctaaatgcgttgtacaaggaactcaaatctaccagtggatttacactatccttgttgctcaaaattgtccaaaatttgaggagtaagaatcctcttcatgtgcttcagagatttaggggtattcagctatttgcagagtctatttgcgcaggagttcccaatgattatcccagtggtgcttatcggtgtggagaaaatatgtcgtgcatcttagcacacattgggaaggaagtttcatactctgacgttcaattttggaattgggtggctgaacctgtccttgctcatgatgctttttcatcattgatgtgggccctgttttgtctcccatgcccatttctgtcttgtcaagattccttattgtcccttgtgcatgttttctatggggcttctgtagctcaggctatagtaatattttgtgggaaacatcaacgtgaaatgagggaatcaaattttgatgattctctgattactgacatctccaaggtttttggggaatctggatgcatcaaggattattttgtttccgacaacatcgattcatcttctgacatcatcaatgtaattcgtagattgagtttcccttacttgaggaggtgtgctttgttgtggaaattgctgagtacctcggtctcagcaccattctgtgatagggatgtgttgaatagatcatctaacaattacatgatggataacatgagtggagctcaagacgagcttaatgaagttcaagagctggaaaagatgttcaaaattcctccattattttctgtcctcaaggatcatactctacgatctttagttacaaaatggctccatcatttttgcaagcagtatgaagtctttagcccccaacatgttctacatgtcacacctgcagttccattcaagttaatgcacctaccgcatgtttaccaggatctactgcagaggtatataaaacagaaatgtgttggctgcaagactctgcttgatgaccccgctctttgcctactctgtggtagagtttgctctctcaactggaagtcatgctgcagggaaagtggatgccaaactcatgctatggcctgcggtgctggtactggtgtatttctgttgatcaagagaactacaattctgctacaaagatgcgcacgccaggctccttggccatctccatacttggatgcatttggtgaagagagaggaaagccattgtacctgaatgaggagcgctatgctgcactcacttacatggttgcttctcatggccttgatcggagctctaaggttctcggccaaactaccattggatccttattcttggtctag

SEQ ID NO: 3675 - protein, 2021 aa, Populus balsamifera subsp. trichocarpa
  misc_feature (1)..(2021): Ceres ANNOT ID no. 1507158
  misc_feature (109)..(178): Pfam Name: zf-UBR1 Pfam Description: Putative zinc finger in N-recognin
  misc_feature (1399)..(1447): Pfam Name: PHD Pfam Description: PHD-finger
  misc_feature: SWISSPROT Homolog: UBR2_MOUSE Ubiquitin-protein ligase E3 component N-recognin-2 (EC 6.-.-.-) (Ubiquitin-protein ligase E3-alpha-2) with e-value of 1.5e-73 and BLAST sequence identity of 27.5
  misc_feature: SWISSPROT Homolog: UBR1_MOUSE Ubiquitin-protein ligase E3 component N-recognin-1 with e-value of 5.7e-72 and BLAST sequence identity of 24.1
  misc_feature: SWISSPROT Homolog: UBR1_MOUSE EC 6.-.-.- Ubiquitin-protein ligase E3-alpha-1 Ubiquitin-protein ligase E3-alpha-I
  misc_feature: SWISSPROT Homolog: UBR1_HUMAN Ubiquitin-protein ligase E3 component N-recognin-1 with e-value of 1.2e-71 and BLAST sequence identity of 24.1
  misc_feature: SWISSPROT Homolog: UBR1_HUMAN EC 6.-.-.- Ubiquitin-protein ligase E3-alpha-1 Ubiquitin-protein ligase E3-alpha-I
  misc_feature: SWISSPROT Homolog: UBR2_HUMAN Ubiquitin-protein ligase E3 component N-recognin-2 with e-value of 6.5e-69 and BLAST sequence identity of 27.3
  misc_feature: SWISSPROT Homolog: UBR2_HUMAN EC 6.-.-.- Ubiquitin-protein ligase E3-alpha-2 Ubiquitin-protein ligase E3-alpha-II
  misc_feature: SWISSPROT Homolog: UBR1_DROME Ubiquitin-protein ligase E3 component N-recognin (EC 6.-.-.-) (Ubiquitin-protein ligase E3-alpha) with e-value of 1.8e-59 and BLAST sequence identity of 32.1
  misc_feature 409246:<222: Transcription Factor
  misc_feature: Phenotype: Activates expression of the gene endogenous to the AtPES (SEQ ID NO 4142) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(2021): Functional Homolog of  Ceres CDNA ID no. 23503138 at SEQ ID NO. 3720 with e-value of 0.0 and BLAST sequence identity of 54.6
MVVVREEEWETRLTQFGVPKEYRVMLHSGLVDYIMDNWSRIPELVAAILPIDDEVAEILQNAKLASKKSASQTMKYCFRECMVWLQWLMFLGEPAVALKNLSKMSAGRGVCGAVWGNNDIAYRCQTCENDPTCAICVPCFQNGNHKDHDYSIIYTGGGCCDCGDVTAWKREGFCSKHKGAEQIQPLPEEFARSVGPVLDALLGCWKNKLVSAETISQKNPNAADRAAMGKKIANQLAFAVVEMLLEFCKCSESLLSFVSRRVISLGGLLEILVRSERFLSEGVVKKLHELLLKLLGEPIFKYEFAKEFLRYYPFVVHEAMKETVDDMHKKYPLLSIFSVQIFTVPTLTPRLVKEMNLLGLLLGCLEDIFIQCAGEDGRLQFTKWAHLYEIGIRVVEDVRFVMSHGVVPKNGMGPLKRETSLYVEEESENINLLFILCHSIANIHSLLVDGAFSMCEEADDATFLNMLGKDMDEQDSIRHTKIGRLSQESSVCSVTESTSFISAEKVVEVDSDSTYHHLLPSSVTWLTYECLRAIENCLGADDSSGAQVSGGTSSISNSNFSAFKKKLYKIRKGKYIFGGHGSTSKDECFSVAYSRCHASVNVDNANVVKDCKTTVPGDTDCAGSSDGLMEGSSSSELDLLRFLSLSDWPDIIYDVSSHDVSVHTPLHRLLSMLLQKALRRCYGGSVVINAINASTSTSLSRTDDDFFGCLLEGCHPCGFSAFVMEHPLRTRVFCAQVHAGMWRKNGDAAILCCEWYRSVRRSEQGLEFDLFLLQCCAVLAPPDLYVSRILERFGLSDYLSLKAEQSTEYEPVLMQEMLMLLIQIVQERRFSGLTPAENLKRELVHKLAIGDATRSQLVKSLPRDLSKIDQLQEVLDTVAVYSNPSGFNQGMYSLRWAYWKELDLYHPRWNSRDLQVAEERYLRYCSASAGTTQLPRWTNIYPPLKGIARIASSKVVIKIIRAVLFYAIFMHKRAPDGVLLTALHLLSLALDICIQQKEMDMSFHIENTSSMFAFVGEEIQEGLNYGSGGQSLLSLLVLLMRIHKRESSDNLLEAGSYNFSSLIESLLKRFAEIDAGCMTKLQQLAPEMAIHLSQSVPNIEKNTLGSASDSEKRKAKALERQAAILAKMKAEQSKFLLSMNSATDDVSNTGAEGIDSDGTQNLEELTQDVCSLCHDPNSKNPVSFLVLLQVSYCFVVLIVDRVSFCNVNLILISWTKKSRLLSFIDRGPPSWDQDQLPDKGQNSVIAKALTNQSGISSSSGSGMISSTQLTHFVQDVVNQFANYAQPGEVNAIIEFIKARFPLLRSSQVSSASKDGKDKTMNTFEMLEQDMYFSMRKEMHDNMLASNSGLQTEKFTAAEGGQISSPVESVLLGKYIAALSREITEHPSSSENCDGVHLSSCGHAVHQECLDRYLSSLKERYVRRIVFEGGHIVDPDQGEFLCPVCRQLANSVLPSLPGDFQKVWRQPMISTVSSLHAVGALVSSSEGCDSLQLQHALFLLKSAAKMVEKGDILKAIPLQRGEKMWPNLDSISRLLIKLYFPNRWDKFSGSARVNHSMIMWDTLKYSLVSMEIAARCGGTQMTPTYSLNALYKELKSTSGFTLSLLLKIVQNLRSKNPLHVLQRFRGIQLFAESICAGVPNDYPSGAYRCGENMSCILAHIGKEVSYSDVQFWNWVAEPVLAHDAFSSLMWALFCLPCPFLSCQDSLLSLVHVFYGASVAQAIVIFCGKHQREMRESNFDDSLITDISKVFGESGCIKDYFVSDNIDSSSDIINVIRRLSFPYLRRCALLWKLLSTSVSAPFCDRDVLNRSSNNYMMDNMSGAQDELNEVQELEKMFKIPPLFSVLKDHTLRSLVTKWLHHFCKQYEVFSPQHVLHVTPAVPFKLMHLPHVYQDLLQRYIKQKCVGCKTLLDDPALCLLCGRVCSLNWKSCCRESGCQTHAMACGAGTGVFLLIKRTTILLQRCARQAPWPSPYLDAFGEERGKPLYLNEERYAALTYMVASHGLDRSSKVLGQTTIGSLFLV

SEQ ID NO: 3676 - DNA, 6573 bp, Populus balsamifera subsp. trichocarpa
  misc_feature (1)..(6573): Ceres ANNOT ID no. 1454014
  misc_feature 409668:<222: Transcription Factor
  misc_feature: Phenotype: Activates expression of the gene endogenous to the AtPES (SEQ ID NO 4142) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atggcggttacagtgatggtggtggttcgggaagaggagtgggagacgaggcttactcagtttggagttcccaaggagtaccgtgttatgttgcattctggcctggttgattatatcatggataattggtctcgcataccagagctagtggcagcaatcttgcctattgatgatgaagtggcagagattctccaaaatgctaagctagcctctaaaaaatctgctagccagacaatgaaatactgtttcagggaatgcatggtttggttacaatggctgatgtttttgggcgaaccagctgttgcacttaagaacctatctaagatgagtgctgggcgtggtgtttgcggagctgtttggggaaataatgatatagcatatcggtgccaaacttgtgaaaatgaccccacatgtgcaatttgtgttccttgttttcagaatgggaaccacaaggatcatgactattctattatatacacaggcggaggttgctgtgattgtggggatgtgacagcatggaaacgagaggggttctgctcaaagcataaaggtgctgaacaaatacaaccccttccagaggagtttgcaagatctgtagggcctgtcctcgatgctcttctagggtgttggaaaaataagctagtgtctgctgaaaccatctcccagaaaaatccaaatgcagctgatcgtgctgctatgggcaaaaagattgcaaatcagctagcatttgcagttgttgagatgctactagagttctgtaaatgcagtgagagtttgcttagttttgtttccaggagggtgatttctctaggaggtttattggagattcttgtgaggtcggagaggttcttgagtgagggtgttgtgaagaaacttcatgagctgctcctgaaattgttgggagagcccattttcaagtacgagttcgccaaagaatttttgcgttattatccatttgttgtacatgaagcgatgaaagaaactgttgatgatatgcacaagaaatatcctttgctatcaatattctctgtgcaaatttttactgtgcccactctcaccccccgacttgtgaaggagatgaacttgctaggcttgttgttggggtgcttggaagatatatttatccagtgtgctggagaagatggtcgtttacagtttaccaagtgggcacatttgtatgagatcggtatacgtgtagttgaagatgttcgatttgttatgagccatggtgttgtaccaaaaaatgggatgggacccttaaagagagaaactagcctctatgtagaagaagaaagtgagaatattaatttgctttttattttgtgtcattctattgccaacatccattctcttttggtggatggagcattttctatgtgtgaggaggcagatgatgctacttttcttaacatgcttggaaaagatatggatgaacaagatagcataagacacacaaaaattggacggctgtctcaggaaagctctgtatgtagtgtgacagaaagtacttcattcatttctgcagagaaggttgttgaagttgattcagattccacttaccatcacctacttccttcctcagtgacgtggttaacctatgagtgcttgagggccattgagaattgtttgggagctgatgattcatctggggctcaagtctctggaggtactagcagcatttccaatagcaacttttcagcatttaagaaaaaattgtataagattagaaaaggcaaatatatatttggtggccatggcagtacaagcaaagatgaatgtttttcagttgcatatagtcgctgccatgcgagtgtcaatgtagataatgctaatgtagtaaaggactgcaaaacaacagttcctggtgatactgactgtgcaggctccagtgacggtttgatggaaggcagcagttcatcagaattggacctcctacgatttttaagtttgtctgattggccagacataatttatgatgttagttcacatgatgtatctgttcacactcctttgcatcgattactttccatgcttttacaaaaagcattaagaaggtgttatggtggatctgtggttataaatgcaatcaatgctagcacctcaacttcattatctagaactgatgatgatttctttggatgtcttcttgagggttgccacccttgtgggttttctgcctttgttatggagcaccctttgcggactagggtgttttgtgcccaggtccatgctggaatgtggaggaagaatggggatgctgccattttatgctgtgagtggtaccgctcagtacgccggtctgaacaaggtttagagtttgatctatttcttctgcagtgctgtgctgtgctggctccacctgacctctatgtcagtagaattctagaacgttttgggttgtcagactacctttctctgaaagctgagcaatctacagagtatgaaccagttttgatgcaggaaatgctcatgcttcttatacaaattgtccaggaaaggcggttttctgggttgactcctgctgaaaatttgaagagagagttggttcataagttagcaattggagatgccactcgcagtcaattagttaaatccttgccccgtgatctctccaagattgaccaacttcaggaagttttggatacagttgctgtatattctaatccatccggcttcaatcaggggatgtattctttgcgctgggcatattggaaagagctagatctgtaccaccctcgttggaattcacgggatttacaagttgcagaagaaagatatttgcgctactgtagtgcttctgcaggaacaacacagcttcctaggtggacaaatatttaccctcctcttaagggcatagctagaatagctagtagtaaagtggtcattaaaatcatccgtgctgtattattttatgctattttcatgcataagcgtgctcctgatggtgttcttctaactgcactgcacttgctctcattagcattagacatctgtattcagcagaaagaaatggatatgtcatttcacattgaaaacacctcttctatgtttgcttttgtgggtgaagaaatccaagagggattaaattacggctctggtggccagagcttgctgtcacttcttgtcttgctcatgaggatacacaagagagagagttctgacaacctcttggaagcaggcagttacaacttctcttctttgattgaaagtttgttgaagaggtttgcagagatagatgctggatgtatgaccaaactgcagcaacttgcccctgagatggccattcatttatcacaatcagttccaaatattgagaaaaatacattgggttcagcttctgatagtgagaaacgcaaagccaaagctctcgagagacaggctgccatattggcaaaaatgaaagctgagcagtccaaatttttgttgagtatgaactctgctactgatgatgtttcaaatactggagcagaaggaattgactcagatggcacacagaatttggaagagttgacgcaagatgtttgttctctttgccatgatcccaattccaaaaatcctgtgtccttcttggttctgcttcaggtaagctactgctttgtagttttgattgttgaccgagtttccttctgcaatgtgaatttgatactgatttcttggaccaagaaatcaaggcttttgagcttcattgacagaggccctccatcatgggatcaagatcagctgcctgacaaggggcaaaactctgtaattgcaaaggcattgaccaatcaatctggaataagctcttcaagtggttcgggaatgatttcatctacccaactaacacattttgttcaggatgtagtcaaccaatttgctaattatgctcaacctggggaagtaaatgctattattgaattcatcaaggctcggttccctttattaaggagttcccaagtatcttctgcatccaaggatgggaaagataagactatgaatacttttgagatgttagaacaagacatgtacttctccatgcggaaagaaatgcatgataatatgctcgcttcaaattctggattgcagactgagaaatttacagctgctgaaggtggtcagataagcagtcctgttgaatctgtattgcttggaaaatatatagcagctctttctagagagataacagagcacccttcttcttctgaaagttctcctaatgatgagctacaggcagaatttccttcccggtctcccgcatatgatggatttggccctgcagattgtgatggggttcatctatcttcctgtggacatgctgtgcatcaggaatgtcttgatcgctatttgtcatcattgaaggaacgatatgtcagaagaattgtttttgaaggagggcatattgtcgacccagatcagggggaatttctctgccctgtatgtcgtcaactagcaaattctgtcttgccttcattgcctggggatttccaaaaggtttggagacagcccatgatttcaactgtcagttcactgcatgctgtgggggctttggtctcatcaagtgaaggatgtgattctcttcagcttcaacatgccttgtttctcttgaaatctgctgcaaaaatggttgaaaagggagatatcttgaaagctattcccttgcaaaggggtgaaaaaatgtggccgaatcttgattcaatttcccgtctccttattaaactatatttcccaaacagatgggataaattctcaggatctgcaagggtaaaccattccatgattatgtgggatactcttaagtattcccttgtatctatggagattgcagcacgttgtggaggaactcaaatgactcctacatatagcctaaatgcgttgtacaaggaactcaaatctaccagtggatttacactatccttgttgctcaaaattgtccaaaatttgaggagtaagaatcctcttcatgtgcttcagagatttaggggtattcagctatttgcagagtctatttgcgcaggagttcccaatgattatcccagtggtgcttatcggtgtggaggagaatgtattggatcagggatgatgttgttccatattgtggctggaatctttggatcatttggatttcatcttgaaaatcaacctcaagaaaaacctgggggcaacctttctacaaagccacagaattatctatcaaaaactttgaaggccttatcaaaaaatatgtcgtgcatcttagcacacattgggaaggaagtttcatactctgacgttcaattttggaattgggtggctgaacctgtccttgctcatgatgctttttcatcattgatgtgggccctgttttgtctcccatgcccatttctgtcttgtcaagattccttattgtcccttgtgcatgttttctatggggcttctgtagctcaggctatagtaatattttgtgggaaacatcaacgtgaaatgagggaatcaaattttgatgattctctgattactgacatctccaaggtttttggggaatctggatgcatcaaggattattttgtttccgacaacatcgattcatcttctgacatcatcaatgtaattcgtagattgagtttcccttacttgaggaggtgtgctttgttgtggaaattgctgagtacctcggtctcagcaccattctgtgatagggatgtgttgaatagatcatctaacaattacatgatggataacatgagtggagctcaagacgagcttaatgaagttcaagagctggaaaagatgttcaaaattcctccattattttctgtcctcaaggatcatactctacgatctttagttacaaaatggctccatcatttttgcaagcagtatgaagtctttagcccccaacatgttctacatgtcacacctgcagttccattcaagttaatgcacctaccgcatgtttaccaggatctactgcagaggtatataaaacagaaatgtgttggctgcaagactctgcttgatgaccccgctctttgcctactctgtggtagagtttgctctctcaactggaagtcatgctgcagggaaagtggatgccaaactcatgctatggcctgcggtgctggtactggtgtatttctgttgatcaagagaactacaattctgctacaaagatgcgcacgccaggctccttggccatctccatacttggatgcatttggtgaagaggcaagttgtttattctgctcttgtaaaagaaagaaactgaagtatcttgtgaatgtgtgtatgcacgtgcaggatattcaaattcagagaggaaagccattgtacctgaatgaggagcgctatgctgcactcacttacatgattttttatttaattgtgcatgttaggttgcttctcatggccttgatcggagctctaaggttctcggccaaactaccattggatccttattcttggtctagctgggaagattcatcttcaagttttccatacggatttctcaggcatagaaggattttgaatcagattgatattggaaggatgacaagtgcttttctgtacatgcaaagattgccaaatcgtccacacattttgggggaaattagttaa

SEQ ID NO: 3677 - protein, 2185 aa, Populus balsamifera subsp. trichocarpa
  misc_feature (1)..(2185): Ceres ANNOT ID no. 1454014
  misc_feature (109)..(178): Pfam Name: zf-UBR1 Pfam Description: Putative zinc finger in N-recognin
  misc_feature (1423)..(1471): Pfam Name: PHD Pfam Description: PHD-finger
  misc_feature: SWISSPROT Homolog: UBR2_MOUSE Ubiquitin-protein ligase E3 component N-recognin-2 (EC 6.-.-.-) (Ubiquitin-protein ligase E3-alpha-2) with e-value of 1.5e-73 and BLAST sequence identity of 27.5
  misc_feature: SWISSPROT Homolog: UBR1_MOUSE Ubiquitin-protein ligase E3 component N-recognin-1 with e-value of 5.7e-72 and BLAST sequence identity of 24.1
  misc_feature: SWISSPROT Homolog: UBR1_MOUSE EC 6.-.-.- Ubiquitin-protein ligase E3-alpha-1 Ubiquitin-protein ligase E3-alpha-I
  misc_feature: SWISSPROT Homolog: UBR1_HUMAN Ubiquitin-protein ligase E3 component N-recognin-1 with e-value of 1.2e-71 and BLAST sequence identity of 24.1
  misc_feature: SWISSPROT Homolog: UBR1_HUMAN EC 6.-.-.- Ubiquitin-protein ligase E3-alpha-1 Ubiquitin-protein ligase E3-alpha-I
  misc_feature: SWISSPROT Homolog: UBR2_HUMAN Ubiquitin-protein ligase E3 component N-recognin-2 with e-value of 6.5e-69 and BLAST sequence identity of 27.3
  misc_feature: SWISSPROT Homolog: UBR2_HUMAN EC 6.-.-.- Ubiquitin-protein ligase E3-alpha-2 Ubiquitin-protein ligase E3-alpha-II
  misc_feature: SWISSPROT Homolog: UBR1_DROME Ubiquitin-protein ligase E3 component N-recognin (EC 6.-.-.-) (Ubiquitin-protein ligase E3-alpha) with e-value of 1.8e-59 and BLAST sequence identity of 32.1
  misc_feature 409997:<222: Transcription Factor
  misc_feature: Phenotype: Activates expression of the gene endogenous to the AtPES (SEQ ID NO 4142) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(2185): Functional Homolog of  Ceres CDNA ID no. 23503138 at SEQ ID NO. 3720 with e-value of 0.0 and BLAST sequence identity of 54.3
MVVVREEEWETRLTQFGVPKEYRVMLHSGLVDYIMDNWSRIPELVAAILPIDDEVAEILQNAKLASKKSASQTMKYCFRECMVWLQWLMFLGEPAVALKNLSKMSAGRGVCGAVWGNNDIAYRCQTCENDPTCAICVPCFQNGNHKDHDYSIIYTGGGCCDCGDVTAWKREGFCSKHKGAEQIQPLPEEFARSVGPVLDALLGCWKNKLVSAETISQKNPNAADRAAMGKKIANQLAFAVVEMLLEFCKCSESLLSFVSRRVISLGGLLEILVRSERFLSEGVVKKLHELLLKLLGEPIFKYEFAKEFLRYYPFVVHEAMKETVDDMHKKYPLLSIFSVQIFTVPTLTPRLVKEMNLLGLLLGCLEDIFIQCAGEDGRLQFTKWAHLYEIGIRVVEDVRFVMSHGVVPKNGMGPLKRETSLYVEEESENINLLFILCHSIANIHSLLVDGAFSMCEEADDATFLNMLGKDMDEQDSIRHTKIGRLSQESSVCSVTESTSFISAEKVVEVDSDSTYHHLLPSSVTWLTYECLRAIENCLGADDSSGAQVSGGTSSISNSNFSAFKKKLYKIRKGKYIFGGHGSTSKDECFSVAYSRCHASVNVDNANVVKDCKTTVPGDTDCAGSSDGLMEGSSSSELDLLRFLSLSDWPDIIYDVSSHDVSVHTPLHRLLSMLLQKALRRCYGGSVVINAINASTSTSLSRTDDDFFGCLLEGCHPCGFSAFVMEHPLRTRVFCAQVHAGMWRKNGDAAILCCEWYRSVRRSEQGLEFDLFLLQCCAVLAPPDLYVSRILERFGLSDYLSLKAEQSTEYEPVLMQEMLMLLIQIVQERRFSGLTPAENLKRELVHKLAIGDATRSQLVKSLPRDLSKIDQLQEVLDTVAVYSNPSGFNQGMYSLRWAYWKELDLYHPRWNSRDLQVAEERYLRYCSASAGTTQLPRWTNIYPPLKGIARIASSKVVIKIIRAVLFYAIFMHKRAPDGVLLTALHLLSLALDICIQQKEMDMSFHIENTSSMFAFVGEEIQEGLNYGSGGQSLLSLLVLLMRIHKRESSDNLLEAGSYNFSSLIESLLKRFAEIDAGCMTKLQQLAPEMAIHLSQSVPNIEKNTLGSASDSEKRKAKALERQAAILAKMKAEQSKFLLSMNSATDDVSNTGAEGIDSDGTQNLEELTQDVCSLCHDPNSKNPVSFLVLLQVSYCFVVLIVDRVSFCNVNLILISWTKKSRLLSFIDRGPPSWDQDQLPDKGQNSVIAKALTNQSGISSSSGSGMISSTQLTHFVQDVVNQFANYAQPGEVNAIIEFIKARFPLLRSSQVSSASKDGKDKTMNTFEMLEQDMYFSMRKEMHDNMLASNSGLQTEKFTAAEGGQISSPVESVLLGKYIAALSREITEHPSSSESSPNDELQAEFPSRSPAYDGFGPADCDGVHLSSCGHAVHQECLDRYLSSLKERYVRRIVFEGGHIVDPDQGEFLCPVCRQLANSVLPSLPGDFQKVWRQPMISTVSSLHAVGALVSSSEGCDSLQLQHALFLLKSAAKMVEKGDILKAIPLQRGEKMWPNLDSISRLLIKLYFPNRWDKFSGSARVNHSMIMWDTLKYSLVSMEIAARCGGTQMTPTYSLNALYKELKSTSGFTLSLLLKIVQNLRSKNPLHVLQRFRGIQLFAESICAGVPNDYPSGAYRCGGECIGSGMMLFHIVAGIFGSFGFHLENQPQEKPGGNLSTKPQNYLSKTLKALSKNMSCILAHIGKEVSYSDVQFWNWVAEPVLAHDAFSSLMWALFCLPCPFLSCQDSLLSLVHVFYGASVAQAIVIFCGKHQREMRESNFDDSLITDISKVFGESGCIKDYFVSDNIDSSSDIINVIRRLSFPYLRRCALLWKLLSTSVSAPFCDRDVLNRSSNNYMMDNMSGAQDELNEVQELEKMFKIPPLFSVLKDHTLRSLVTKWLHHFCKQYEVFSPQHVLHVTPAVPFKLMHLPHVYQDLLQRYIKQKCVGCKTLLDDPALCLLCGRVCSLNWKSCCRESGCQTHAMACGAGTGVFLLIKRTTILLQRCARQAPWPSPYLDAFGEEASCLFCSCKRKKLKYLVNVCMHVQDIQIQRGKPLYLNEERYAALTYMIFYLIVHVRLLLMALIGALRFSAKLPLDPYSWSSWEDSSSSFPYGFLRHRRILNQIDIGRMTSAFLYMQRLPNRPHILGEIS

SEQ ID NO: 3678 - protein, 283 aa, Arabidopsis thaliana
  misc_feature (1)..(283): Ceres CDNA ID no. 23503210
  misc_feature (1)..(283): Also Known As Ceres GEMINI ID 5110G1
  misc_feature (214)..(254): Pfam Name: zf-C3HC4 Pfam Description: Zinc finger, C3HC4 type (RING finger)
  misc_feature 410463:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
MEDENTTIIMASLSALSPSHLTNLTHSILSISHHHRRRLGAVLSSPTLFSLTLRHLLSLSLPDKTHLIANHLLSLLHPLLIHRKHHSSYAVTMKLRDLDAVVLLLFLCETHQLHPDVLEASADNWREILGNTYSNNMLSNNSGLWTCDAGILMPYIETLVRCKRFVDIMGGYNHLRRRDQKEGYQVPAARAAVVALRAVEVFNVAASNAGEVECVICKEEMSEGRDVCEMPCQHFFHWKCILPWLSKKNTCPFCRFQLPTDDVFSEIQRLWEILVKSSELHVA

SEQ ID NO: 3679 - DNA, 831 bp, Populus balsamifera subsp. trichocarpa
  misc_feature (1)..(831): Ceres ANNOT ID no. 1455082
  misc_feature 410543:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atggaagaagaaactatcatcacggcagcactctccaccctcgcttctccccagcttacagatctcaccagctccatcctctcgcttaccctccaccatcacagccgcctctcctccctcctttgctctccctcccttttctccctcgcccttcaccatcttcactccctctccctcgctcacaaaaccctactcattgccaaatacctcctctcatccctccaccacctcacacgtcacttccatccaccaacacttattccaccacaccctaccaccaccatcaaacaccgcgatctcgacgccgcattgcttctcattttcctttgtgatgtacatcaagaaagccccgaaatacttaaaacaccacgcactggatggcgtgagggtttgaggaagcattactctaaaactgtattaaggcgatcaagcgttggggtgcattatggtggtgtcctcttaccatacgttgagatggtcataaggtgttggaggtttgttggtgtaatggctggctgtgcagtgaaggaggggagggaggtggcagcggcaccggcagcagtggtggcgcttccggcagtggaggtgagaggaggtggtggtgagtgtgtaatatgtagggaaaagatgagtggaggtagagatgtgtgtgaattgccatgtgaacacttgtttcattggatgtgcattttgccatggctaaagaagacgaatacttgcccatgttgcaggttccagcttcccactgaagatgtgttctgtgagatcgaacggctgtggagtgctctaatcaagattggtgatggggcccttagtggggaacgcacgtga

SEQ ID NO: 3680 - protein, 276 aa, Populus balsamifera subsp. trichocarpa
  misc_feature (1)..(276): Ceres ANNOT ID no. 1455082
  misc_feature (203)..(243): Pfam Name: zf-C3HC4 Pfam Description: Zinc finger, C3HC4 type (RING finger)
  misc_feature: SWISSPROT Homolog: CIP8_ARATH Ubiquitin-protein ligase CIP8 (EC 6.3.2.-) (COP1-interacting protein 8) with e-value of 5.1e-14 and BLAST sequence identity of 45.9
  misc_feature: SWISSPROT Homolog: RHA2A_ARATH RING-H2 zinc finger protein RHA2a with e-value of 2.1e-11 and BLAST sequence identity of 34.4
  misc_feature: SWISSPROT Homolog: RN126_XENTR RING finger protein 126 with e-value of 2.9e-10 and BLAST sequence identity of 34.5
  misc_feature: SWISSPROT Homolog: ZN364_MOUSE Zinc finger protein 364 (Rabring 7) with e-value of 3.6e-10 and BLAST sequence identity of 39.0
  misc_feature: SWISSPROT Homolog: R126A_XENLA RING finger protein 126-A with e-value of 9.0e-10 and BLAST sequence identity of 34.5
  misc_feature 410640:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(276): Functional Homolog of  Ceres CDNA ID no. 23503210 at SEQ ID NO. 3725 with e-value of 3.60E-68 and BLAST sequence identity of 57.6
MEEETIITAALSTLASPQLTDLTSSILSLTLHHHSRLSSLLCSPSLFSLALHHLHSLSLAHKTLLIAKYLLSSLHHLTRHFHPPTLIPPHPTTTIKHRDLDAALLLIFLCDVHQESPEILKTPRTGWREGLRKHYSKTVLRRSSVGVHYGGVLLPYVEMVIRCWRFVGVMAGCAVKEGREVAAAPAAVVALPAVEVRGGGGECVICREKMSGGRDVCELPCEHLFHWMCILPWLKKTNTCPCCRFQLPTEDVFCEIERLWSALIKIGDGALSGERT

SEQ ID NO: 3681 - protein, 479 aa, Arabidopsis thaliana
  misc_feature (1)..(479): Ceres CDNA ID no. 23503364
  misc_feature (1)..(479): Also Known As Ceres GEMINI ID 5110F5
  misc_feature 410736:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MESTRSDPELDDDFSEIYKEYTGPASAVTNNNIQDKDKPVKQRSEERCDEEEEQLPDPNSVPTDFTSREAKVWEAKSKATERNWKKRKEEEMICKICGESGHFTQGCPSTLGANRKSQEFFERVPARDNNVRVLFTEKVMESIERETSCKIKLDEKFIIVSGKDRLILRKGVDAVHKVKEDGEMKSSSVSHRSRSRSPRRTSVGPSRARNSEPQRQQLPSHGSSSFPERSGRQDKFVDNRFREETRVRENQRNVPRGSPQAYGSDRARSRSTHSKSPGRPRYSGWDKPYDRQKPEVSGYRSERWDQERMGGSSDIQVSHQFERPPFPQTLEELELEYTRDALELEKKRDKEEDEENNKHRETIRELRESYMKKLAGLRGMNAKQWDDFLQLDAQRRQQQARQQNSGLSYGNYRQFPPYAEFDDGYSSNPPPYGGNNMPMDSKGRYPNHGDNYSSRHQDNNYGGFQRQRREEYGKAYNRY

SEQ ID NO: 3682 - protein, 808 aa, Arabidopsis thaliana
  misc_feature (1)..(808): Ceres CDNA ID no. 23503971
  misc_feature (1)..(808): Also Known As Ceres GEMINI ID 5110E6
  misc_feature (10)..(38): Pfam Name: efhand Pfam Description: EF hand
  misc_feature (234)..(267): Pfam Name: TPR_1 Pfam Description: Tetratricopeptide repeat
  misc_feature (310)..(343): Pfam Name: TPR_2 Pfam Description: Tetratricopeptide repeat
  misc_feature (446)..(471): Pfam Name: TPR_4 Pfam Description: Tetratricopeptide repeat
  misc_feature 410900:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
MATRGSRSEKVKRIFQQFDGNHDGGLNREEMAALVVAVNPRVKFSDEQINAILDEVFRTYAEFIDPNKGLTYDGLLRTYDDGAGDVDRDFDALGLELNADETTIKGSEAASSSSITDERAVEAQKKQRTAAWAVSPNHGIVFDETWKLVDDLEILVKRLKSKQEKDGKLKADNNNNNVDAFSDAGWSRELGPSSEISEKRIYWEESSHDYGVFVKELGVLRSKADGARSREEAFDGHMAIGRVLYEHQLFKEALVSFKRACELQPTDVRPHFKAGNCLYVLGKCKESKDEFLLALEAAESGGNQWAYLLPQIYVNLGIALEGEGMVLSACEYYREAAILCPTHFRALKLLGSALFGVGEYRAAVKALEEAIYLKPDYADAHCDLASSLHSMGEDERAIEVFQRAIDLKPGHVDALYNLGGLYMDLGRFQRASEMYTRVLTVWPNHWRAQLNKAVSLLGAGETEEAKRALKEALKLTNRVELHDAISHLKHLQKKKGKNNGNGNGGEGPFIVVEPSKFKTVGEKTTLRPDLATALQIRAFQRVTRLGKCDVEAVRKEMRDNDVPVSYSGSGGPTKSIRKPNLEEILRRLLSSLKPDTFQGAIKAINEKILALLDDSGSGRVDMGMFYAVIAPLCGGHSDKRKRVAFDALLWRPVNEGSSQITKTDAVKYIKLLRAIYIPSHGMSEMLEVHGEEEAESSVTVTFNQFLAMFDDPDWGFGIMSTILKLEANDRNRHGNQVCSVCRYPVIGSRFKEVKARFSLCNQCYGEGKVPPSFKQEEYKFREYESEAEAMKAKCVCFSMQSHKKAIAT

SEQ ID NO: 3683 - DNA, 2394 bp, Populus balsamifera subsp. trichocarpa
  misc_feature (1)..(2394): Ceres ANNOT ID no. 1452812
  misc_feature 411079:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atgacgacaagagggactagatcagagaaagtgaagaggattttccaacaatttgatgccaatcgtgatggaggtctcagcagagatgaaatggcagctttggtggtggctgtgaaccctagagttaaatttagtgacgagcaaatcaatgcgattcttgacgaagttttccgcacgtacggagagtttattgatggcgacaaagggttaacctatgatggtttattgcgtacctatgatgatggagctggtgacgtggaccgtgattttgatgcgcttgaattggaattgaatgatgataataaagggagcacgatcgaggcggaggcgtcgtcgtcgtcaattgtggatgagagggttatagagtcgcagaagaagcagaggactgctgcgtgggcggtttcgcctaatcacgggattgtttttgatgatacgtggaaaattgttgatgatttggagattttgattaagagattgaaagcgaagcaagctaaagatgggaaatttaaagctgataattttgatgcgttttctgatgctgggtggtcaagggaattggggccatcttcggagatctcggaaaagagggtgttttgggaagagtctgggaatgattacgcggctttcgtgagagaattgggggctttgaggagcagagctgacggggcgagatcgagagaagaggcatttgatgggcatatggcaattgggagggttttgtacgatcatcagttgtttaaggaggcgttggttagttttaagagagcttgtgagttgcagcctgtggatgttaggccacactttagagctgggaattgtttatatgtgcttggaaggtataaagaggctaaagaggagtttttgttggcgttggaggcagcagaggcaggtgggaatcaatggggttatttgcttccccagatttatgtgaatctcgggattgcgctggaaggtgaaggtatggttttaagtgcttgtgagtattatagagaagctgctattctctgcccaacccattttagagctttgaaacttttaggtagtgctctgtttggggtaggggaatataaggctgctgttaaggccttagaagaggctatctttatgaaaccagattatgctgatgctcattgtgatttagcttctgctttacatgccatgggtgaggatgagaaggcaatagaggtgtttcaaaaggcaattgatttgaaacctggccatgtggatgctttgtataatttaggtgggctgtacatggatctgggtaggtttcaaagagcttccgagatgtatactagggttttagctgtctggccaaaccactggcgggcacaacttaataaggctgtctcgttgttgggggctggggagactgaggaagctaagaaagctttgaaggaagcattgaaattgacaaatagggttgaattgcatgatgcaatatctcatttgaagcagatacagaagaagaaagtgaagggtaatgaaggtgccaatggggagggagtgtttgtcattgtggaaccttcaaaatttaagacggtgaatggcaaaactacattgaggcaggacttagctattgctcttcaaatcagggtgtttcagaggattaccaggttaagtcgatgtgatgtggaacttttgaagaaggaaatgagtgaaaatgatgtaccaatgtcttattctggtggtggtgttcctgagaaatcaatacgcaaacctaacttagaggaaattctgcggcggttgcttaatttcctgaagcctgaaaccttccagggggctgtcaaggtaataaacgagaagatcctctctgttttggacgatacaggctcaggcagggtggatttaggtatgatctatgccgttcttgctcccatttgcagtggcactcctgataagcgaaaaagggttgcttttgatgcacttttatggcgtcctgtgaatgaaggtggttcacagattaaaagggctgatgctgttcattacatcaatttactgagggctatttatattccttctcatggggttagtgaaatgctagagcttcatggagaagaagattcttcaatggtgtctttcaaggagtttcttgtgatgttcgatgatcctgattggggctttggtattatgtcaactctggtgaagctcgaatctggggacaggaaccgccatggaaattgtgtttgctcagtttgccgctacccaattattgggtcccgcttcaaggagataaaatctcattttagtctatgtagccagtgttacagcgaggggaaggtgtctcctgcatttaagcaggatgattacaaattcaaagagtatggaagtgaggctgaagcgatgaaagataagtgcacatgtctccctttgcaatctcgtaatgatcggtaa

SEQ ID NO: 3684 - protein, 797 aa, Populus balsamifera subsp. trichocarpa
  misc_feature (1)..(797): Ceres ANNOT ID no. 1452812
  misc_feature (10)..(38): Pfam Name: efhand Pfam Description: EF hand
  misc_feature (306)..(339): Pfam Name: TPR_2 Pfam Description: Tetratricopeptide repeat
  misc_feature (442)..(471): Pfam Name: TPR_1 Pfam Description: Tetratricopeptide repeat
  misc_feature: SWISSPROT Homolog: OGT1_RAT UDP-N-acetylglucosamine--peptide N-acetylglucosaminyltransferase A 110 kDa subunit (EC 2.4.1.-) (O-GlcNAc transferase p110 subunit) with e-value of 1.7e-17 and BLAST sequence identity of 29.7
  misc_feature: SWISSPROT Homolog: OGT1_HUMAN UDP-N-acetylglucosamine--peptide N-acetylglucosaminyltransferase A 110 kDa subunit (EC 2.4.1.-) (O-GlcNAc transferase p110 subunit) with e-value of 2.2e-17 and BLAST sequence identity of 29.7
  misc_feature: SWISSPROT Homolog: OGT1_CAEEL UDP-N-acetylglucosamine--peptide N-acetylglucosaminyltransferase (EC 2.4.1.-) (O-GlcNAc) (OGT) with e-value of 1.9e-16 and BLAST sequence identity of 26.1
  misc_feature: SWISSPROT Homolog: SEC_ARATH Probable UDP-N-acetylglucosamine--peptide N- acetylglucosaminyltransferase SEC with e-value of 1.8e-11 and BLAST sequence identity of 26.2
  misc_feature: SWISSPROT Homolog: SEC_ARATH EC 2.4.1.- (Protein SECRET AGENT)
  misc_feature: SWISSPROT Homolog: Y941_METJA Hypothetical protein MJ0941 with e-value of 1.0e-09 and BLAST sequence identity of 27.2
  misc_feature 411249:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(797): Functional Homolog of  Ceres CDNA ID no. 23503971 at SEQ ID NO. 3729 with e-value of 0.0 and BLAST sequence identity of 83.7
MTTRGTRSEKVKRIFQQFDANRDGGLSRDEMAALVVAVNPRVKFSDEQINAILDEVFRTYGEFIDGDKGLTYDGLLRTYDDGAGDVDRDFDALELELNDDNKGSTIEAEASSSSIVDERVIESQKKQRTAAWAVSPNHGIVFDDTWKIVDDLEILIKRLKAKQAKDGKFKADNFDAFSDAGWSRELGPSSEISEKRVFWEESGNDYAAFVRELGALRSRADGARSREEAFDGHMAIGRVLYDHQLFKEALVSFKRACELQPVDVRPHFRAGNCLYVLGRYKEAKEEFLLALEAAEAGGNQWGYLLPQIYVNLGIALEGEGMVLSACEYYREAAILCPTHFRALKLLGSALFGVGEYKAAVKALEEAIFMKPDYADAHCDLASALHAMGEDEKAIEVFQKAIDLKPGHVDALYNLGGLYMDLGRFQRASEMYTRVLAVWPNHWRAQLNKAVSLLGAGETEEAKKALKEALKLTNRVELHDAISHLKQIQKKKVKGNEGANGEGVFVIVEPSKFKTVNGKTTLRQDLAIALQIRVFQRITRLSRCDVELLKKEMSENDVPMSYSGGGVPEKSIRKPNLEEILRRLLNFLKPETFQGAVKVINEKILSVLDDTGSGRVDLGMIYAVLAPICSGTPDKRKRVAFDALLWRPVNEGGSQIKRADAVHYINLLRAIYIPSHGVSEMLELHGEEDSSMVSFKEFLVMFDDPDWGFGIMSTLVKLESGDRNRHGNCVCSVCRYPIIGSRFKEIKSHFSLCSQCYSEGKVSPAFKQDDYKFKEYGSEAEAMKDKCTCLPLQSRNDR

SEQ ID NO: 3685 - DNA, 2394 bp, Populus balsamifera subsp. trichocarpa
  misc_feature (1)..(2394): Ceres ANNOT ID no. 1442627
  misc_feature 411433:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atgacgacgagagggactagatcagagaaagtgaagagaattttccaacaatttgacgggaaccgggatggaggtctcaacagagatgaaatggcagctttggtggtggctgtaaatcctagagttaaattcagtgaggagcaaatcaatgcgattcttgacgaagttttccgcacttacggagagtttattgatggggagaaagggttaacgtatgatggtttgttgcgtacttatgatgatggagctggtgacgtggaccgtgattttgatgcgcttgagttggagctgaatggtgataataaagggagctcgatcgaggtggaggcgtcgtcgtcgtcaattgtggatgagagggttattgagtcgcagaagaagcagaggacggctgattgggcggtgtcgccaaatcacgggattgtttttgatgacacgtggaaaattgtggatgatttggagattttgattaagagattgaaagcgaagcaggcgaaagatgggaaatataaagctgataattttgatgcgttttcagatgctgggtggtcgagggaattggggccatcttcggagatctcggataagagggtgttttgggaagagtccgggagtgattatgcactttttgtgaaagaattgggggttttgaggagcagagctgatggagcgagatcaagagaagaggcatttgatgggcatatggcaattggaagggttttgtatgatcatcagttgttcaaggaggcgttggttagttttaagagagcttgtgagttgcagccggtggatgttaggccacattttagagctgggaattgtttatatgtgcttggaaagtataaagaggctaaagaggagtttttgttggccttggaggcagcggaggcaggtgggaatcaatggggttatttgcttcctcagatttatgtaaatctcgggattgcgctggaaggtgaaggcatggttttaagtgcttgtgagtattatagagaagctgctattctttgtccaactcattttagagctctgaaacttttgggtagtgctctttttggggtaggggaatataaggctgctgttaaggccttggaagaggctatttttatgaaaccagactttgctgatgctcattgtgatttagcctctgctttacatgccatgggtgacgatgagaaggcaatagaggtgtttcaaaaggcaattgatttgaaacctggccatgtggatgctttgtataatttaggcgggctgtacatggatctgggtaggtttcagagagcttctgagatgtataccagggttttagctgtctggccaaaccactggcgggctcagcttaatagggctgtctcgttgttgggggctggggagacagaggaagctaagaaagctttgaaggaagcattgaaattgacaaatagggttgaattgcatgatgcaatatcacatttgaagcagatacagaagaagaaagtaaagggcaatgggggtgccaatggggagggagtgtttgtcattgtagaaccttcaaaatttaagagactgaatgacaaaactacattgaggcaggatttagctaatgctcttcaaatcagggcgtttcagaggattaccaggttgagtcgatgtgacgtggagcttttgaagaaggaaatgagtgaaaatgatgtaccagtatcttattctggtggcggtgttcctgagaaatcaatacgcaaacctaacttagaggaagttttgaggcggttgcttaattttctgaagcctgaaaccttccagggggctgtcaaggccataaatgagaggatcctctctgtttttgatgagacaggccaaggcagggtggatttaggcatgttctatgccattcttgcccccatttgcagtggcaatcctgaaaagcgaaaacgggttgcttttgatgcactcttatggcgtcctgtgagtgaaagtggttctcagattaaggcggctgatgctgtcactttcatcaagtttctgagggctatttatgttccctctcacggagttagtgaaatgctagaggttcatggagaagcagattcttcaatggtgtctttcaaggagtttcttgtgatgttcgatgatcctgattggggctttggtattatgtcaactctgatgaagctcgaatctggggataggaaccgtcatggacactatgtttgctctgtttgccgctacccgattattggttcccgcttcaaggagataaaatctcattttagtctatgtaaccagtgctacagtgaggggaaggtgcctcccgcatttaagcaggatgagtacatattcaaagagtatggaagtgaggctgaagcaatgaaagataagtgcacctgtctccctttgcaatctcacaatgatcggtaa

SEQ ID NO: 3686 - protein, 797 aa, Populus balsamifera subsp. trichocarpa
  misc_feature (1)..(797): Ceres ANNOT ID no. 1442627
  misc_feature (10)..(38): Pfam Name: efhand Pfam Description: EF hand
  misc_feature (306)..(339): Pfam Name: TPR_2 Pfam Description: Tetratricopeptide repeat
  misc_feature (340)..(373): Pfam Name: TPR_2 Pfam Description: Tetratricopeptide repeat
  misc_feature (442)..(471): Pfam Name: TPR_1 Pfam Description: Tetratricopeptide repeat
  misc_feature: SWISSPROT Homolog: OGT1_RAT UDP-N-acetylglucosamine--peptide N-acetylglucosaminyltransferase A 110 kDa subunit (EC 2.4.1.-) (O-GlcNAc transferase p110 subunit) with e-value of 1.7e-17 and BLAST sequence identity of 29.7
  misc_feature: SWISSPROT Homolog: OGT1_HUMAN UDP-N-acetylglucosamine--peptide N-acetylglucosaminyltransferase A 110 kDa subunit (EC 2.4.1.-) (O-GlcNAc transferase p110 subunit) with e-value of 2.2e-17 and BLAST sequence identity of 29.7
  misc_feature: SWISSPROT Homolog: OGT1_CAEEL UDP-N-acetylglucosamine--peptide N-acetylglucosaminyltransferase (EC 2.4.1.-) (O-GlcNAc) (OGT) with e-value of 1.9e-16 and BLAST sequence identity of 26.1
  misc_feature: SWISSPROT Homolog: SEC_ARATH Probable UDP-N-acetylglucosamine--peptide N- acetylglucosaminyltransferase SEC with e-value of 1.8e-11 and BLAST sequence identity of 26.2
  misc_feature: SWISSPROT Homolog: SEC_ARATH EC 2.4.1.- (Protein SECRET AGENT)
  misc_feature: SWISSPROT Homolog: Y941_METJA Hypothetical protein MJ0941 with e-value of 1.0e-09 and BLAST sequence identity of 27.2
  misc_feature 411608:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(797): Functional Homolog of  Ceres CDNA ID no. 23503971 at SEQ ID NO. 3729 with e-value of 0.0 and BLAST sequence identity of 81.9
MTTRGTRSEKVKRIFQQFDGNRDGGLNRDEMAALVVAVNPRVKFSEEQINAILDEVFRTYGEFIDGEKGLTYDGLLRTYDDGAGDVDRDFDALELELNGDNKGSSIEVEASSSSIVDERVIESQKKQRTADWAVSPNHGIVFDDTWKIVDDLEILIKRLKAKQAKDGKYKADNFDAFSDAGWSRELGPSSEISDKRVFWEESGSDYALFVKELGVLRSRADGARSREEAFDGHMAIGRVLYDHQLFKEALVSFKRACELQPVDVRPHFRAGNCLYVLGKYKEAKEEFLLALEAAEAGGNQWGYLLPQIYVNLGIALEGEGMVLSACEYYREAAILCPTHFRALKLLGSALFGVGEYKAAVKALEEAIFMKPDFADAHCDLASALHAMGDDEKAIEVFQKAIDLKPGHVDALYNLGGLYMDLGRFQRASEMYTRVLAVWPNHWRAQLNRAVSLLGAGETEEAKKALKEALKLTNRVELHDAISHLKQIQKKKVKGNGGANGEGVFVIVEPSKFKRLNDKTTLRQDLANALQIRAFQRITRLSRCDVELLKKEMSENDVPVSYSGGGVPEKSIRKPNLEEVLRRLLNFLKPETFQGAVKAINERILSVFDETGQGRVDLGMFYAILAPICSGNPEKRKRVAFDALLWRPVSESGSQIKAADAVTFIKFLRAIYVPSHGVSEMLEVHGEADSSMVSFKEFLVMFDDPDWGFGIMSTLMKLESGDRNRHGHYVCSVCRYPIIGSRFKEIKSHFSLCNQCYSEGKVPPAFKQDEYIFKEYGSEAEAMKDKCTCLPLQSHNDR

SEQ ID NO: 3687 - protein, 537 aa, Arabidopsis thaliana
  misc_feature (1)..(537): CDNA ID no. 23505103
  misc_feature (64)..(514): Pfam Name: p450 Pfam Description: Cytochrome P450
  misc_feature: Phenotype: INFLORESCENCE - Corkscrew Appearance Useful for making ornamental plants with modified flowers
  misc_feature: Phenotype: WHOLE PLANT - Dark Green Useful for increasing chlorophyll and photosynthetic capacity
  misc_feature: Phenotype: WHOLE PLANT - Late Senescence Useful for delaying senescence
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: SILIQUES - Clubbed Useful for modifying fruit shape, composition and seed yield
  misc_feature: Phenotype: INFLORESCENCE - Long Internode Useful for making taller plants and plants with longer flowers
  misc_feature: Phenotype: INFLORESCENCE - Other Useful for making ornamental plants with modified flowers
MTIDMYLSFASRSGSSPFPSLELCLSIFLFISLFVFWLTPGGFAWALYKARFHTRPESKTGPAIPGPSGLPIFGLLLAFVNNALTHRILANIADTCKAKALMAFSVGSTRFVITSEPETAKELLNSSAFADRPVKESAYELLFDRAMGFAPFGDYWRELRRISSTHLFSPKRIFSSGESRRKIGQNMVGEIKNAMECYGEVHIKKILHFGSLNNVMSSVFGKTYNFNEGIVYSKESNELEHLVSEGYELLGIFNWSDHFPGMRWLDLQGVRRRCRSLVGRVNVFVGKIINDHKSKRSLRDNPEESTYDDDFVDVLLGMHGNSKLSDSDMIAVLWEMIFRGTDTVAILLEWILARMVLHPDIQAKAQAEIDCIVGDSGRQVTDSDLPKLPYVRAIVKETLRMHPPGPLLSWARLSIHDTQIGTHFIPAGTTAMVNMWAITHDEKVWPEAHEYKPERFLGAQESNNFPIMGSDLRLAPFGAGRRVCPGKSMGLATVELWLAQLLGSYKWVSCGEVDLSETLKLSLEMKNTLVCKAIPRG

SEQ ID NO: 3688 - DNA, 1596 bp, Populus balsamifera subsp. trichocarpa
  misc_feature (1)..(1596): ANNOT ID no. 1447690
atggaaacacaaatagacagcttttgggtattggctctagtttccaaatgcaaagccttttcctctcaagaccccatcttccttcttctttctcttttcttggcttggctagccattgctttgtgctactgggtttaccctggaggccccgcctggggcaaatattggctcaaaagagcaacctgctcgaaagccaagatgattccgggacctagagggtttccagtgataggaagcatgaacctcatggtaaacttggctcaccacaagcttgctgctgcagccaagactcttaaagcaaaaagactcatggcttttagcatgggagagactagggttattatcacatgcaatcctgatgtagccaaagacatcttgaacagttcagtatttgctgatcgtccagttaaagagtctgcctatcagctcatgtttaatagagctattggttttgctccctatggggtttattggagaactctaaggagaattgcagcaacccatcttctttgtcctaaacaaatcagctctacagagccacagagactcgatattgcttctcaaatggtatcagtaatggcatgtcaaggtggagattactttcgtgttcgagacatactgaggaaagcttcactgaacaacatgatgtgctcagtttttggtcgtaaatatgatctaggcacatcaaataatgaaattgaggaacttggaggacttgttgatgaaggttatgatcttctagggaagcttaactggtctgatcatctaccttggcttgcaaatttcgaccttcaaaaaatcaggttcaggtgctccaatttggttcctaaagtgaaccggtttgtgaaccgggttattcaagaacatagagaggaccaaagtggccaaagaagaaatgactttgttgatgttctgctctctcttcatggaccggacaagttatcagaccatgacatggttgctgttctttgggagatgatttttagaggaacagatacagtggcagttctgatagagtggatactagccaggatgatacttcaccctgatatccaatcaaaggtgcatgatgagcttgatcaagttgcgggaagatcaaggccgttgatggaagcagacatacgatcaatggtttacctgccggcggttgtgaaagaggttctaaggttacacccaccggggccactcttgtcatgggcgcgtttagcaatcacggacactgatgttgatggatatgatgtgccagcggggaccacagctatggttaatatgtgggccataacaagggacccgcaagtttgggtggacccactaaagttctcgccagagagatttttgagcaaggaagtcactgctgacgtggagttctctgtgtcagggtctgacctcaggctggctccattcgggtcgggtcgtaggacttgcccgggaaggacactgggtttggccaccgttagcttctgggttgggagtttgttgcatgagtttgagtgggcgcggtgtggccatgagccggtggacctctctgaagtgttgaggttgtcttgtgaaatggccaaaccactcacagtcaaggtgaatccgaggagaagataa

SEQ ID NO: 3689 - protein, 531 aa, Populus balsamifera subsp. trichocarpa
  misc_feature (1)..(531): ANNOT ID no. 1447690
  misc_feature (68)..(526): Pfam Name: p450 Pfam Description: Cytochrome P450
  misc_feature: SWISSPROT Homolog: C78A4_PINRA Cytochrome P450 78A4 (EC 1.14.-.-) with e-value of 1.1e-131 and BLAST sequence identity of 50.9
  misc_feature: SWISSPROT Homolog: C78A3_SOYBN Cytochrome P450 78A3 (EC 1.14.-.-) with e-value of 3.6e-126 and BLAST sequence identity of 52.6
  misc_feature: SWISSPROT Homolog: C78AB_ORYSA Cytochrome P450 78A11 (EC 1.14.-.-) (PLASTOCHRON1 protein) with e-value of 7.1e-121 and BLAST sequence identity of 47.8
  misc_feature: SWISSPROT Homolog: C78A1_MAIZE Cytochrome P450 78A1 (EC 1.14.-.-) (CYPLXXVIII) with e-value of 1.5e-119 and BLAST sequence identity of 51.9
  misc_feature: SWISSPROT Homolog: C76C2_ARATH Cytochrome P450 76C2 (EC 1.14.-.-) with e-value of 1.9e-65 and BLAST sequence identity of 34.3
  misc_feature (1)..(531): Functional Homolog of  CDNA ID no. 23505103 at SEQ ID NO. 3734 with e-value of 1.89E-135 and BLAST sequence identity of 53.8
METQIDSFWVLALVSKCKAFSSQDPIFLLLSLFLAWLAIALCYWVYPGGPAWGKYWLKRATCSKAKMIPGPRGFPVIGSMNLMVNLAHHKLAAAAKTLKAKRLMAFSMGETRVIITCNPDVAKDILNSSVFADRPVKESAYQLMFNRAIGFAPYGVYWRTLRRIAATHLLCPKQISSTEPQRLDIASQMVSVMACQGGDYFRVRDILRKASLNNMMCSVFGRKYDLGTSNNEIEELGGLVDEGYDLLGKLNWSDHLPWLANFDLQKIRFRCSNLVPKVNRFVNRVIQEHREDQSGQRRNDFVDVLLSLHGPDKLSDHDMVAVLWEMIFRGTDTVAVLIEWILARMILHPDIQSKVHDELDQVAGRSRPLMEADIRSMVYLPAVVKEVLRLHPPGPLLSWARLAITDTDVDGYDVPAGTTAMVNMWAITRDPQVWVDPLKFSPERFLSKEVTADVEFSVSGSDLRLAPFGSGRRTCPGRTLGLATVSFWVGSLLHEFEWARCGHEPVDLSEVLRLSCEMAKPLTVKVNPRRR

SEQ ID NO: 3690 - DNA, 1599 bp, Populus balsamifera subsp. trichocarpa
  misc_feature (1)..(1599): ANNOT ID no. 1491278
atggaaacacaaatagacagcttttgggtattggtccttgtttccaaatgcaaagccttttctgctcaaaaccccatcttccttcttgtttctgttttcctggcctggctagccatggctttgtgttactgggtgtaccctggaggccctgcctggggtaattatttgcgcaagaaaggaattagctgttcaagagccaagatgattccagggcctagagggtttccagtgataggaagcatgaacctcatggttaacttggctcaccacaagcttgctgctgcagcgaaggcttttaaagcagaaagacttatggcttttagcttgggagagactaaggtcattatcacatgcaatcctgatgtagccaaagaaatcttgaacagttcagtctttgctgatcgtccagttaaagagtctgcctatcaactcatgtttaatagagctattggttttgctccttatggggtttactggagaactctaaggagaattgcagcaactcatcttttttgtcctaaacaaatcagctctactgagtcgcaaagattcaatattgcttctcaaatggtatccgcaatagcaagtcaaggtggagattacttttgtgttcgaggcatactaaagaaagcttcactcaacaacatgatgtgctcagtttttggtcgtaaatatgatctgggctcatcaaatagtgaaactgaagagcttagaaggcttgttgatgaaggttatgatcttctagggaaacttaattggtctgatcatcttccttggcttgcaaatttagaccttcaaagaatcaggtttaggtgctccaatttggttcctaaagtgaaccggtttgtgaaccgggttattgaagaacatagagaggaccagactggccaaagaagaaatgactttgtcgatgttttactctctcttcatggaccggacaagttatcacaccatgatatgattgccgttctctgggagatgatttttagaggaacagataccgtggcagttttgatagagtggatactagcaaggatggtacttcaccgtgatatccaatcaaaggtgcatgatgagctcgatcaagttgtgggaagatcaaggccgttgatggaagcagacattcagtcaatggtttacctgcctgcagttgtgaaagaagttctgaggttgcacccaccaggcccactactgtcgtgggcccgtttagcaatcacggacactaatgtggatggatatgatgttccagcagggaccacagctatggttaatatgtgggccataacaagggacccacaagtttgggcgaaccctctaaggttcttgccagagagatttttgtgcaaggatgctactgctgacgtggaattctctgtgtccgggtctgaccttaagctggctccgtttgggtcgggtcggaggacttgcccgggaaaggctctgggtttggccacggttagcttttgggtcggggttttgttgcacgagttcgagtgggtgcaatgtgatcatgagccggtggatctctcagaagtgctaaggttatcttgtgagatgtctaacccacttacaatcaaagtgaatccaaggagaagatga

SEQ ID NO: 3691 - protein, 532 aa, Populus balsamifera subsp. trichocarpa
  misc_feature (1)..(532): ANNOT ID no. 1491278
  misc_feature (69)..(529): Pfam Name: p450 Pfam Description: Cytochrome P450
  misc_feature: SWISSPROT Homolog: C78A4_PINRA Cytochrome P450 78A4 (EC 1.14.-.-) with e-value of 1.1e-131 and BLAST sequence identity of 50.9
  misc_feature: SWISSPROT Homolog: C78A3_SOYBN Cytochrome P450 78A3 (EC 1.14.-.-) with e-value of 3.6e-126 and BLAST sequence identity of 52.6
  misc_feature: SWISSPROT Homolog: C78AB_ORYSA Cytochrome P450 78A11 (EC 1.14.-.-) (PLASTOCHRON1 protein) with e-value of 7.1e-121 and BLAST sequence identity of 47.8
  misc_feature: SWISSPROT Homolog: C78A1_MAIZE Cytochrome P450 78A1 (EC 1.14.-.-) (CYPLXXVIII) with e-value of 1.5e-119 and BLAST sequence identity of 51.9
  misc_feature: SWISSPROT Homolog: C76C2_ARATH Cytochrome P450 76C2 (EC 1.14.-.-) with e-value of 1.9e-65 and BLAST sequence identity of 34.3
  misc_feature (1)..(532): Functional Homolog of  CDNA ID no. 23505103 at SEQ ID NO. 3734 with e-value of 1.09E-132 and BLAST sequence identity of 54.1
METQIDSFWVLVLVSKCKAFSAQNPIFLLVSVFLAWLAMALCYWVYPGGPAWGNYLRKKGISCSRAKMIPGPRGFPVIGSMNLMVNLAHHKLAAAAKAFKAERLMAFSLGETKVIITCNPDVAKEILNSSVFADRPVKESAYQLMFNRAIGFAPYGVYWRTLRRIAATHLFCPKQISSTESQRFNIASQMVSAIASQGGDYFCVRGILKKASLNNMMCSVFGRKYDLGSSNSETEELRRLVDEGYDLLGKLNWSDHLPWLANLDLQRIRFRCSNLVPKVNRFVNRVIEEHREDQTGQRRNDFVDVLLSLHGPDKLSHHDMIAVLWEMIFRGTDTVAVLIEWILARMVLHRDIQSKVHDELDQVVGRSRPLMEADIQSMVYLPAVVKEVLRLHPPGPLLSWARLAITDTNVDGYDVPAGTTAMVNMWAITRDPQVWANPLRFLPERFLCKDATADVEFSVSGSDLKLAPFGSGRRTCPGKALGLATVSFWVGVLLHEFEWVQCDHEPVDLSEVLRLSCEMSNPLTIKVNPRRR

SEQ ID NO: 3692 - DNA, 1560 bp, Populus balsamifera subsp. trichocarpa; identical to SEQ ID NO: 3300
  misc_feature (1)..(1560): ANNOT ID no. 1500987

SEQ ID NO: 3693 - protein, 519 aa, Populus balsamifera subsp. trichocarpa; identical to SEQ ID NO: 3301
  misc_feature (1)..(519): ANNOT ID no. 1500987
  misc_feature (64)..(509): Pfam Name: p450 Pfam Description: Cytochrome P450
  misc_feature: SWISSPROT Homolog: C78A4_PINRA Cytochrome P450 78A4 (EC 1.14.-.-) with e-value of 1.1e-131 and BLAST sequence identity of 50.9
  misc_feature: SWISSPROT Homolog: C78A3_SOYBN Cytochrome P450 78A3 (EC 1.14.-.-) with e-value of 3.6e-126 and BLAST sequence identity of 52.6
  misc_feature: SWISSPROT Homolog: C78AB_ORYSA Cytochrome P450 78A11 (EC 1.14.-.-) (PLASTOCHRON1 protein) with e-value of 7.1e-121 and BLAST sequence identity of 47.8
  misc_feature: SWISSPROT Homolog: C78A1_MAIZE Cytochrome P450 78A1 (EC 1.14.-.-) (CYPLXXVIII) with e-value of 1.5e-119 and BLAST sequence identity of 51.9
  misc_feature: SWISSPROT Homolog: C76C2_ARATH Cytochrome P450 76C2 (EC 1.14.-.-) with e-value of 1.9e-65 and BLAST sequence identity of 34.3
  misc_feature (1)..(519): Functional Homolog of  CDNA ID no. 23505103 at SEQ ID NO. 3734 with e-value of 1.69E-132 and BLAST sequence identity of 54.1

SEQ ID NO: 3694 - DNA, 1572 bp, Populus balsamifera subsp. trichocarpa; identical to SEQ ID NO: 3302
  misc_feature (1)..(1572): ANNOT ID no. 1490915

SEQ ID NO: 3695 - protein, 522 aa, Populus balsamifera subsp. trichocarpa; identical to SEQ ID NO: 3303
  misc_feature (1)..(522): ANNOT ID no. 1490915
  misc_feature (63)..(508): Pfam Name: p450 Pfam Description: Cytochrome P450
  misc_feature: SWISSPROT Homolog: C78A4_PINRA Cytochrome P450 78A4 (EC 1.14.-.-) with e-value of 1.1e-131 and BLAST sequence identity of 50.9
  misc_feature: SWISSPROT Homolog: C78A3_SOYBN Cytochrome P450 78A3 (EC 1.14.-.-) with e-value of 3.6e-126 and BLAST sequence identity of 52.6
  misc_feature: SWISSPROT Homolog: C78AB_ORYSA Cytochrome P450 78A11 (EC 1.14.-.-) (PLASTOCHRON1 protein) with e-value of 7.1e-121 and BLAST sequence identity of 47.8
  misc_feature: SWISSPROT Homolog: C78A1_MAIZE Cytochrome P450 78A1 (EC 1.14.-.-) (CYPLXXVIII) with e-value of 1.5e-119 and BLAST sequence identity of 51.9
  misc_feature: SWISSPROT Homolog: C76C2_ARATH Cytochrome P450 76C2 (EC 1.14.-.-) with e-value of 1.9e-65 and BLAST sequence identity of 34.3
  misc_feature (1)..(522): Functional Homolog of  CDNA ID no. 23505103 at SEQ ID NO. 3734 with e-value of 9.60E-132 and BLAST sequence identity of 54.4

SEQ ID NO: 3696 - protein, 280 aa, Arabidopsis thaliana
  misc_feature (1)..(280): Ceres CDNA ID no. 23505182
  misc_feature (48)..(248): Pfam Name: Lactamase_B Pfam Description: Metallo-beta-lactamase superfamily
  misc_feature: Phenotype: WHOLE PLANT - Early Senescence Useful for modulating crop development and harvest
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: INFLORESCENCE - Weak Useful for making stronger plants
MEKKKAMQIEGYPIEGLSIGGHETCIIFPSLRIAFDIGRCPHRAISQDFLFISHSHMDHIGGLPMYVATRGLYKMKPPTIIVPASIKETVESLFEVHRKLDSSELKHNLVGLDIGEEFIIRKDLKVKAFKTFHVIQSQGYVVYSTKYKLKKEYIGLSGNEIKNLKVSGVEITDSIITPEVAFTGDTTSDFVVDETNADALKAKVLVMESTFLDDSVSVEHARDYGHIHISEIVNHAEKFENKAILLIHFSARYTVKEIEDAVSALPPPLEGRVFALTQGF

SEQ ID NO: 3697 - DNA, 1101 bp, Populus balsamifera subsp. trichocarpa
  misc_feature (1)..(1101): Ceres ANNOT ID no. 1525474
  misc_feature 413025:<222: Transcription Factor
  misc_feature: Phenotype: WHOLE PLANT - Early Senescence Useful for modulating crop development and harvest
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: INFLORESCENCE - Weak Useful for making stronger plants
atgcaaatctctatccctttattctcttcacctcccaatcctaaaatcccatcacttttcccttttcagcacctccccagtattttccatggaaaaggaaaacctacaacattaacaacccgtaattttcatttcctccctctcaaaattaaaaacaagcccttcatcgtcaaagcctccagctttttatcagaaatcgggcgtgctattgaggaagaagaagactacagaaaggcccgtgctgctgttatccgtaaaggaattgacttgggagggtatgcaattgagggtctgtccattggaggccaagagacttgtataattataccagagtttaagtgtgcttttgatattgggaggtgccccaccagagctattcaccagaattttgtcttcatcactcatgcccatcttgatcacattggtgggctgccaatgtatgtggctagtcgtggtttgtacagcttaaagcctccaacaatatttgttcctccgtgtatcaaagacgatgttgagaaactatttgacattcacagggcaatggggcaagtagagcttaattttgatttggttgcattggatgtgggtgaaacatatgaattgcggaatgatgttgtggtccgaccattcagaactcaacatgttatacccagtcagggttatgtcatctattcggtgaggaaaaaattgaagaaacaatacattcatctcaaaggaaaacaaatagagaaattgaagaagtctggtgttgagattacagacataatattgtcccctgaggtggcctttactggagataccacagcagagtacatgcttgatccgcgtaatgcagatgcgttgagggcaaaagttctaataactgaggcaactttcctggatgaagattttaccactgagcatgcacgacagcgtggtcatacccatttgtttgagattattgaaaatgccaaatggatccggagtaaagcaatcttgttgactcatttctcctcccgctacagtatagaggacatacgtgaagctgtgtcgaagttgcaatccagggtgtcagcaaaagtagttcctctgacagaaggtttcaaatcaatgtactcatag

SEQ ID NO: 3698 - protein, 366 aa, Populus balsamifera subsp. trichocarpa
  misc_feature (1)..(366): Ceres ANNOT ID no. 1525474
  misc_feature (131)..(145): Pfam Name: Lactamase_B Pfam Description: Metallo-beta-lactamase superfamily
  misc_feature: SWISSPROT Homolog: RNZN_ARATH Nuclear ribonuclease Z (EC 3.1.26.11) (RNase Z) (tRNase Z) (tRNA 3 endonuclease) (Zinc phosphodiesterase NUZ) with e-value of 9.9e-147 and BLAST sequence identity of 100.0
  misc_feature: SWISSPROT Homolog: RNZC_ARATH Ribonuclease Z, chloroplast precursor (EC 3.1.26.11) (RNase Z) (tRNase Z) (tRNA 3 endonuclease) (Zinc phosphodiesterase CPZ) with e-value of 4.1e-86 and BLAST sequence identity of 56.3
  misc_feature: SWISSPROT Homolog: RNZN_WHEAT Nuclear ribonuclease Z (EC 3.1.26.11) (RNase Z) (tRNase Z) (tRNA 3 endonuclease) (Zinc phosphodiesterase ELAC) (Fragment) with e-value of 3.8e-67 and BLAST sequence identity of 69.2
  misc_feature: SWISSPROT Homolog: RNZ_SULTO Ribonuclease Z (EC 3.1.26.11) (RNase Z) (tRNase Z) (tRNA 3 endonuclease) with e-value of 7.3e-14 and BLAST sequence identity of 29.9
  misc_feature: SWISSPROT Homolog: RNZ_SULAC Ribonuclease Z (EC 3.1.26.11) (RNase Z) (tRNase Z) (tRNA 3 endonuclease) with e-value of 3.4e-12 and BLAST sequence identity of 30.6
  misc_feature 413155:<222: Transcription Factor
  misc_feature: Phenotype: WHOLE PLANT - Early Senescence Useful for modulating crop development and harvest
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: INFLORESCENCE - Weak Useful for making stronger plants
  misc_feature (1)..(366): Functional Homolog of  Ceres CDNA ID no. 23505182 at SEQ ID NO. 3743 with e-value of 5.59E-88 and BLAST sequence identity of 58.1
MQISIPLFSSPPNPKIPSLFPFQHLPSIFHGKGKPTTLTTRNFHFLPLKIKNKPFIVKASSFLSEIGRAIEEEEDYRKARAAVIRKGIDLGGYAIEGLSIGGQETCIIIPEFKCAFDIGRCPTRAIHQNFVFITHAHLDHIGGLPMYVASRGLYSLKPPTIFVPPCIKDDVEKLFDIHRAMGQVELNFDLVALDVGETYELRNDVVVRPFRTQHVIPSQGYVIYSVRKKLKKQYIHLKGKQIEKLKKSGVEITDIILSPEVAFTGDTTAEYMLDPRNADALRAKVLITEATFLDEDFTTEHARQRGHTHLFEIIENAKWIRSKAILLTHFSSRYSIEDIREAVSKLQSRVSAKVVPLTEGFKSMYS

SEQ ID NO: 3699 - protein, 524 aa, Arabidopsis thaliana
  misc_feature (1)..(524): Ceres CDNA ID no. 23505323
  misc_feature (1)..(524): Also Known As Ceres GEMINI ID 5110B10
  misc_feature (11)..(270): Pfam Name: Mpp10 Pfam Description: Mpp10 protein
  misc_feature 413292:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MATVKDSGFEALEKLKATEPPVFLAPSSISEDARSASQYLFMKLKPHNPKCPFDQLSSDGFDAEQIWQQIDMQSQPLLTSLRQEVKRFAKNPEEIRKLGKLALKVSHEDDIDEMDMDGFDSDDVDDEDKEIESNDSEGEDEEEEEEDEEEEEEEEEEEEEEKDGDNEGIEDKFFKIKELEEFLEEGEAEEYGIDHKNKKGVAQRKKQNLSDDEDEEDDDDEEEDVEFDAFAGGDDEETDKLGKARYDDFFGGKKETKMKLKDLSEDEEAEIENKGNEKLSTHERARLKLQSKIEQMEKANLDPKHWTMQGEITAAKRPMNSALEVDLDFEHNARPAPVITEEVTASLEDLIKSRIIEARFDDVQRAPRLPTKGKREAKELDESKSKKGLAEVYEAEYFQKANPAFAPTTHSDELKKEASMLFKKLCLKLDALSHFHFTPKPVIEEMSIPNVSAIAMEEVAPVAVSDAAMLAPEEIFSGKGDIKDESELTQEDRKRRRANKKRKFKAESANEPPKKALDTSTKNP

SEQ ID NO: 3700 - DNA, 1665 bp, Populus balsamifera subsp. trichocarpa
  misc_feature (1)..(1665): Ceres ANNOT ID no. 1473621
  misc_feature 413417:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggcaaaaccagtcgaagcagaagcagcaggcatggaagccttaaaccgcctaaaatccattgacccaccactatggctagcaccatcgtcctctctgtctcaaacagcacgcacagcttgtaaacatctcttctcgtcaataaatccccatgtccctaaatccccctttgatcaacttctaattgatgggtgtgatgctgagcagatttggcagcaaattgacttacaatcacagcccttgttgtccagtttacgccgtcaagttttgcactttcagaagaatccagaggaaattaaagtaaatggtgacaaagttttacaagggaaaaaaaagggcgtagaagacaaggaggtgaaaaaagttgatgagtttgataatagtgatgatgaggatatgtatgaaattgatgatgaagatgacagtgatgatgatgcggacggaggtgaggaggaagagagtggagaagaggagggagaaaagggagtgatcgaggataagtttttgaagataaaggaattggaggattttttggaggaggaggatgccaaggaatatggattggatacaaggaagaataataagaaaaagaatttaagcgacgaggaggaggatgaagaggacgaggaagatgatgatgatgaaggggaggaggaggaggatgaggatgaagatgatgaggacaaggaagatgatgagcttggagtttttggtaatggcgatgatgaagatgaggatgcaagcaagcgtgccagatacgaagacttctttggtggtaaaaagagaaaaatcttaaaaaagaaaacaaaagaagactcaagctcagatgatgaacttgatgatgaagcattgaatgagagaaaaggtagactttctacccatgaaaaacaacttcagaagcttcaatctgagatagaacagatggagaaatcaaatttggagcccaaaacttggaccatgcaaggagaggtaactgctgcaagcagacccaagaatagtgcgttagaagttgatttagactttgaacacaatatgaggcccgcccctgtaatcactgaggaggttactgcaacacttgaagatatgattaagagtaggatcattgaggggcggtttgatgacattcggaaggctcccagtttacactctaaagcaccaagagaactgaaagagttggatgagaataagagcaagaagggtcttgccgatgtttatgaggaagaatatgttcaaaagacaaatccagcagctgctccattatctttctcggatgaacagaagaaggaggcaagtgtcctgttcaaaaaactgtgcttgaagttggatgctctttctcatttccactttgctcctaaacctgtcatagaggacatgtctatccaagcaaatgtccctgctcttgctatggaggagattgcaccaatggcagtttcagatgcagcaatgctggctcctgaggaaattttttcgggcaaaggtaatatcaaggaagaagcagaacttacaaaggccgagaggaagaggaggagggctaacaagaaaagaaaatttaaggccgaatcagtgaaaaggatgccaaagaaggcacaagagaacacaacactaaaccacgatgatggtgaatgttcatctgaactggctggtgtcattatttctggaagttga

SEQ ID NO: 3701 - protein, 554 aa, Populus balsamifera subsp. trichocarpa
  misc_feature (1)..(554): Ceres ANNOT ID no. 1473621
  misc_feature (14)..(289): Pfam Name: Mpp10 Pfam Description: Mpp10 protein
  misc_feature: SWISSPROT Homolog: MPP10_MOUSE U3 small nucleolar ribonucleoprotein protein MPP10 (M phase phosphoprotein 10) with e-value of 4.0e-56 and BLAST sequence identity of 38.2
  misc_feature: SWISSPROT Homolog: MPP10_HUMAN U3 small nucleolar ribonucleoprotein protein MPP10 (M phase phosphoprotein 10) with e-value of 8.3e-56 and BLAST sequence identity of 37.8
  misc_feature: SWISSPROT Homolog: MPP10_YEAST U3 small nucleolar ribonucleoprotein protein MPP10 with e-value of 5.0e-49 and BLAST sequence identity of 33.3
  misc_feature: SWISSPROT Homolog: MPP10_SCHPO U3 small nucleolar ribonucleoprotein protein mpp10 with e-value of 1.6e-43 and BLAST sequence identity of 32.3
  misc_feature: SWISSPROT Homolog: GARP_PLAFF Glutamic acid-rich protein precursor with e-value of 4.3e-17 and BLAST sequence identity of 32.9
  misc_feature 413542:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(554): Functional Homolog of  Ceres CDNA ID no. 23505323 at SEQ ID NO. 3746 with e-value of 7.09E-159 and BLAST sequence identity of 64.8
MAKPVEAEAAGMEALNRLKSIDPPLWLAPSSSLSQTARTACKHLFSSINPHVPKSPFDQLLIDGCDAEQIWQQIDLQSQPLLSSLRRQVLHFQKNPEEIKVNGDKVLQGKKKGVEDKEVKKVDEFDNSDDEDMYEIDDEDDSDDDADGGEEEESGEEEGEKGVIEDKFLKIKELEDFLEEEDAKEYGLDTRKNNKKKNLSDEEEDEEDEEDDDDEGEEEEDEDEDDEDKEDDELGVFGNGDDEDEDASKRARYEDFFGGKKRKILKKKTKEDSSSDDELDDEALNERKGRLSTHEKQLQKLQSEIEQMEKSNLEPKTWTMQGEVTAASRPKNSALEVDLDFEHNMRPAPVITEEVTATLEDMIKSRIIEGRFDDIRKAPSLHSKAPRELKELDENKSKKGLADVYEEEYVQKTNPAAAPLSFSDEQKKEASVLFKKLCLKLDALSHFHFAPKPVIEDMSIQANVPALAMEEIAPMAVSDAAMLAPEEIFSGKGNIKEEAELTKAERKRRRANKKRKFKAESVKRMPKKAQENTTLNHDDGECSSELAGVIISGS

SEQ ID NO: 3702 - DNA, 1809 bp, Populus balsamifera subsp. trichocarpa
  misc_feature (1)..(1809): Ceres ANNOT ID no. 1521779
  misc_feature 413681:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggcaatacctagcgaagcagcagcagcagccttagaagccttaaatcgcctaaaatcgactaacccaccactatggctagcaccatcgccttctctgtctcaaacagcacgcacggcctgtaaacatatcttctcttcaataaatcctcatgtcgctaaatcgctctttgatcaacttctaattgacgggtttgatgttgagcagatttggcagcaaattgacttacaatcacagccgttgttgtccactttacgccgtcaagttttgcactttgagaagaatccagaggaaattagagtaactggtgagaaggtcttacaagggaaaaacaacggtgtagaagagaaggaggtgaaaaaaattgatggggttggtaatggtgacgacgacgacatggatatgtatggaattgatgatgaagatgacgatgatgatgaagaggaggaggaggtaagtgaagaggaagagagtggagaagaggagggagaaaagggagtggtagaggataagtttttgaagataaaggatttggaggattttttggaggatgaggatgccaaggaatatggactagatacaaagaagaataacaagaaagacaatttaagtgaggaggatgacgaagacgaggatgatgatgaaggtgagggaggagaggatgatgaagatgatgagcttggggtttttggcgatggtgatgaggaagatgaagatgcaagcaagcatgccagagaaatctcacggaaacttagcaaggcctccatttgccctgttgctggcagcacttcttatgaaactgttgcttcaatgcaccagaccttactaccttccttgaaagttttttttttttaccttgaattactgattcttggtttctcttgtgcatcgctgagattcagatatgaagacttctttggcagtaaaaggagaaaaatcttaaaaagaaagtcaaaagaagactcaagctcagatgatgaacttgatgatgaagcagttgatgagagaaaaggtagactttctacccatgaaaaacaacttcagaagcttcaatctgagatagagcagatggagaaagcaaatttggagccaaaaacttggaccatgcaaggagaggtaactgctgcaagcagacccaagaatagtgcactagaagttgatttagactttgaacacaatatgaggcctgcccctgtaatcactgaggaggttactgcaacactggaagatatgattaagaataggatcattgagggacagtttaatgacattcagaaggctcccagtttaccctctaaagcaccgagagaactgaaagagttggatgataataagagcaagaagggtcttgccgatgtttatgaggaagaatatgttcaaaagacaaatccagctgctgcaccgttatctttcttagatgaacagaagaaggaggcaagtgtcctgttcaaaaaactgtgcttgaagttggatgcactttctcactaccactttgctcccaaacctgtcatagaagacatgtctatccaagcaaatgtccctgctcttgctatggaagagattgcacccatggcagtttcagatgcagctatgctggctccagaagaagttttttcaggcaaaggtgatattaaggaagaagcagaacttacgcaggctgagaggaagaggaggagggctaacaagaaaagaaaatttaaggctgaatcggttaaagggacagcaaagaaggcacgagagaacacaacactataccacgatgatgttaaattatgcaaaaattattctggtgtgatttggttatcttag

SEQ ID NO: 3703 - protein, 602 aa, Populus balsamifera subsp. trichocarpa
  misc_feature (1)..(602): Ceres ANNOT ID no. 1521779
  misc_feature (301)..(337): Pfam Name: Mpp10 Pfam Description: Mpp10 protein
  misc_feature: SWISSPROT Homolog: MPP10_MOUSE U3 small nucleolar ribonucleoprotein protein MPP10 (M phase phosphoprotein 10) with e-value of 4.0e-56 and BLAST sequence identity of 38.2
  misc_feature: SWISSPROT Homolog: MPP10_HUMAN U3 small nucleolar ribonucleoprotein protein MPP10 (M phase phosphoprotein 10) with e-value of 8.3e-56 and BLAST sequence identity of 37.8
  misc_feature: SWISSPROT Homolog: MPP10_YEAST U3 small nucleolar ribonucleoprotein protein MPP10 with e-value of 5.0e-49 and BLAST sequence identity of 33.3
  misc_feature: SWISSPROT Homolog: MPP10_SCHPO U3 small nucleolar ribonucleoprotein protein mpp10 with e-value of 1.6e-43 and BLAST sequence identity of 32.3
  misc_feature: SWISSPROT Homolog: GARP_PLAFF Glutamic acid-rich protein precursor with e-value of 4.3e-17 and BLAST sequence identity of 32.9
  misc_feature 413812:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(602): Functional Homolog of  Ceres CDNA ID no. 23505323 at SEQ ID NO. 3746 with e-value of 8.60E-147 and BLAST sequence identity of 62.8
MAIPSEAAAAALEALNRLKSTNPPLWLAPSPSLSQTARTACKHIFSSINPHVAKSLFDQLLIDGFDVEQIWQQIDLQSQPLLSTLRRQVLHFEKNPEEIRVTGEKVLQGKNNGVEEKEVKKIDGVGNGDDDDMDMYGIDDEDDDDDEEEEEVSEEEESGEEEGEKGVVEDKFLKIKDLEDFLEDEDAKEYGLDTKKNNKKDNLSEEDDEDEDDDEGEGGEDDEDDELGVFGDGDEEDEDASKHAREISRKLSKASICPVAGSTSYETVASMHQTLLPSLKVFFFYLELLILGFSCASLRFRYEDFFGSKRRKILKRKSKEDSSSDDELDDEAVDERKGRLSTHEKQLQKLQSEIEQMEKANLEPKTWTMQGEVTAASRPKNSALEVDLDFEHNMRPAPVITEEVTATLEDMIKNRIIEGQFNDIQKAPSLPSKAPRELKELDDNKSKKGLADVYEEEYVQKTNPAAAPLSFLDEQKKEASVLFKKLCLKLDALSHYHFAPKPVIEDMSIQANVPALAMEEIAPMAVSDAAMLAPEEVFSGKGDIKEEAELTQAERKRRRANKKRKFKAESVKGTAKKARENTTLYHDDVKLCKNYSGVIWLS

SEQ ID NO: 3704 - protein, 513 aa, Arabidopsis thaliana
  misc_feature (1)..(513): Ceres CDNA ID no. 23507479
  misc_feature (40)..(90): Pfam Name: p450 Pfam Description: Cytochrome P450
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: ROSETTE LEAVES - Long Petioles Useful for making plants that grow better in shade
  misc_feature: Phenotype: ROSETTE LEAVES - Short Petioles Useful for modulating plant size
  misc_feature: Phenotype: INFLORESCENCE - Weak Useful for making stronger plants
  misc_feature: Phenotype: ROSETTE LEAVES - Other Useful for making ornamental plants with modified leaves
MFETEHHTLLPLLLLPSLLSLLLFLILLKRRNRKTRFNLPPGKSGWPFLGETIGYLKPYTATTLGDFMQQHVSKYGKIYRSNLFGEPTIVSADAGLNRFILQNEGRLFECSYPRSIGGILGKWSMLVLVGDMHRDMRSISLNFLSHARLRTILLKDVERHTLFVLDSWQQNSIFSAQDEAKKFTFNLMAKHIMSMDPGEEETEQLKKEYVTFMKGVVSAPLNLPGTAYHKALQSRATILKFIERKMEERKLDIKEEDQEEEEVKTEDEAEMSKSDHVRKQRTDDDLLGWVLKHSNLSTEQILDLILSLLFAGHETSSVAIALAIFFLQACPKAVEELREEHLEIARAKKELGESELNWDDYKKMDFTQCVINETLRLGNVVRFLHRKALKDVRYKGYDIPSGWKVLPVISAVHLDNSRYDQPNLFNPWRWQQQNNGASSSGSGSFSTWGNNYMPFGGGPRLCAGSELAKLEMAVFIHHLVLKFNWELAEDDKPFAFPFVDFPNGLPIRVSRIL

SEQ ID NO: 3705 - DNA, 1470 bp, Populus balsamifera subsp. trichocarpa
  misc_feature (1)..(1470): Ceres ANNOT ID no. 1510416
  misc_feature 414143:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: ROSETTE LEAVES - Long Petioles Useful for making plants that grow better in shade
  misc_feature: Phenotype: ROSETTE LEAVES - Short Petioles Useful for modulating plant size
  misc_feature: Phenotype: INFLORESCENCE - Weak Useful for making stronger plants
  misc_feature: Phenotype: ROSETTE LEAVES - Other Useful for making ornamental plants with modified leaves
atgtctcactcagagcttgttgtctttctccttccatcgattttatcactactcttgctcttcattctcgtgcaaagaaagcaagtaagatttaatctcccaccaggcaacatggggtggccatttcttggagaaaccattggctacctgaagccttactctgctacttcaataggagaattcatggaacagcacatatcaaggtatggaaagatttacaagtccaatttgtttggggagccaacaatagtatccgcagatgctggacttaacagatttatactacagaatgagggaagattatttgaatgcagctatccaaaaagtattggtggaattcttggaaaatggtccatgttggttcttgttggagacatgcatagagacatgaggattatatctcttaactttttgagccatgccaggttaagaactcatctattgaaagaagtggagaagcaaaccctgcttgttcttagctcttggaaggagaattgtacattttcagctcaagatgaagcaaagaagtttaccttcaatttgatggcaaaacatatcatgagcttggatcctggaaagccagagactgagcagctgaaaaaagagtatgttactttcatgaaaggagtagtttcagctcctataaatttgcctggaaccccatatagaaaagccttgaagtctcgatcaatcatcttgaaatttatagagcgaaagatggaggagagaattgctgaaacgaagggtggagtagaaaacttggaagacgatgatcttcttggatgggtcttgaagcattcaaatctttctacggagcaaatccttgacttaatcttaagcttgctctttgctggccacgaaacttcttctgtgtccatagctctagccatctacttcttgcaagcttgtcctggtgctattcaacagttaaaagaagaacatattcaaatctccagagccaagaaacggtcaggagagacggaattgaactgggatgattacaaaaaaatggaattcacccaatgcgttataagcgagacactgaggcttggaaacgtagtcaggtttcttcacagaaaagctctaaaagatgttcggtacaaagggtacgacattccatgtggatggaaagtgctaccagtgatctcagccgtccatttagattcaactcttttcgaccaacctcaacacttcaatccatggagatggcagcagcataacaatgctcgtggtgcttctacaagttcgagtgggacgacgagtagtaattacttcatgccatttgggggaggaccgcgactttgtgcaggatcggaattggcaaaactagaaatggccgtgttcatccaccatttggtcctcaacttccactgggaactggttgataccgatcaagcctttgcctttccttttgtcgattttcccaagggcttgcccataagagtcaagcacctactcacagttacatga

SEQ ID NO: 3706 - protein, 489 aa, Populus balsamifera subsp. trichocarpa
  misc_feature (1)..(489): Ceres ANNOT ID no. 1510416
  misc_feature (34)..(488): Pfam Name: p450 Pfam Description: Cytochrome P450
  misc_feature: SWISSPROT Homolog: C90B1_ARATH Cytochrome P450 90B1 (EC 1.14.-.-) (Steroid 22-alpha-hydroxylase) (Dwarf4) (Dwarf protein 4) with e-value of 9.1e-279 and BLAST sequence identity of 99.8
  misc_feature: SWISSPROT Homolog: C724B_ORYSA Cytochrome P450 724B1 (EC 1.14.-.-) (OsDWARF11) (Dwarf protein 11) with e-value of 1.8e-106 and BLAST sequence identity of 50.2
  misc_feature: SWISSPROT Homolog: C90A1_ARATH Cytochrome P450 90A1 (EC 1.14.-.-) with e-value of 3.5e-99 and BLAST sequence identity of 39.3
  misc_feature: SWISSPROT Homolog: C90D2_ORYSA Cytochrome P450 90D2 (EC 1.14.-.-) (C6-oxidase) with e-value of 8.0e-81 and BLAST sequence identity of 44.7
  misc_feature: SWISSPROT Homolog: C87A3_ORYSA Cytochrome P450 87A3 (EC 1.14.-.-) with e-value of 6.3e-77 and BLAST sequence identity of 39.8
  misc_feature 414320:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: ROSETTE LEAVES - Long Petioles Useful for making plants that grow better in shade
  misc_feature: Phenotype: ROSETTE LEAVES - Short Petioles Useful for modulating plant size
  misc_feature: Phenotype: INFLORESCENCE - Weak Useful for making stronger plants
  misc_feature: Phenotype: ROSETTE LEAVES - Other Useful for making ornamental plants with modified leaves
  misc_feature (1)..(489): Functional Homolog of  Ceres CDNA ID no. 23507479 at SEQ ID NO. 3751 with e-value of 1.90E-206 and BLAST sequence identity of 80.4
MSHSELVVFLLPSILSLLLLFILVQRKQVRFNLPPGNMGWPFLGETIGYLKPYSATSIGEFMEQHISRYGKIYKSNLFGEPTIVSADAGLNRFILQNEGRLFECSYPKSIGGILGKWSMLVLVGDMHRDMRIISLNFLSHARLRTHLLKEVEKQTLLVLSSWKENCTFSAQDEAKKFTFNLMAKHIMSLDPGKPETEQLKKEYVTFMKGVVSAPINLPGTPYRKALKSRSIILKFIERKMEERIAETKGGVENLEDDDLLGWVLKHSNLSTEQILDLILSLLFAGHETSSVSIALAIYFLQACPGAIQQLKEEHIQISRAKKRSGETELNWDDYKKMEFTQCVISETLRLGNVVRFLHRKALKDVRYKGYDIPCGWKVLPVISAVHLDSTLFDQPQHFNPWRWQQHNNARGASTSSSGTTSSNYFMPFGGGPRLCAGSELAKLEMAVFIHHLVLNFHWELVDTDQAFAFPFVDFPKGLPIRVKHLLTVT

SEQ ID NO: 3707 - DNA, 1470 bp, Populus balsamifera subsp. trichocarpa
  misc_feature (1)..(1470): Ceres ANNOT ID no. 1541253
  misc_feature 414502:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: ROSETTE LEAVES - Long Petioles Useful for making plants that grow better in shade
  misc_feature: Phenotype: ROSETTE LEAVES - Short Petioles Useful for modulating plant size
  misc_feature: Phenotype: INFLORESCENCE - Weak Useful for making stronger plants
  misc_feature: Phenotype: ROSETTE LEAVES - Other Useful for making ornamental plants with modified leaves
atgtctcactcagagcttgttgtgcttctccttccttcaattttatctctactcctggtcttcattctcatgcaaagaaagcaagcaagatttaatctcccacctggcaacatgggctggccatttcttggagaaactattggctacttgaagccttactctgctacttcaataggggaattcatggaacaacacatatcaaggtatggaaagatttacaagtccaatttgtttggggagccgacaatagtatctgcagatgctggacttaacagatttatactccagagtgaaggaagattgtttgaatgcagctatccaagaagtattggtggaattcttggaaaatggtctatgctggttctagttggagacatgcatagaaacatgaggagtatatctctcaactttttgagccatgccaggttaagaagtcatctattgaaagaagtggagaagcaaaccttgcttgttcttagttcttggaaggagaattgtacattttcagctcaagatgaagcaaagaagtttaccttcaatttgatggcaaaacatatgatgagcttggatcctggaaagccagagactgagcagctgaagaaagagtatgttactttcatgaaaggagtggtttctgctccactaaattttcctggaacaccgtatagaaaagccttgaagtctcgatcaatcatccttaaatttatagagcaaaaaatggaagagagaattgctagattgaaggagggagtggaagatttagaggaagatgatcttcttggatgggttttgaagcattcaaatctttctaccgagcaaatccttgacttgatattaagcttgctctttgctggccatgaaacttcttctgtctccatagctttagccatctacttcttgcaagcttgtcccggtgctattcaacagttaaaagaagaacatattgaaatttccagagccaagaaacagtcaggagagatggaaataaactgggatgattacaaaaaaatggaattcactcaatgtgttataagtgagacactgaggcttggaaacgtagtcaggttccttcatagaaaagctgtcagagatgttcgctataaagggtatgacattccatgtggatggaaagtgctgccagtgatctcagccgtgcatttagattctactgtttttgaccagcctcaacagttcaatccatggagatggcagcagcacaacaatgctcgtggatcttctacttgttcgagtgcggcggcggcgagtagtaatcacttcatgccatttgggggaggaccgcgactctgtgcaggatcggaattggcaaaacttgaaatggcagttttcattcaccatttggttctgaacttccattgggaattggtcggtgccgatcaagcctttgcctttccttttgttgattttcctaaaggcttgccaataagagtcaagcaccacacagtcatataa

SEQ ID NO: 3708 - protein, 489 aa, Populus balsamifera subsp. trichocarpa
  misc_feature (1)..(489): Ceres ANNOT ID no. 1541253
  misc_feature (34)..(490): Pfam Name: p450 Pfam Description: Cytochrome P450
  misc_feature: SWISSPROT Homolog: C90B1_ARATH Cytochrome P450 90B1 (EC 1.14.-.-) (Steroid 22-alpha-hydroxylase) (Dwarf4) (Dwarf protein 4) with e-value of 9.1e-279 and BLAST sequence identity of 99.8
  misc_feature: SWISSPROT Homolog: C724B_ORYSA Cytochrome P450 724B1 (EC 1.14.-.-) (OsDWARF11) (Dwarf protein 11) with e-value of 1.8e-106 and BLAST sequence identity of 50.2
  misc_feature: SWISSPROT Homolog: C90A1_ARATH Cytochrome P450 90A1 (EC 1.14.-.-) with e-value of 3.5e-99 and BLAST sequence identity of 39.3
  misc_feature: SWISSPROT Homolog: C90D2_ORYSA Cytochrome P450 90D2 (EC 1.14.-.-) (C6-oxidase) with e-value of 8.0e-81 and BLAST sequence identity of 44.7
  misc_feature: SWISSPROT Homolog: C87A3_ORYSA Cytochrome P450 87A3 (EC 1.14.-.-) with e-value of 6.3e-77 and BLAST sequence identity of 39.8
  misc_feature 414679:<222: Transcription Factor
  misc_feature: Phenotype: WHOLE PLANT - Dark Green Useful for increasing chlorophyll and photosynthetic capacity
  misc_feature: Phenotype: WHOLE PLANT - Large Useful for making bigger plants
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Yellow-Green Viable 1 Useful for making lethal plants for genetic confinement systems
  misc_feature: Phenotype: ROSETTE LEAVES - Long Petioles Useful for making plants that grow better in shade
  misc_feature: Phenotype: ROSETTE LEAVES - Short Petioles Useful for modulating plant size
  misc_feature: Phenotype: INFLORESCENCE - Weak Useful for making stronger plants
  misc_feature: Phenotype: ROSETTE LEAVES - Other Useful for making ornamental plants with modified leaves
  misc_feature (1)..(489): Functional Homolog of  Ceres CDNA ID no. 23507479 at SEQ ID NO. 3751 with e-value of 2.80E-203 and BLAST sequence identity of 78.9
MSHSELVVLLLPSILSLLLVFILMQRKQARFNLPPGNMGWPFLGETIGYLKPYSATSIGEFMEQHISRYGKIYKSNLFGEPTIVSADAGLNRFILQSEGRLFECSYPRSIGGILGKWSMLVLVGDMHRNMRSISLNFLSHARLRSHLLKEVEKQTLLVLSSWKENCTFSAQDEAKKFTFNLMAKHMMSLDPGKPETEQLKKEYVTFMKGVVSAPLNFPGTPYRKALKSRSIILKFIEQKMEERIARLKEGVEDLEEDDLLGWVLKHSNLSTEQILDLILSLLFAGHETSSVSIALAIYFLQACPGAIQQLKEEHIEISRAKKQSGEMEINWDDYKKMEFTQCVISETLRLGNVVRFLHRKAVRDVRYKGYDIPCGWKVLPVISAVHLDSTVFDQPQQFNPWRWQQHNNARGSSTCSSAAAASSNHFMPFGGGPRLCAGSELAKLEMAVFIHHLVLNFHWELVGADQAFAFPFVDFPKGLPIRVKHHTVI

SEQ ID NO: 3709 - protein, 163 aa, Arabidopsis thaliana
  misc_feature (1)..(163): Ceres CDNA ID no. 23509939
  misc_feature (1)..(163): Also Known As Ceres GEMINI ID 5110E3
  misc_feature (2)..(54): Pfam Name: HLH Pfam Description: Helix-loop-helix DNA-binding domain
  misc_feature 414875:<222: Transcription Factor
  misc_feature: Phenotype: Activates expression of the gene endogenous to the AtHMGS (SEQ ID NO 4144) regalutory region Useful for modulating Terpenoid Biosynthesis
MEKLVHKEIEKRRRQEMASLYASLRSLLPLEFIQGKRSTSDQVKGAVNYIDYLQRNIKDINSKRDDLVLLSGRSFRSSNEQEWNEISNHVVIRPCLVGIEIVLSILQTPFSSVLQVLREHGLYVLGYICSSVNDRLIHTLQAEVNDLALIDLADLKDTLTLMK

SEQ ID NO: 3710 - DNA, 522 bp, Populus balsamifera subsp. trichocarpa
  misc_feature (1)..(522): Ceres ANNOT ID no. 1527683
  misc_feature 414933:<222: Transcription Factor
  misc_feature: Phenotype: Activates expression of the gene endogenous to the AtHMGS (SEQ ID NO 4144) regalutory region Useful for modulating Terpenoid Biosynthesis
atgatgcatagagatattgaaagacaaaggaggcaagaaatgacaaccctttatgcatcccttcgagctttacttcctcttgaatttatcaagggaaagcgttcgatttcagatcacatgaacgaggcagtgaattatataaagtatctccaaaagaagatcaaagaaactagtgccaaaagagatgagttaaagaaactatccgatttcagttctgttgcctcaccaagtggatgttctaacaaatcttcttcaagttcagtagctctccagccatatccaggtggtattgagattacgtttgatagtgatttaatggggagagatttgcccctatcaagagtattgcaagtgttgcttgaagaaggaatttctgttatcaactgtgtttccaccaaagtaaatgaaagattattccactctgtccaaactgaggtcaatgatcctacatgcttaaatttatccgagctgtggcagaaattaaccctagtagtttcttctacaagtgatttatccaagtga

SEQ ID NO: 3711 - protein, 173 aa, Populus balsamifera subsp. trichocarpa
  misc_feature (1)..(173): Ceres ANNOT ID no. 1527683
  misc_feature (1)..(51): Pfam Name: HLH Pfam Description: Helix-loop-helix DNA-binding domain
  misc_feature 414982:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(173): Functional Homolog of  Ceres CDNA ID no. 23509939 at SEQ ID NO. 3756 with e-value of 1.00E-31 and BLAST sequence identity of 50.3
MMHRDIERQRRQEMTTLYASLRALLPLEFIKGKRSISDHMNEAVNYIKYLQKKIKETSAKRDELKKLSDFSSVASPSGCSNKSSSSSVALQPYPGGIEITFDSDLMGRDLPLSRVLQVLLEEGISVINCVSTKVNERLFHSVQTEVNDPTCLNLSELWQKLTLVVSSTSDLSK

SEQ ID NO: 3712 - protein, 537 aa, Arabidopsis thaliana
  misc_feature (1)..(537): Ceres CDNA ID no. 23510894
  misc_feature (476)..(534): Pfam Name: BBE Pfam Description: Berberine and berberine like
  misc_feature (84)..(225): Pfam Name: FAD_binding_4 Pfam Description: FAD binding domain
  misc_feature: Utility: ABA Useful for making plants with enhanced tolerance to drought
  misc_feature: Utility: Mannitol Useful for making plants with enhanced tolerance to drought
  misc_feature: Utility: PEG Useful for making plants with increased tolerance to drought
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
MGISKPLPLFSILVLYFSLYTITPTSSLASLQDQFINCVQRNTHVYFPLEKTFFAPTKNVSMFSQVLESTAQNLRFLKKSMPKPGFIFSPIHESHVQASIICSKKLRMHLRVRSGGHDYEGLSYVSQIDKPFILMDLSKMRQVNINIQDNSAWVQSGATVGELYYRIAEKSKVHGFPAGLCSSLGIGGHITGGAYGSMMRKYGLGADNVLDAKIVDANGKLLDRAAMGEDTFWAIRGGAGGSFGIILAWKIKLVPVPKTVTVFTVTKTLQQDVGNKIISKWQRVADKLVEELFIRVLFNVAGTGGNKTVTTSYNALFLGGKGTLMNVMKKSFPELGLTFKDCIEMSWLESIAYISGFPTHTPTNVLLQGKSPFPKVSFKAKSDFVKTPIPESGLQGIFKKLLKEDIPLMIWNPYGGMMAKIPESQIPFPHRKGVLFKVQYVTSWLDSDKRPSRHINWIRDLYSYMTPYVSSNPREAYVNYRDLDLGRNTKDVKTCIKQAQVWGANYFKNNFNRLMMIKAKVDPENFFRHEQSIPPMM

SEQ ID NO: 3713 - DNA, 1638 bp, Populus balsamifera subsp. trichocarpa
  misc_feature (1)..(1638): Ceres ANNOT ID no. 1467221
  misc_feature 415216:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
atggtgccttcaagtttttgtattttttcaactcttgtagttctgctgctatcttcttcagtgacagtttcacttccaattaaagatgattttgtccaatgcttcttacaaaattcagaaatttccgttcctacctcaagtttttacaccccagacaatagttcttcattcagtgctgttttacaatctactgctcaaaacctgaggtacttgttgccttcagtgccaaaacctgtgtttatcttcacacctttgtatgaagcccatgtccaagcatctgttatctgctgtagacaacttggacttcaccttagagtccgtagtggaggccatgactatgagggtctctcttatgcttcggaaattgagtcacctttcattgttgtagaccttgccaagcttcgagctatccaagttaatattgaagataacagtgcttgggttcaggcaggtgctacaatcggtgagctgtactatagaattgctgaaaaaagcaaaactcatggcttcccagctggcctttgcagcagtttgggcattggtgggcacattacaggaggtgcttatggttccatgatgagaaagtatggccttggcgctgacaatgtcattgatgctcgtgtaattgatgctagtggcagggttcttgaaagacaatccatgggagaggattttttttgggcaattagaggaggtggaggagccagctttggtatcatcactgcatggaaagtaaaactggttccagttccatcaactgtgactgtttttacggtcactaagaccctggaacagggtggcactaagcttctctacagatggcagcaagttgctgataaacttgatgaggatctcttcatcagggtcatcatacaaacagctaatggtgcgaaaaagggtcaaagaactgttacaacttcttataatgccttgtttcttggtgatgccagcagactactcaatgtcatgaagactggcttccctgaattgggcttgacacgaaaggattgcgtcgaaactacctggctgaaatctgtgttatacatcgcaggctacccagccaatacacctcctgaagttctgcttcaaggaaagtcaacattcaagaactacttcaaagccaagtcagattttgtccaacatcccatacctgaagccgcactggaggggatatggaaaaggtattttcaagaagtgactcctttcatgatatggaatccttatggtggaatgatgagcaagatttcagagtcatcaattcctttcccccatagaaaaggtgtcctcttcaagattcagtacttgaccagctggcaaactcctgcagaggatgcttcaaagcatataaattggatcaggaagctttacaagtacatggcaccttatgtttccatgtttccaaggcaagcatacgtcaattacagggaccttgatctggggatgaacaagaagaggaacacaagctttaaagaagcaagtgtctggggtaccaagtacttcaagaacaacttcaacaggttggtacaagtcaagaccacagttgatcccgacaacttcttcaggcatgagcagagcatcccacctcttccactctcctcgagaaaagggaaaggaaagggacaccatgggattcattag

SEQ ID NO: 3714 - protein, 545 aa, Populus balsamifera subsp. trichocarpa
  misc_feature (1)..(545): Ceres ANNOT ID no. 1467221
  misc_feature (470)..(527): Pfam Name: BBE Pfam Description: Berberine and berberine like
  misc_feature (78)..(219): Pfam Name: FAD_binding_4 Pfam Description: FAD binding domain
  misc_feature: SWISSPROT Homolog: RETO_ESCCA Reticuline oxidase precursor with e-value of 1.1e-106 and BLAST sequence identity of 42.1
  misc_feature: SWISSPROT Homolog: RETO_ESCCA EC 1.21.3.3 (Berberine-bridge-forming enzyme) (BBE) Tetrahydroprotoberberine synthase
  misc_feature: SWISSPROT Homolog: RETO_PAPSO Reticuline oxidase precursor with e-value of 5.8e-103 and BLAST sequence identity of 41.4
  misc_feature: SWISSPROT Homolog: RETO_PAPSO EC 1.21.3.3(Berberine-bridge-forming enzyme) (BBE) Tetrahydroprotoberberine synthase
  misc_feature: SWISSPROT Homolog: MCRA_STRLA Mitomycin radical oxidase (EC 1.5.3.-) with e-value of 1.2e-16 and BLAST sequence identity of 29.1
  misc_feature: SWISSPROT Homolog: HDNO_ARTOX 6-hydroxy-D-nicotine oxidase (EC 1.5.3.6) 6-HDNO with e-value of 9.9e-14 and BLAST sequence identity of 26.5
  misc_feature: SWISSPROT Homolog: FAS5_RHOFA Hypothetical 47.9 kDa oxidoreductase in fasciation locus (ORF5) with e-value of 2.1e-06 and BLAST sequence identity of 24.0
  misc_feature 415377:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature (1)..(545): Functional Homolog of  Ceres CDNA ID no. 23510894 at SEQ ID NO. 3759 with e-value of 1.30E-191 and BLAST sequence identity of 66.9
MVPSSFCIFSTLVVLLLSSSVTVSLPIKDDFVQCFLQNSEISVPTSSFYTPDNSSSFSAVLQSTAQNLRYLLPSVPKPVFIFTPLYEAHVQASVICCRQLGLHLRVRSGGHDYEGLSYASEIESPFIVVDLAKLRAIQVNIEDNSAWVQAGATIGELYYRIAEKSKTHGFPAGLCSSLGIGGHITGGAYGSMMRKYGLGADNVIDARVIDASGRVLERQSMGEDFFWAIRGGGGASFGIITAWKVKLVPVPSTVTVFTVTKTLEQGGTKLLYRWQQVADKLDEDLFIRVIIQTANGAKKGQRTVTTSYNALFLGDASRLLNVMKTGFPELGLTRKDCVETTWLKSVLYIAGYPANTPPEVLLQGKSTFKNYFKAKSDFVQHPIPEAALEGIWKRYFQEVTPFMIWNPYGGMMSKISESSIPFPHRKGVLFKIQYLTSWQTPAEDASKHINWIRKLYKYMAPYVSMFPRQAYVNYRDLDLGMNKKRNTSFKEASVWGTKYFKNNFNRLVQVKTTVDPDNFFRHEQSIPPLPLSSRKGKGKGHHGIH

SEQ ID NO: 3715 - DNA, 1638 bp, Populus balsamifera subsp. trichocarpa
  misc_feature (1)..(1638): Ceres ANNOT ID no. 1442171
  misc_feature 415529:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
atggttccttttaggtgttccattctttcaatctttgtagtcctgctgctatctcctggactgacattttcacttccaattaaagatagttttgtccagtgtctctcacaaaattcagaatttgtcattcctgcctcagatttctacaccccagacaatagctcttcattcaatgctgttttggaatctactgctcaaaaccttaggtacttgttgccttcggtgccaaaacctgagtttattttcactcctctgtacgaagcccatgtccaagcatctgttatttgctgtaagcagcttggaattcaccttagagtccgcagtggaggccatgactatgagggtctctcttatgccactgaaattgaaacacaattcattgttgtagacctagccaagcttcgagctgtccaagttgacattgaagataatagtgcatgggttcaggcaggagcaacgatcggtgagctttactacagaattgcagaaaaaagcgaagctcatggcttcccaggtggcctttgcagcagtttaggcattggtgggcacattacaggaggtgcctatggttccatgatgagaaagtatggccttggtgctgacaatgttattgatgctcggataattgatgctagtggcagggttcttgaaagacgagccatgggagaggatcttttttgggctattagaggtggtggaggagccagctttggtatcattactgcctggaaagtaaaactggttcctgtgccatcaactgtgactgtttttacagttactaagaccttggaacaaggtggcactaagcttctgtacagatggcagcaagttgctgataaacttgacgaggatctcttcatcagggttataattcaagcagctgatggtgctacaaagggtaaaagaactgtcacaacttcctataatgccttgtttctaggtgatgccaaaagactactcaatgtcatggagcaaggcttccctgaattgggtttgacgctgaaggattgcaccgaaaccacctggctgaaatctgtgctatacatcgcaggctacccagccaacactcctcctgaagttttgcttcaaggcaagtcaacattcaagaactacttcaaagccaagtcagattttgtcacagaacccatacccgaaacagcactcgaggggatatgggaaaggtattttgaagaagcgactcctttcatgatatggaatccttatggtggaatgatgagcgaaatttcagagtcatcaattcctttcccacataggaaaggtatccttttcaaaattcagtacttgaccatgtggcaaaatcctgcagaggatgcttcaaagcatatagattggatcaggaggctttacaattacatggcgccttatgtttccatgtttccaaggcaagcatatgtcaattacagggaccttgatttggggattaacaaggagagcaacacaagctttattgaagctagtgcttggggcgccaagtacttcaaagataacttcaacaggctgatacaagtgaagaccaaagttgatcctgacaacttcttcaagcatgagcagagcatcccacctcttccagtctcctttagaaaaagaaaaggaaggggacatcatgggattcattag

SEQ ID NO: 3716 - protein, 545 aa, Populus balsamifera subsp. trichocarpa
  misc_feature (1)..(545): Ceres ANNOT ID no. 1442171
  misc_feature (470)..(527): Pfam Name: BBE Pfam Description: Berberine and berberine like
  misc_feature (78)..(219): Pfam Name: FAD_binding_4 Pfam Description: FAD binding domain
  misc_feature: SWISSPROT Homolog: RETO_ESCCA Reticuline oxidase precursor with e-value of 1.1e-106 and BLAST sequence identity of 42.1
  misc_feature: SWISSPROT Homolog: RETO_ESCCA EC 1.21.3.3 (Berberine-bridge-forming enzyme) (BBE) Tetrahydroprotoberberine synthase
  misc_feature: SWISSPROT Homolog: RETO_PAPSO Reticuline oxidase precursor with e-value of 5.8e-103 and BLAST sequence identity of 41.4
  misc_feature: SWISSPROT Homolog: RETO_PAPSO EC 1.21.3.3(Berberine-bridge-forming enzyme) (BBE) Tetrahydroprotoberberine synthase
  misc_feature: SWISSPROT Homolog: MCRA_STRLA Mitomycin radical oxidase (EC 1.5.3.-) with e-value of 1.2e-16 and BLAST sequence identity of 29.1
  misc_feature: SWISSPROT Homolog: HDNO_ARTOX 6-hydroxy-D-nicotine oxidase (EC 1.5.3.6) (6-HDNO) with e-value of 9.9e-14 and BLAST sequence identity of 26.5
  misc_feature: SWISSPROT Homolog: FAS5_RHOFA Hypothetical 47.9 kDa oxidoreductase in fasciation locus (ORF5) with e-value of 2.1e-06 and BLAST sequence identity of 24.0
  misc_feature 415690:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature (1)..(545): Functional Homolog of  Ceres CDNA ID no. 23510894 at SEQ ID NO. 3759 with e-value of 9.59E-187 and BLAST sequence identity of 65.5
MVPFRCSILSIFVVLLLSPGLTFSLPIKDSFVQCLSQNSEFVIPASDFYTPDNSSSFNAVLESTAQNLRYLLPSVPKPEFIFTPLYEAHVQASVICCKQLGIHLRVRSGGHDYEGLSYATEIETQFIVVDLAKLRAVQVDIEDNSAWVQAGATIGELYYRIAEKSEAHGFPGGLCSSLGIGGHITGGAYGSMMRKYGLGADNVIDARIIDASGRVLERRAMGEDLFWAIRGGGGASFGIITAWKVKLVPVPSTVTVFTVTKTLEQGGTKLLYRWQQVADKLDEDLFIRVIIQAADGATKGKRTVTTSYNALFLGDAKRLLNVMEQGFPELGLTLKDCTETTWLKSVLYIAGYPANTPPEVLLQGKSTFKNYFKAKSDFVTEPIPETALEGIWERYFEEATPFMIWNPYGGMMSEISESSIPFPHRKGILFKIQYLTMWQNPAEDASKHIDWIRRLYNYMAPYVSMFPRQAYVNYRDLDLGINKESNTSFIEASAWGAKYFKDNFNRLIQVKTKVDPDNFFKHEQSIPPLPVSFRKRKGRGHHGIH

SEQ ID NO: 3717 - protein, 284 aa, Arabidopsis thaliana
  misc_feature (1)..(284): Ceres CDNA ID no. 23515088
  misc_feature (1)..(284): Also Known As Ceres GEMINI ID 5110A1
  misc_feature (113)..(135): Pfam Name: zf-C2H2 Pfam Description: Zinc finger, C2H2 type
  misc_feature (188)..(210): Pfam Name: zf-C2H2 Pfam Description: Zinc finger, C2H2 type
  misc_feature 415862:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
MGQDEVGSDQTQIIKGKRTKRQRSSSTFVVTAATTVTSTSSSAGGSGGERAVSDEYNSAVSSPVTTDCTQEEEDMAICLIMLARGTVLPSPDLKNSRKIHQKISSENSSFYVYECKTCNRTFSSFQALGGHRASHKKPRTSTEEKTRLPLTQPKSSASEEGQNSHFKVSGSALASQASNIINKANKVHECSICGSEFTSGQALGGHMRRHRTAVTTISPVAATAEVSRNSTEEEIEINIGRSMEQQRKYLPLDLNLPAPEDDLRESKFQGIVFSATPALIDCHY

SEQ ID NO: 3718 - DNA, 1176 bp, Populus balsamifera subsp. trichocarpa
  misc_feature (1)..(1176): Ceres ANNOT ID no. 1462217
  misc_feature 415949:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atgagaatgagcagctcaagactccatcaagtatatatacctgtcacatacttggaaggtaaacatacccttccaacaacagcacttggtgccccatactctatgccctattcccacaaacttcacatgagagacagaatcacacaagttgaagatggaagaagaggaggaggaggaggaggagtcacctgtgcatatcacatctctcatgctatatctcacacaaggtctttgatgatggatatggaagctcaagatgagttcatggggtctaatgatcttactcagatcgttaaaggcaaacgcaccaagcggcaaaggtcatcttccccacacaaggtggcgacctcttgctcatcaagtggctatggtggtggtgggggagaaagaggagtgcttatagaggagtatggttcaatttcctctcctacaacttctagtgaggtttgtgagagcacagaagaagaagaagatatggctaattgcttgattctgctagcacaaggtgacgtccctccaaagcaaattcatgaaaataaaggcagtaaagttgagaaatttagtgctcgaaaattctcagatatgtccgcaccaaccattaacaaggccggtttctttgtatacgagtgcaaaacctgtaaccgttgtttcccatcattccaagcattaggtgggcacagagccagtcacaaaaggcctaaggccacagcaccggaagagaaaaaaggtcttgtggtggcatcaatggaggatcttgacgatcgtcaattgaataaaaggagtccttatccttgtctttctctccaaatacccaacaacaacaacgttaacaagggttttcaggctaacaaggctaagattcatgagtgctcaatttgtggctcggagttcatgtcaggtcaagctcttggaggtcacatgagaaggcatagggccaacacaggcgccaaccaagtgagcaatatcagtactgattcatcaagtgccaccactgagtctaaaattcatggtgatcaccatcatacgatcaagccacgaaatatgttggctttggatcttaatctaccagctcctcctgaggatgatcatcacctccgcgaatccaaattccaattatcgtcaacacaacaaccactagtgttctcctccccagccttagtggattgccattactag

SEQ ID NO: 3719 - protein, 357 aa, Populus balsamifera subsp. trichocarpa
  misc_feature (1)..(357): Ceres ANNOT ID no. 1462217
  misc_feature (174)..(196): Pfam Name: zf-C2H2 Pfam Description: Zinc finger, C2H2 type
  misc_feature: SWISSPROT Homolog: ZFP1_WHEAT Zinc-finger protein 1 (WZF1) with e-value of 6.2e-19 and BLAST sequence identity of 32.5
  misc_feature: SWISSPROT Homolog: ZFP1_ARATH Zinc finger protein 1 with e-value of 1.2e-06 and BLAST sequence identity of 24.3
  misc_feature 416043:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(357): Functional Homolog of  Ceres CDNA ID no. 23515088 at SEQ ID NO. 3764 with e-value of 9.09E-56 and BLAST sequence identity of 58.3
MPYSHKLHMRDRITQVEDGRRGGGGGGVTCAYHISHAISHTRSLMMDMEAQDEFMGSNDLTQIVKGKRTKRQRSSSPHKVATSCSSSGYGGGGGERGVLIEEYGSISSPTTSSEVCESTEEEEDMANCLILLAQGDVPPKQIHENKGSKVEKFSARKFSDMSAPTINKAGFFVYECKTCNRCFPSFQALGGHRASHKRPKATAPEEKKGLVVASMEDLDDRQLNKRSPYPCLSLQIPNNNNVNKGFQANKAKIHECSICGSEFMSGQALGGHMRRHRANTGANQVSNISTDSSSATTESKIHGDHHHTIKPRNMLALDLNLPAPPEDDHHLRESKFQLSSTQQPLVFSSPALVDCHY

SEQ ID NO: 3720 - DNA, 861 bp, Populus balsamifera subsp. trichocarpa
  misc_feature (1)..(861): Ceres ANNOT ID no. 1535433
  misc_feature 416153:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atggaagctcaagatgatttcgtggggtctaatgatcttactcagatcattaaaggcaaacgcaccaagcgccaaaggtcatcgtccccgtatatggtgatgacctctagctcatcaagtggttatggtggcggtgatggcggaggagagagaggagtgcttatagaggagcatggttcaatttcctcccctacaacttctagtgaggttactgagaggacagaagaagaagaagatatggctaattgcttgattctactagcacaaggtgaccgtccaaagcaaattcatgaaaacaaaagcggtttcttggtatacgaatgcaaaacttgtaaccggagtttcccatctttccaagcattaggcgggcacagagccagtcacaaaaggcctaaagccacagcggaagagaaaaaaggtcttgtggtggcatcaatggaggatcttggcgtttgtcaattgattaaaaggagtaatcttgatccttctctttctctccaaataggccacaacaataacgtcaacaagggttttcagggtaacaaggctaagactcatgagtgctcaatttgtggctcggagttcatgtctggccaagctcttggcggtcacatgagaaggcacagggctaacacaggcaaccaggcgggcatgatcactactgattcatccagtgccaccgctgagtctaatattcatggtgatcatcatcagatcaagccaaaaaatattttggccttggatcttaatctaccagctcccgaggatgatcatcaccttcgtgaatccaatttccaattcacgtcaacccggcaagcactagtgttctccgccacagccttggtggattgccattactag

SEQ ID NO: 3721 - protein, 286 aa, Populus balsamifera subsp. trichocarpa
  misc_feature (1)..(286): Ceres ANNOT ID no. 1535433
  misc_feature (106)..(128): Pfam Name: zf-C2H2 Pfam Description: Zinc finger, C2H2 type
  misc_feature: SWISSPROT Homolog: ZFP1_WHEAT Zinc-finger protein 1 (WZF1) with e-value of 6.2e-19 and BLAST sequence identity of 32.5
  misc_feature: SWISSPROT Homolog: ZFP1_ARATH Zinc finger protein 1 with e-value of 1.2e-06 and BLAST sequence identity of 24.3
  misc_feature 416237:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(286): Functional Homolog of  Ceres CDNA ID no. 23515088 at SEQ ID NO. 3764 with e-value of 3.89E-55 and BLAST sequence identity of 55.8
MEAQDDFVGSNDLTQIIKGKRTKRQRSSSPYMVMTSSSSSGYGGGDGGGERGVLIEEHGSISSPTTSSEVTERTEEEEDMANCLILLAQGDRPKQIHENKSGFLVYECKTCNRSFPSFQALGGHRASHKRPKATAEEKKGLVVASMEDLGVCQLIKRSNLDPSLSLQIGHNNNVNKGFQGNKAKTHECSICGSEFMSGQALGGHMRRHRANTGNQAGMITTDSSSATAESNIHGDHHQIKPKNILALDLNLPAPEDDHHLRESNFQFTSTRQALVFSATALVDCHY

SEQ ID NO: 3722 - DNA, 888 bp, Populus balsamifera subsp. trichocarpa
  misc_feature (1)..(888): Ceres ANNOT ID no. 1475615
  misc_feature 416332:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atgggttctcaagcaatggtgtctaaggaactatcacaaatcatcaaaggcaagcgtgccaagcgacaaaggccatcttcgccactaacgttagccataacttgtagctcagctagcgtcggggaaaacggaggtgaacgtggtcaaagaatctacaacaactcatcatcgtctgatcctagcacctcagttaaattcacgggaaggacagacgaggaagaagacatggccaattgtttgattcttttggctcaaggcaatcgccaaaacttcaaattatctaagcccgtgactgctgcagcaacaactattacgtataccaacaaggacgcaggtttatatgcttatgagtgcaagatctgtaacaggcgtttcccttcatttcaagcgcttggtggacatagagcgagtcacaagaaatcaagacagggtaatattagtgaagacaagaaagcgttggcagtgacagtacggatgggtgatcaagaggaaaatggaaatgataatgatatgagcaccgccctttcattgcaaatagtaaatgatggggttctatgtagtaacaatgttaaatctaataaggtccatgagtgctccatatgcggtgatgagttttcgtctggtcaggctttaggtggtcatatgagacggcacagggcgttcgctcccaccacaaccgcaaccgcaacaacgttaacatctagaagtttggaaagaagtaagcctgatcatgagtccgaagaatccaagaaaccaagagatatccaactactggatcttaatcttccagcagcagaagatgatctccgagaatcaaagtttcactttgcgtccaaggaacaagttcttgtcttcacagcttcttccttggttgattgccattactaa

SEQ ID NO: 3723 - protein, 295 aa, Populus balsamifera subsp. trichocarpa
  misc_feature (1)..(295): Ceres ANNOT ID no. 1475615
  misc_feature (196)..(218): Pfam Name: zf-C2H2 Pfam Description: Zinc finger, C2H2 type
  misc_feature: SWISSPROT Homolog: ZFP1_WHEAT Zinc-finger protein 1 (WZF1) with e-value of 6.2e-19 and BLAST sequence identity of 32.5
  misc_feature: SWISSPROT Homolog: ZFP1_ARATH Zinc finger protein 1 with e-value of 1.2e-06 and BLAST sequence identity of 24.3
  misc_feature 416416:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(295): Functional Homolog of  Ceres CDNA ID no. 23515088 at SEQ ID NO. 3764 with e-value of 2.00E-51 and BLAST sequence identity of 51.4
MGSQAMVSKELSQIIKGKRAKRQRPSSPLTLAITCSSASVGENGGERGQRIYNNSSSSDPSTSVKFTGRTDEEEDMANCLILLAQGNRQNFKLSKPVTAAATTITYTNKDAGLYAYECKICNRRFPSFQALGGHRASHKKSRQGNISEDKKALAVTVRMGDQEENGNDNDMSTALSLQIVNDGVLCSNNVKSNKVHECSICGDEFSSGQALGGHMRRHRAFAPTTTATATTLTSRSLERSKPDHESEESKKPRDIQLLDLNLPAAEDDLRESKFHFASKEQVLVFTASSLVDCHY

SEQ ID NO: 3724 - protein, 640 aa, Arabidopsis thaliana
  misc_feature (1)..(640): Ceres CDNA ID no. 23515246
  misc_feature (1)..(640): Also Known As Ceres GEMINI ID 5110D5
  misc_feature (242)..(556): Pfam Name: GRAS Pfam Description: GRAS family transcription factor
  misc_feature 416528:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
MPLSFERFQGEGVFGLSSSSFYSDSQKIWSNQDKTEAKQEDLGYVVGGFLPEPTSVLDALRSPSPLASYSSTTTTLSSSHGGGGTTVTNTTVTAGDDNNNNKCSQMGLDDLDGVLSASSPGQEQSILRLIMDPGSAFGVFDPGFGFGSGSGPVSAPVSDNSNLLCNFPFQEITNPAEALINPSNHCLFYNPPLSPPAKRFNSGSLHQPVFPLSDPDPGHDPVRRQHQFQFPFYHNNQQQQFPSSSSSTAVAMVPVPSPGMAGDDQSVIIEQLFNAAELIGTTGNNNGDHTVLAQGILARLNHHLNTSSNHKSPFQRAASHIAEALLSLIHNESSPPLITPENLILRIAAYRSFSETSPFLQFVNFTANQSILESCNESGFDRIHIIDFDVGYGGQWSSLMQELASGVGGRRRNRASSLKLTVFAPPPSTVSDEFELRFTEENLKTFAGEVKIPFEIELLSVELLLNPAYWPLSLRSSEKEAIAVNLPVNSVASGYLPLILRFLKQLSPNIVVCSDRGCDRNDAPFPNAVIHSLQYHTSLLESLDANQNQDDSSIERFWVQPSIEKLLMKRHRWIERSPPWRILFTQCGFSPASLSQMAEAQAECLLQRNPVRGFHVEKRQSSLVMCWQRKELVTVSAWKC

SEQ ID NO: 3725 - DNA, 1926 bp, Populus balsamifera subsp. trichocarpa
  misc_feature (1)..(1926): Ceres ANNOT ID no. 1539565
  misc_feature 416677:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atgcccctaccctctgaggactttcaagggaagggggtgttagatttctcttcgtctactacttcctctccaaattcactgtatcaacaccaccagaagtggcagaacaacaacagcaaagaaagttgtggtttttttttgggcagtgctgagcccacatctgtgcttgatacaataagcagacaaagcccaccaacatcgtcctcaacactgtcttcttctcaaggcggaggtggtggcggcggaggagcctccaccgacaccaccaacgacgtggcagcagctggtggaagcaacccttgtgtagatgaaaaatgtggacagcaacttggaatggaggattgggagagtgtgttgccaggttctcctagtcaagagcagtcaattttaaggctaattatgggtgatattgaggacccatccgtgggacttcacaaactgttacaaggtggaagtaggtctctagatatggagcatgcgtcgggttttggtgttgtagatcaagtttttggctttgatgtatccagtatgagttctgcaagtgccaatttggttgccaacaacaacaacattgatccttcttcaatccatgagcatcataataaccagcatttcttatcaccaccgccgtcgaaaaggcttaattctgggcttgttggagtcaattatgtgccaaaagtctttgattcgaggcctccagagttgtttcttccacgacaacatcaacagcagcagcagaatcatcagtttcgaatgttgcagcagcagcagcagaggcagggagtgatcacgaatcagaaaattgcaagcgatgaattggcaaaccagcagcagcttcaacaggcaataataaacccgatatgtcaagcagcagagctgatcgaaactgggaatccggtacttgcgcaagggatattggcgcggctcaatcaccagctctctcttcctatcggtaagccttaccaaaggactgctttttacttcaaggatgccttgcagttgcttctccatacgagcagcaacaactcaattgataatgcttgtagcctgattttcaagatcggtgcttataaatctttctctgagatctcaccaatccttcagtttgcgaattttacttgcaaccaagttcttctcgaggcttctgagggttttgagagaattcatattgttgattttgatattggatatggtggacaatgggcttctcttatgcaagaactggctttgaggactggaggtgccccttctcttaaaatcacagcttttgcttctccttcctcacatgatgagctcgagcttggtttcactcgagaaaatttaagaatctttgcaagtgaaatcaacatgccattcgagcttgaaattttaagccttgaatccttgggttctggttcttggccaatgcctcttcgcacgccggaaaaggaagtaactgctgtgaatcttccaattggctccttttcaaatgacacatcaactcttcctttggcgcttcgctttgtaaagcaactctcacccaaagtcgtggtctctttggacagaggctgtgaccgaagcgacctcccatttgcgcaccatgtaaatcatgccattcaatcttattcaaccctgctggaatcactggatgccgtgaatgtgaacctagatgcattgcaaaagattgagagttttttggtgcagccaggtattgagaaaattgtattgggtcgtcatcgttgccctgataggacttctccttggaggagtctctttttacagtctggtttcactccattgcctttcagtaactttaccgagtcacaagccgagtatttggtgcatcgtactccagttaggggtttccatgtcgaaaagaggcaatcttcgcttgttctttgctggcaacggaaggacctcatagcagcttctgcttggaggtgttaa

SEQ ID NO: 3726 - protein, 641 aa, Populus balsamifera subsp. trichocarpa
  misc_feature (1)..(641): Ceres ANNOT ID no. 1539565
  misc_feature (289)..(555): Pfam Name: GRAS Pfam Description: GRAS family transcription factor
  misc_feature: SWISSPROT Homolog: RGA1_BRACM DELLA protein RGA1 (RGA-like protein 1) (BrRGA1) with e-value of 2.8e-33 and BLAST sequence identity of 28.7
  misc_feature: SWISSPROT Homolog: RGA_ARATH DELLA protein RGA (Repressor on the ga1-3 mutant) with e-value of 3.9e-29 and BLAST sequence identity of 30.9
  misc_feature: SWISSPROT Homolog: RGA_ARATH GAI-related sequence Restoration of growth on ammonia protein 1
  misc_feature: SWISSPROT Homolog: RGA2_BRACM DELLA protein RGA2 (RGA-like protein 2) (BrRGA2) with e-value of 7.2e-28 and BLAST sequence identity of 30.9
  misc_feature: SWISSPROT Homolog: GAIP_CUCMA DELLA protein GAIP (Gibberellic acid-insensitive phloem protein) GAIP (CmGAIP) with e-value of 3.5e-27 and BLAST sequence identity of 28.4
  misc_feature: SWISSPROT Homolog: GAIPB_CUCMA DELLA protein GAIP-B Gibberellic acid-insensitive phloem protein B (GAIP-B) (CmGAIP-B) with e-value of 8.1e-27 and BLAST sequence identity of 27.8
  misc_feature 416822:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(641): Functional Homolog of  Ceres CDNA ID no. 23515246 at SEQ ID NO. 3771 with e-value of 1.40E-123 and BLAST sequence identity of 51.5
MPLPSEDFQGKGVLDFSSSTTSSPNSLYQHHQKWQNNNSKESCGFFLGSAEPTSVLDTISRQSPPTSSSTLSSSQGGGGGGGGASTDTTNDVAAAGGSNPCVDEKCGQQLGMEDWESVLPGSPSQEQSILRLIMGDIEDPSVGLHKLLQGGSRSLDMEHASGFGVVDQVFGFDVSSMSSASANLVANNNNIDPSSIHEHHNNQHFLSPPPSKRLNSGLVGVNYVPKVFDSRPPELFLPRQHQQQQQNHQFRMLQQQQQRQGVITNQKIASDELANQQQLQQAIINPICQAAELIETGNPVLAQGILARLNHQLSLPIGKPYQRTAFYFKDALQLLLHTSSNNSIDNACSLIFKIGAYKSFSEISPILQFANFTCNQVLLEASEGFERIHIVDFDIGYGGQWASLMQELALRTGGAPSLKITAFASPSSHDELELGFTRENLRIFASEINMPFELEILSLESLGSGSWPMPLRTPEKEVTAVNLPIGSFSNDTSTLPLALRFVKQLSPKVVVSLDRGCDRSDLPFAHHVNHAIQSYSTLLESLDAVNVNLDALQKIESFLVQPGIEKIVLGRHRCPDRTSPWRSLFLQSGFTPLPFSNFTESQAEYLVHRTPVRGFHVEKRQSSLVLCWQRKDLIAASAWRC

SEQ ID NO: 3727 - DNA, 1935 bp, Populus balsamifera subsp. trichocarpa
  misc_feature (1)..(1935): Ceres ANNOT ID no. 1486151
  misc_feature 416979:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atgaaggccatgcccctaccctctgaggactttcaagggaagggggtgttagatttctcttcgtctactacttcctctccaaattcactgtatcaacaccaccagaagtggcagaacaacaacagcaaagaaagttgtggtttttttttgggcagtgctgagcccacatctgtgcttgatacaataagcagacaaagcccaccaacatcgtcctcaacactgtcttcttctcaaggcggaggtggtggcggcggaggagcctccaccgacaccaccaacgacgtggcagcagctggtggaagcaacccttgtgtagatgaaaaatgtggacagcaacttggaatggaggattgggagagtgtgttgccaggttctcctagtcaagagcagtcaattttaaggctaattatgggtgatattgaggacccatccgtgggacttcacaaactgttacaaggtggaagtaggtctctagatatggagcatgcgtcgggttttggtgttgtagatcaagtttttggctttgatgtatccagtatgagttctgcaagtgccaatttggttgccaacaacaacaacattgatccttcttcaatccatgagcatcataataaccagcatttcttatcaccaccgccgtcgaaaaggcttaattctgggcttgttggagtcaattatgtgccaaaagtctttgattcgaggcctccagagttgtttcttccacgacaacatcaacagcagcagcagaatcatcagtttcgaatgttgcagcagcagcagcagaggcagggagtgatcacgaatcagaaaattgcaagcgatgaattggcaaaccagcagcagcttcaacaggcaataataaacccgatatgtcaagcagcagagctgatcgaaactgggaatccggtacttgcgcaagggatattggcgcggctcaatcaccagctctctcttcctatcggtaagccttaccaaaggactgctttttacttcaaggatgccttgcagttgcttctccatacgagcagcaacaactcaattgataatgcttgtagcctgattttcaagatcggtgcttataaatctttctctgagatctcaccaatccttcagtttgcgaattttacttgcaaccaagttcttctcgaggcttctgagggttttgagagaattcatattgttgattttgatattggatatggtggacaatgggcttctcttatgcaagaactggctttgaggactggaggtgccccttctcttaaaatcacagcttttgcttctccttcctcacatgatgagctcgagcttggtttcactcgagaaaatttaagaatctttgcaagtgaaatcaacatgccattcgagcttgaaattttaagccttgaatccttgggttctggttcttggccaatgcctcttcgcacgccggaaaaggaagtaactgctgtgaatcttccaattggctccttttcaaatgacacatcaactcttcctttggcgcttcgctttgtaaagcaactctcacccaaagtcgtggtctctttggacagaggctgtgaccgaagcgacctcccatttgcgcaccatgtaaatcatgccattcaatcttattcaaccctgctggaatcactggatgccgtgaatgtgaacctagatgcattgcaaaagattgagagttttttggtgcagccaggtattgagaaaattgtattgggtcgtcatcgttgccctgataggacttctccttggaggagtctctttttacagtctggtttcactccattgcctttcagtaactttaccgagtcacaagccgagtatttggtgcatcgtactccagttaggggtttccatgtcgaaaagaggcaatcttcgcttgttctttgctggcaacggaaggacctcatagcagcttctgcttggaggtgttaa

SEQ ID NO: 3728 - protein, 644 aa, Populus balsamifera subsp. trichocarpa
  misc_feature (1)..(644): Ceres ANNOT ID no. 1486151
  misc_feature (292)..(558): Pfam Name: GRAS Pfam Description: GRAS family transcription factor
  misc_feature: SWISSPROT Homolog: RGA1_BRACM DELLA protein RGA1 (RGA-like protein 1) (BrRGA1) with e-value of 2.8e-33 and BLAST sequence identity of 28.7
  misc_feature: SWISSPROT Homolog: RGA_ARATH DELLA protein RGA (Repressor on the ga1-3 mutant) with e-value of 3.9e-29 and BLAST sequence identity of 30.9
  misc_feature: SWISSPROT Homolog: RGA_ARATH GAI-related sequence Restoration of growth on ammonia protein 1
  misc_feature: SWISSPROT Homolog: RGA2_BRACM DELLA protein RGA2 (RGA-like protein 2) (BrRGA2) with e-value of 7.2e-28 and BLAST sequence identity of 30.9
  misc_feature: SWISSPROT Homolog: GAIP_CUCMA DELLA protein GAIP (Gibberellic acid-insensitive phloem protein) GAIP (CmGAIP) with e-value of 3.5e-27 and BLAST sequence identity of 28.4
  misc_feature: SWISSPROT Homolog: GAIPB_CUCMA DELLA protein GAIP-B Gibberellic acid-insensitive phloem protein B (GAIP-B) (CmGAIP-B) with e-value of 8.1e-27 and BLAST sequence identity of 27.8
  misc_feature 417124:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(644): Functional Homolog of  Ceres CDNA ID no. 23515246 at SEQ ID NO. 3771 with e-value of 1.40E-123 and BLAST sequence identity of 51.5
MKAMPLPSEDFQGKGVLDFSSSTTSSPNSLYQHHQKWQNNNSKESCGFFLGSAEPTSVLDTISRQSPPTSSSTLSSSQGGGGGGGGASTDTTNDVAAAGGSNPCVDEKCGQQLGMEDWESVLPGSPSQEQSILRLIMGDIEDPSVGLHKLLQGGSRSLDMEHASGFGVVDQVFGFDVSSMSSASANLVANNNNIDPSSIHEHHNNQHFLSPPPSKRLNSGLVGVNYVPKVFDSRPPELFLPRQHQQQQQNHQFRMLQQQQQRQGVITNQKIASDELANQQQLQQAIINPICQAAELIETGNPVLAQGILARLNHQLSLPIGKPYQRTAFYFKDALQLLLHTSSNNSIDNACSLIFKIGAYKSFSEISPILQFANFTCNQVLLEASEGFERIHIVDFDIGYGGQWASLMQELALRTGGAPSLKITAFASPSSHDELELGFTRENLRIFASEINMPFELEILSLESLGSGSWPMPLRTPEKEVTAVNLPIGSFSNDTSTLPLALRFVKQLSPKVVVSLDRGCDRSDLPFAHHVNHAIQSYSTLLESLDAVNVNLDALQKIESFLVQPGIEKIVLGRHRCPDRTSPWRSLFLQSGFTPLPFSNFTESQAEYLVHRTPVRGFHVEKRQSSLVLCWQRKDLIAASAWRC

SEQ ID NO: 3729 - DNA, 2190 bp, Populus balsamifera subsp. trichocarpa
  misc_feature (1)..(2190): Ceres ANNOT ID no. 1497018
  misc_feature 417281:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atgcccttaccctttgaggactttcaagcgaaggggctgttgggtttctcttcttattcttcttcctctccagatccattccatcaacaccaccacaagtggcaaaacaacaacagcaaagaaagttgtggttttcttgtgggcagtactgagcccacatctgtgcttgacacaataagcagacaaagcccgccaacatcctcctcaacactgtcttcttctcaaggcggaggaggtggtggcggaggagcctccaccgacaccaccaacggcgcggcaggtgctggtggaagcagccctagtgtagatgaaaaatgcggaccgcaacttggaatggaggactgggagagtgtgttgtcagggtctcctattcaagaacagtccatattaaggttaattatgggtgatatcgaggacccatctttaggactttacaagctgttacaaagtggaagtaggtctcaagatatggagcttaatgcatcaggtttcggtgtagtagatcaagtttttggctttgaagtacccaatatgagtacagcaagtgccaacttggctgtcaaccacaacaattttgacccttcttcaatccatggtacttctcctgatttcccactcgttaacctcaaagctactataagttttaatattggttgtgtacttaaccaaaatccaacaccaaatcctgttttgtttacttcagggatcaatcttttgccaggtttgtttcagcaacaccaccagcaggcagcatttgatcaagacgagaagcctcagattttgaatccaggggcgatgatcaaccaaaatcaacatcagtttgtgcaaaacccagctatgcttttgccattgtcatatgcacaattagaagagcatcataataacctgcattccttatcaccaccgccattgaaaaggctgaatactgggcctgttggagccaatcatgtgcccaaagtctttgatttgaggcctccagaattgtttcttccccgacagcagcagcagaatcatcagtttcaaatgacgcagcatcaaaggcagggaatgattacgaagcagaaaattgcaagtgatgaattggcaaaccagcagcagcttcaacaggcaataataaacccgatatgtcaagcagcagagctgatcgaaactgggaatccggtacttgcgcaagggatattggcgcggctcaatcaccagctctctgttccaatcggtaagccttatcaaaggactgccttttacttcaaggaggccttgcagttacttctcaatatgaacaataacaactctattggtactgcttgtaacctgattttcaagattggtgcttataaatccttctctgagatctcaccgatccttcagtttgcgagttttacttgtaaccaagcccttcttgaggcttttgaggggtttgagagaattcacgttgttgattttgatattgggtatggtgggcagtgggcttctcttatgcaagagctggctttgaggaatggaggtgccccatctcttaaaatcaccgcttttgcttctccttcttcacatgatgaacttgagcttggtttcactcaagaaaatttaaaaatgtttgcaagtgaaatcaacatgccatttgagattgaaattttaagccttgaatccttgagctctggttcttggccaatgcctctccgcctaacagaaaaggaagtaattgctgtcaatcttccagttggctccttttcaaattacccatcaactcttcctttggtgcttcgctttgtgaaacagctcttgcccaaagttgtggtctctttggacagaggctgtgaccgaagcgacctcccatttgcacaccatgtaaatcacgccattcaatcttatacaagcctgcttgaatcactggatgccgtgaatgtgaatttagatgcagtgcaaaagattgagaggtttttggtccaaccaggcattgaaaaaacagtactgggtcggcatagctgccctgataggactcctccttggagaagtctgtttttgcagtctggttttactccattgactttcagcaactttaccgagtcacaggctgagtatttagtgcaacgtactccagttaggggtttccatgttgaaaagaggcaatcttcgcttgttctttgctggcaacataaggacctcgtttcagcttctgcttggaggtgttaa

SEQ ID NO: 3730 - protein, 729 aa, Populus balsamifera subsp. trichocarpa
  misc_feature (1)..(729): Ceres ANNOT ID no. 1497018
  misc_feature (377)..(642): Pfam Name: GRAS Pfam Description: GRAS family transcription factor
  misc_feature: SWISSPROT Homolog: RGA1_BRACM DELLA protein RGA1 (RGA-like protein 1) (BrRGA1) with e-value of 2.8e-33 and BLAST sequence identity of 28.7
  misc_feature: SWISSPROT Homolog: RGA_ARATH DELLA protein RGA (Repressor on the ga1-3 mutant) with e-value of 3.9e-29 and BLAST sequence identity of 30.9
  misc_feature: SWISSPROT Homolog: RGA_ARATH GAI-related sequence Restoration of growth on ammonia protein 1
  misc_feature: SWISSPROT Homolog: RGA2_BRACM DELLA protein RGA2 (RGA-like protein 2) (BrRGA2) with e-value of 7.2e-28 and BLAST sequence identity of 30.9
  misc_feature: SWISSPROT Homolog: GAIP_CUCMA DELLA protein GAIP (Gibberellic acid-insensitive phloem protein) GAIP (CmGAIP) with e-value of 3.5e-27 and BLAST sequence identity of 28.4
  misc_feature: SWISSPROT Homolog: GAIPB_CUCMA DELLA protein GAIP-B Gibberellic acid-insensitive phloem protein B (GAIP-B) (CmGAIP-B) with e-value of 8.1e-27 and BLAST sequence identity of 27.8
  misc_feature 417434:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(729): Functional Homolog of  Ceres CDNA ID no. 23515246 at SEQ ID NO. 3771 with e-value of 1.60E-113 and BLAST sequence identity of 52.3
MPLPFEDFQAKGLLGFSSYSSSSPDPFHQHHHKWQNNNSKESCGFLVGSTEPTSVLDTISRQSPPTSSSTLSSSQGGGGGGGGASTDTTNGAAGAGGSSPSVDEKCGPQLGMEDWESVLSGSPIQEQSILRLIMGDIEDPSLGLYKLLQSGSRSQDMELNASGFGVVDQVFGFEVPNMSTASANLAVNHNNFDPSSIHGTSPDFPLVNLKATISFNIGCVLNQNPTPNPVLFTSGINLLPGLFQQHHQQAAFDQDEKPQILNPGAMINQNQHQFVQNPAMLLPLSYAQLEEHHNNLHSLSPPPLKRLNTGPVGANHVPKVFDLRPPELFLPRQQQQNHQFQMTQHQRQGMITKQKIASDELANQQQLQQAIINPICQAAELIETGNPVLAQGILARLNHQLSVPIGKPYQRTAFYFKEALQLLLNMNNNNSIGTACNLIFKIGAYKSFSEISPILQFASFTCNQALLEAFEGFERIHVVDFDIGYGGQWASLMQELALRNGGAPSLKITAFASPSSHDELELGFTQENLKMFASEINMPFEIEILSLESLSSGSWPMPLRLTEKEVIAVNLPVGSFSNYPSTLPLVLRFVKQLLPKVVVSLDRGCDRSDLPFAHHVNHAIQSYTSLLESLDAVNVNLDAVQKIERFLVQPGIEKTVLGRHSCPDRTPPWRSLFLQSGFTPLTFSNFTESQAEYLVQRTPVRGFHVEKRQSSLVLCWQHKDLVSASAWRC

SEQ ID NO: 3731 - DNA, 2199 bp, Populus balsamifera subsp. trichocarpa
  misc_feature (1)..(2199): Ceres ANNOT ID no. 1444071
  misc_feature 417606:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atgaaggccatgcccttaccctttgaggactttcaagcgaaggggctgttgggtttctcttcttattcttcttcctctccagatccattccatcaacaccaccacaagtggcaaaacaacaacagcaaagaaagttgtggttttcttgtgggcagtactgagcccacatctgtgcttgacacaataagcagacaaagcccgccaacatcctcctcaacactgtcttcttctcaaggcggaggaggtggtggcggaggagcctccaccgacaccaccaacggcgcggcaggtgctggtggaagcagccctagtgtagatgaaaaatgcggaccgcaacttggaatggaggactgggagagtgtgttgtcagggtctcctattcaagaacagtccatattaaggttaattatgggtgatatcgaggacccatctttaggactttacaagctgttacaaagtggaagtaggtctcaagatatggagcttaatgcatcaggtttcggtgtagtagatcaagtttttggctttgaagtacccaatatgagtacagcaagtgccaacttggctgtcaaccacaacaattttgacccttcttcaatccatggtacttctcctgatttcccactcgttaacctcaaagctactataagttttaatattggttgtgtacttaaccaaaatccaacaccaaatcctgttttgtttacttcagggatcaatcttttgccaggtttgtttcagcaacaccaccagcaggcagcatttgatcaagacgagaagcctcagattttgaatccaggggcgatgatcaaccaaaatcaacatcagtttgtgcaaaacccagctatgcttttgccattgtcatatgcacaattagaagagcatcataataacctgcattccttatcaccaccgccattgaaaaggctgaatactgggcctgttggagccaatcatgtgcccaaagtctttgatttgaggcctccagaattgtttcttccccgacagcagcagcagaatcatcagtttcaaatgacgcagcatcaaaggcagggaatgattacgaagcagaaaattgcaagtgatgaattggcaaaccagcagcagcttcaacaggcaataataaacccgatatgtcaagcagcagagctgatcgaaactgggaatccggtacttgcgcaagggatattggcgcggctcaatcaccagctctctgttccaatcggtaagccttatcaaaggactgccttttacttcaaggaggccttgcagttacttctcaatatgaacaataacaactctattggtactgcttgtaacctgattttcaagattggtgcttataaatccttctctgagatctcaccgatccttcagtttgcgagttttacttgtaaccaagcccttcttgaggcttttgaggggtttgagagaattcacgttgttgattttgatattgggtatggtgggcagtgggcttctcttatgcaagagctggctttgaggaatggaggtgccccatctcttaaaatcaccgcttttgcttctccttcttcacatgatgaacttgagcttggtttcactcaagaaaatttaaaaatgtttgcaagtgaaatcaacatgccatttgagattgaaattttaagccttgaatccttgagctctggttcttggccaatgcctctccgcctaacagaaaaggaagtaattgctgtcaatcttccagttggctccttttcaaattacccatcaactcttcctttggtgcttcgctttgtgaaacagctcttgcccaaagttgtggtctctttggacagaggctgtgaccgaagcgacctcccatttgcacaccatgtaaatcacgccattcaatcttatacaagcctgcttgaatcactggatgccgtgaatgtgaatttagatgcagtgcaaaagattgagaggtttttggtccaaccaggcattgaaaaaacagtactgggtcggcatagctgccctgataggactcctccttggagaagtctgtttttgcagtctggttttactccattgactttcagcaactttaccgagtcacaggctgagtatttagtgcaacgtactccagttaggggtttccatgttgaaaagaggcaatcttcgcttgttctttgctggcaacataaggacctcgtttcagcttctgcttggaggtgttaa

SEQ ID NO: 3732 - protein, 729 aa, Populus balsamifera subsp. trichocarpa; identical to SEQ ID NO: 3730
  misc_feature (1)..(729): Ceres ANNOT ID no. 1444071
  misc_feature (377)..(642): Pfam Name: GRAS Pfam Description: GRAS family transcription factor
  misc_feature: SWISSPROT Homolog: RGA1_BRACM DELLA protein RGA1 (RGA-like protein 1) (BrRGA1) with e-value of 2.8e-33 and BLAST sequence identity of 28.7
  misc_feature: SWISSPROT Homolog: RGA_ARATH DELLA protein RGA (Repressor on the ga1-3 mutant) with e-value of 3.9e-29 and BLAST sequence identity of 30.9
  misc_feature: SWISSPROT Homolog: RGA_ARATH GAI-related sequence Restoration of growth on ammonia protein 1
  misc_feature: SWISSPROT Homolog: RGA2_BRACM DELLA protein RGA2 (RGA-like protein 2) (BrRGA2) with e-value of 7.2e-28 and BLAST sequence identity of 30.9
  misc_feature: SWISSPROT Homolog: GAIP_CUCMA DELLA protein GAIP (Gibberellic acid-insensitive phloem protein) GAIP (CmGAIP) with e-value of 3.5e-27 and BLAST sequence identity of 28.4
  misc_feature: SWISSPROT Homolog: GAIPB_CUCMA DELLA protein GAIP-B Gibberellic acid-insensitive phloem protein B (GAIP-B) (CmGAIP-B) with e-value of 8.1e-27 and BLAST sequence identity of 27.8
  misc_feature 417759:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(729): Functional Homolog of  Ceres CDNA ID no. 23515246 at SEQ ID NO. 3771 with e-value of 1.60E-113 and BLAST sequence identity of 52.3

SEQ ID NO: 3733 - DNA, 2208 bp, Populus balsamifera subsp. trichocarpa
  misc_feature (1)..(2208): Ceres ANNOT ID no. 1497013
  misc_feature 417931:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atgcccctaccctttgagaactttcaagggaaggggctgccggatttctcttcttcttctactacttcctctccagatccattccatcaacaccaccacaagtggcaaaacaacgacagcaaagaaagttgtggttttcttgtgggcagtactgagcccacatctgtgcttgacacaataagtagacaaagcccgccaacatcctcctcaacgctgtcttcttctcaaggcggaggtggcggcggcggaggagcctccaccgaaaccaccaacgacgtcgcagctgcttgtggaagcagccctagtgtagatgaaaaatgcggaccgcaacttggaatggaggactgggagagtgtgttgtcagggtctcctagtcaagaacagtccataataaggctaattatgggtgatatcgaggacccagctttaggacttaacaagctgttacaaagtggaagtaggtctcaagatacggagcttaatgcatcaggtttcggcgtggtagatcaagtttttggctttgaagtacccaatatgtgtactgcaagtgccaacttggttgtcaacaacaacaatattgacccttcttcaatccatggtacttttcttgattcccctctggttaaccacgaagttactagaatttttagtattggttgtgtacttcaccaaaacccaacaccaaatcctgttttgtttacttcagggatcagtcttttgccaggtttgtttcagcaacaccagcagcagcaggcatcatttgatcaagacgagaagcctcagattttgaatcctggggcgataaccaaccaaaatcaacatcagtttgtgcaaaacccagctatgcttttgccattgtcatatgcacaattagaagagcatcataataacctgcatttcttatcaccaccgccattgaaaaggctgaattctgggcatgttggagccaattatatgcccaaagtctttgatttgaggcctccagagttgtttcttccgctacaacagcagcagcagcagaatcatcagtttcaaatgatgcagcagcaaaggcagggaatgattacgaagcagaaaattgcaattgatgaattggcaaaccagcagcagcttcaacacgcaataataaacccgatatgtgaagcagcagagctgatcgaaactgggaatccggtacttgcgcaagggatattggcgcggctcaatcaccagctctctgttccaatcggtaagccttatcaaaggactgctttttacttcaaggaggccttgcaattacttctcaatatgaacaataacaactctattggtactgcttataacccgattttcaagattggtgcttataaatccttctctgagatctcaccgatccttcagtttgcaaattttacttgtaaccaagcccttcttgaggcttttgaggggtttgagagaattcacgttgttgattttgatattgggtatggtgggcagtgggcttctcttatgcaagaactggctttgaggaatggaggcgccccttctcttaaaatcactgcttttgtttctccttcctcacatgatgagcttgagcttgagcttggttttactcaagaaaatttaagaatctttgctagtgaaatcaacatgccattcgagcttgaaattttaagccttgaatccttgggctctgtttctcggccaatgactctttgcacattggacaaggaagtaattgctgtgaatcttccacttggcgtcttttctaattacccatcgactcttcctgttgtgcttcgctttgtaaagcagctctcgcccaaagttgtggtctctttggacagtggttgtgaccgaagtgatctcccatttgctcaccatataaatcatgccattcaatcttatacaagcctgcttgaatcacttgatgctgtgaatgtgaacttagatatactgcaaaagattgagaggttcttggtccaaccatgcattgaaagaatggtactgggtcgacatggttgctctgataggacgaccccttggaggagtctgtttttgcagtctggtttcactccattgactttcagtaactttactgagtcacaagctgagtgtttggtgcaacgtactcctgttaagggtttccatgttgaaaagaagcagtcttcacttgttctttgctggcaacagagggacctcgtatcagtttctgcttggagctgttaa

SEQ ID NO: 3734 - protein, 735 aa, Populus balsamifera subsp. trichocarpa
  misc_feature (1)..(735): Ceres ANNOT ID no. 1497013
  misc_feature (349)..(649): Pfam Name: GRAS Pfam Description: GRAS family transcription factor
  misc_feature: SWISSPROT Homolog: RGA1_BRACM DELLA protein RGA1 (RGA-like protein 1) (BrRGA1) with e-value of 2.8e-33 and BLAST sequence identity of 28.7
  misc_feature: SWISSPROT Homolog: RGA_ARATH DELLA protein RGA (Repressor on the ga1-3 mutant) with e-value of 3.9e-29 and BLAST sequence identity of 30.9
  misc_feature: SWISSPROT Homolog: RGA_ARATH GAI-related sequence Restoration of growth on ammonia protein 1
  misc_feature: SWISSPROT Homolog: RGA2_BRACM DELLA protein RGA2 (RGA-like protein 2) (BrRGA2) with e-value of 7.2e-28 and BLAST sequence identity of 30.9
  misc_feature: SWISSPROT Homolog: GAIP_CUCMA DELLA protein GAIP (Gibberellic acid-insensitive phloem protein) GAIP (CmGAIP) with e-value of 3.5e-27 and BLAST sequence identity of 28.4
  misc_feature: SWISSPROT Homolog: GAIPB_CUCMA DELLA protein GAIP-B Gibberellic acid-insensitive phloem protein B (GAIP-B) (CmGAIP-B) with e-value of 8.1e-27 and BLAST sequence identity of 27.8
  misc_feature 418084:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(735): Functional Homolog of  Ceres CDNA ID no. 23515246 at SEQ ID NO. 3771 with e-value of 6.70E-108 and BLAST sequence identity of 52.3
MPLPFENFQGKGLPDFSSSSTTSSPDPFHQHHHKWQNNDSKESCGFLVGSTEPTSVLDTISRQSPPTSSSTLSSSQGGGGGGGGASTETTNDVAAACGSSPSVDEKCGPQLGMEDWESVLSGSPSQEQSIIRLIMGDIEDPALGLNKLLQSGSRSQDTELNASGFGVVDQVFGFEVPNMCTASANLVVNNNNIDPSSIHGTFLDSPLVNHEVTRIFSIGCVLHQNPTPNPVLFTSGISLLPGLFQQHQQQQASFDQDEKPQILNPGAITNQNQHQFVQNPAMLLPLSYAQLEEHHNNLHFLSPPPLKRLNSGHVGANYMPKVFDLRPPELFLPLQQQQQQNHQFQMMQQQRQGMITKQKIAIDELANQQQLQHAIINPICEAAELIETGNPVLAQGILARLNHQLSVPIGKPYQRTAFYFKEALQLLLNMNNNNSIGTAYNPIFKIGAYKSFSEISPILQFANFTCNQALLEAFEGFERIHVVDFDIGYGGQWASLMQELALRNGGAPSLKITAFVSPSSHDELELELGFTQENLRIFASEINMPFELEILSLESLGSVSRPMTLCTLDKEVIAVNLPLGVFSNYPSTLPVVLRFVKQLSPKVVVSLDSGCDRSDLPFAHHINHAIQSYTSLLESLDAVNVNLDILQKIERFLVQPCIERMVLGRHGCSDRTTPWRSLFLQSGFTPLTFSNFTESQAECLVQRTPVKGFHVEKKQSSLVLCWQQRDLVSVSAWSC

SEQ ID NO: 3735 - DNA, 2217 bp, Populus balsamifera subsp. trichocarpa
  misc_feature (1)..(2217): Ceres ANNOT ID no. 1444066
  misc_feature 418256:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atgaaggccatgcccctaccctttgagaactttcaagggaaggggctgccggatttctcttcttcttctactacttcctctccagatccattccatcaacaccaccacaagtggcaaaacaacgacagcaaagaaagttgtggttttcttgtgggcagtactgagcccacatctgtgcttgacacaataagtagacaaagcccgccaacatcctcctcaacgctgtcttcttctcaaggcggaggtggcggcggcggaggagcctccaccgaaaccaccaacgacgtcgcagctgcttgtggaagcagccctagtgtagatgaaaaatgcggaccgcaacttggaatggaggactgggagagtgtgttgtcagggtctcctagtcaagaacagtccataataaggctaattatgggtgatatcgaggacccagctttaggacttaacaagctgttacaaagtggaagtaggtctcaagatacggagcttaatgcatcaggtttcggcgtggtagatcaagtttttggctttgaagtacccaatatgtgtactgcaagtgccaacttggttgtcaacaacaacaatattgacccttcttcaatccatggtacttttcttgattcccctctggttaaccacgaagttactagaatttttagtattggttgtgtacttcaccaaaacccaacaccaaatcctgttttgtttacttcagggatcagtcttttgccaggtttgtttcagcaacaccagcagcagcaggcatcatttgatcaagacgagaagcctcagattttgaatcctggggcgataaccaaccaaaatcaacatcagtttgtgcaaaacccagctatgcttttgccattgtcatatgcacaattagaagagcatcataataacctgcatttcttatcaccaccgccattgaaaaggctgaattctgggcatgttggagccaattatatgcccaaagtctttgatttgaggcctccagagttgtttcttccgctacaacagcagcagcagcagaatcatcagtttcaaatgatgcagcagcaaaggcagggaatgattacgaagcagaaaattgcaattgatgaattggcaaaccagcagcagcttcaacacgcaataataaacccgatatgtgaagcagcagagctgatcgaaactgggaatccggtacttgcgcaagggatattggcgcggctcaatcaccagctctctgttccaatcggtaagccttatcaaaggactgctttttacttcaaggaggccttgcaattacttctcaatatgaacaataacaactctattggtactgcttataacccgattttcaagattggtgcttataaatccttctctgagatctcaccgatccttcagtttgcaaattttacttgtaaccaagcccttcttgaggcttttgaggggtttgagagaattcacgttgttgattttgatattgggtatggtgggcagtgggcttctcttatgcaagaactggctttgaggaatggaggcgccccttctcttaaaatcactgcttttgtttctccttcctcacatgatgagcttgagcttgagcttggttttactcaagaaaatttaagaatctttgctagtgaaatcaacatgccattcgagcttgaaattttaagccttgaatccttgggctctgtttctcggccaatgactctttgcacattggacaaggaagtaattgctgtgaatcttccacttggcgtcttttctaattacccatcgactcttcctgttgtgcttcgctttgtaaagcagctctcgcccaaagttgtggtctctttggacagtggttgtgaccgaagtgatctcccatttgctcaccatataaatcatgccattcaatcttatacaagcctgcttgaatcacttgatgctgtgaatgtgaacttagatatactgcaaaagattgagaggttcttggtccaaccatgcattgaaagaatggtactgggtcgacatggttgctctgataggacgaccccttggaggagtctgtttttgcagtctggtttcactccattgactttcagtaactttactgagtcacaagctgagtgtttggtgcaacgtactcctgttaagggtttccatgttgaaaagaagcagtcttcacttgttctttgctggcaacagagggacctcgtatcagtttctgcttggagctgttaa

SEQ ID NO: 3736 - protein, 735 aa, Populus balsamifera subsp. trichocarpa; identical to SEQ ID NO: 3734
  misc_feature (1)..(735): Ceres ANNOT ID no. 1444066
  misc_feature (349)..(649): Pfam Name: GRAS Pfam Description: GRAS family transcription factor
  misc_feature: SWISSPROT Homolog: RGA1_BRACM DELLA protein RGA1 (RGA-like protein 1) (BrRGA1) with e-value of 2.8e-33 and BLAST sequence identity of 28.7
  misc_feature: SWISSPROT Homolog: RGA_ARATH DELLA protein RGA (Repressor on the ga1-3 mutant) with e-value of 3.9e-29 and BLAST sequence identity of 30.9
  misc_feature: SWISSPROT Homolog: RGA_ARATH GAI-related sequence Restoration of growth on ammonia protein 1
  misc_feature: SWISSPROT Homolog: RGA2_BRACM DELLA protein RGA2 (RGA-like protein 2) (BrRGA2) with e-value of 7.2e-28 and BLAST sequence identity of 30.9
  misc_feature: SWISSPROT Homolog: GAIP_CUCMA DELLA protein GAIP (Gibberellic acid-insensitive phloem protein) GAIP (CmGAIP) with e-value of 3.5e-27 and BLAST sequence identity of 28.4
  misc_feature: SWISSPROT Homolog: GAIPB_CUCMA DELLA protein GAIP-B Gibberellic acid-insensitive phloem protein B (GAIP-B) (CmGAIP-B) with e-value of 8.1e-27 and BLAST sequence identity of 27.8
  misc_feature 418409:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(735): Functional Homolog of  Ceres CDNA ID no. 23515246 at SEQ ID NO. 3771 with e-value of 6.70E-108 and BLAST sequence identity of 52.3

SEQ ID NO: 3737 - protein, 121 aa, Arabidopsis thaliana
  misc_feature (1)..(121): Ceres CDNA ID no. 23516578
  misc_feature (1)..(91): Pfam Name: Auxin_inducible Pfam Description: Auxin responsive protein
  misc_feature: Phenotype: FLOWER - Reduced fertility Useful for sterility, genetic confinement systems
MGTGEKTLKSFQLHRKQSVKVKDVPKGCLAIKVGSQGEEQQRFIVPVLYFNHPLFMQLLKEAEDEYGFDQKGTITIPCHVEEFRYVQALIDGERSVYNGNNHHHRHGGRDQYHHLVGCFRA

SEQ ID NO: 3738 - protein, 175 aa, Arabidopsis thaliana
  misc_feature (1)..(175): Ceres CDNA ID no. 23516633
  misc_feature (1)..(175): Also Known As Ceres GEMINI ID 5109E3
  misc_feature (32)..(171): Pfam Name: AUX_IAA Pfam Description: AUX/IAA family
  misc_feature 418647:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MGRGRSSSSSSIESSSKSNPFGASSSTRNLSTDLRLGLSFGTSSGTQYFNGGYGYSVAAPAVEDAEYVAAVEEEEENECNSVGSFYVKVNMEGVPIGRKIDLMSLNGYRDLIRTLDFMFNASILWAEEEDMCNEKSHVLTYADKEGDWMMVGDVPWEMFLSTVRRLKISRANYHY

SEQ ID NO: 3739 - DNA, 528 bp, Populus balsamifera subsp. trichocarpa
  misc_feature (1)..(528): Ceres ANNOT ID no. 1524883
  misc_feature 418706:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atgggcagaggagctacctctagttcttcatcttcttttgaaagcagcaactacccatctgtatcaagcaagtcttctctctctcagctaaagaaagacctaagcacagatctcaggcttggacttagcatctcaacctctcaacaggagaacccttctacaccaagtgatcagcaactttcggactggccaccaatcaagccatttctaaggaaggcattagcgtcagaagaaaatgagtgcagtagtgccaccttcttcgtcaaggtttacatggaaggcattccgattggaaggaagctcaacctcttagcccatgatggttaccatgacttaatacagactcttgaccaaatgttcaacactagcattctctggcctgaaatggatattgaacattctgggcaatgtcatgtgttgacatatgaagacaaagagggggattggttgattgttggggatgttccctgggagatgttcttaccttctgtgcggagattgaagatcactagggcagacagcctatga

SEQ ID NO: 3740 - protein, 175 aa, Populus balsamifera subsp. trichocarpa
  misc_feature (1)..(175): Ceres ANNOT ID no. 1524883
  misc_feature (63)..(125): Pfam Name: AUX_IAA Pfam Description: AUX/IAA family
  misc_feature: SWISSPROT Homolog: IAA20_ARATH Auxin-responsive protein IAA20 (Indoleacetic acid-induced protein 20) with e-value of 2.6e-91 and BLAST sequence identity of 100.0
  misc_feature: SWISSPROT Homolog: IAA30_ARATH Putative auxin-responsive protein IAA30 (Putative indoleacetic acid-induced protein 30) with e-value of 8.2e-72 and BLAST sequence identity of 83.0
  misc_feature: SWISSPROT Homolog: IAA4_ORYSA Auxin-responsive protein IAA4 (Indoleacetic acid-induced protein 4) with e-value of 6.5e-30 and BLAST sequence identity of 52.7
  misc_feature: SWISSPROT Homolog: IAA31_ARATH Auxin-responsive protein IAA31 (Indoleacetic acid-induced protein 31) with e-value of 7.0e-27 and BLAST sequence identity of 59.8
  misc_feature: SWISSPROT Homolog: IAA8_ORYSA Auxin-responsive protein IAA8 (Indoleacetic acid-induced protein 8) with e-value of 5.7e-25 and BLAST sequence identity of 42.8
  misc_feature 418796:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(175): Functional Homolog of  Ceres CDNA ID no. 23516633 at SEQ ID NO. 3785 with e-value of 1.30E-38 and BLAST sequence identity of 55.0
MGRGATSSSSSSFESSNYPSVSSKSSLSQLKKDLSTDLRLGLSISTSQQENPSTPSDQQLSDWPPIKPFLRKALASEENECSSATFFVKVYMEGIPIGRKLNLLAHDGYHDLIQTLDQMFNTSILWPEMDIEHSGQCHVLTYEDKEGDWLIVGDVPWEMFLPSVRRLKITRADSL

SEQ ID NO: 3741 - DNA, 525 bp, Populus balsamifera subsp. trichocarpa
  misc_feature (1)..(525): Ceres ANNOT ID no. 1497918
  misc_feature 418863:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atgggcagaggagctgcctctagctcttcatcatctttcgaaagcagccgctacccatctgtctccggcgagtcttctttccctcatgtaaagagggaccttagcacagatctaaggcttggacttggcatatcaacctctcgacaggacaacccttccacaccaagtgagcagctattggattggccaccgatcaagccgtctccggggaaggcagtaacatcagaagaaaatgagtgctgtagttccaccttattcgtcaaggtgtacatggaaggcattcaaattggaaggaaactgaacctattagcccacgatggttaccatgacttgatacagactctcgacgaaatgttcaacactagcattctctggcctgaaatggatgttgaacattccgggaaatgccatgtgctgacatatgaagacaaagagggcgattggttgattgttggggatgttccatgggaggtgttcttaccttctgtgcggagattgaagatcaccagggcagacagcctatga

SEQ ID NO: 3742 - protein, 174 aa, Populus balsamifera subsp. trichocarpa
  misc_feature (1)..(174): Ceres ANNOT ID no. 1497918
  misc_feature (85)..(168): Pfam Name: AUX_IAA Pfam Description: AUX/IAA family
  misc_feature: SWISSPROT Homolog: IAA20_ARATH Auxin-responsive protein IAA20 (Indoleacetic acid-induced protein 20) with e-value of 2.6e-91 and BLAST sequence identity of 100.0
  misc_feature: SWISSPROT Homolog: IAA30_ARATH Putative auxin-responsive protein IAA30 (Putative indoleacetic acid-induced protein 30) with e-value of 8.2e-72 and BLAST sequence identity of 83.0
  misc_feature: SWISSPROT Homolog: IAA4_ORYSA Auxin-responsive protein IAA4 (Indoleacetic acid-induced protein 4) with e-value of 6.5e-30 and BLAST sequence identity of 52.7
  misc_feature: SWISSPROT Homolog: IAA31_ARATH Auxin-responsive protein IAA31 (Indoleacetic acid-induced protein 31) with e-value of 7.0e-27 and BLAST sequence identity of 59.8
  misc_feature: SWISSPROT Homolog: IAA8_ORYSA Auxin-responsive protein IAA8 (Indoleacetic acid-induced protein 8) with e-value of 5.7e-25 and BLAST sequence identity of 42.8
  misc_feature 418953:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(174): Functional Homolog of  Ceres CDNA ID no. 23516633 at SEQ ID NO. 3785 with e-value of 3.69E-36 and BLAST sequence identity of 54.7
MGRGAASSSSSSFESSRYPSVSGESSFPHVKRDLSTDLRLGLGISTSRQDNPSTPSEQLLDWPPIKPSPGKAVTSEENECCSSTLFVKVYMEGIQIGRKLNLLAHDGYHDLIQTLDEMFNTSILWPEMDVEHSGKCHVLTYEDKEGDWLIVGDVPWEVFLPSVRRLKITRADSL

SEQ ID NO: 3743 - DNA, 474 bp, Populus balsamifera subsp. trichocarpa
  misc_feature (1)..(474): Ceres ANNOT ID no. 1471472
  misc_feature 419020:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atgggcagaggagctacctctagttcttcatcttcttttgaaagcagcaactacccatctgtatcaagcaagtcttctctctctcagctaaagaaagacctaagcacagatctcaggcttggacttagcatctcaacctctcaacaggagaacccttctacaccaagtgatcagcaactttcggactggccaccaatcaagccatttctaaggaaggcattagcgtcagaagaaaatgagtgcagtagtgccaccttcttcgtcaaggtttacatggaaggcattccgattggaaggaagctcaacctcttagcccatgatgggcctgaaatggatattgaacattctgggcaatgtcatgtgttgacatatgaagacaaagagggggattggttgattgttggggatgttccctgggagatgttcttaccttctgtgcggagattgaagatcactagggcagacagcctatga

SEQ ID NO: 3744 - protein, 157 aa, Populus balsamifera subsp. trichocarpa
  misc_feature (1)..(157): Ceres ANNOT ID no. 1471472
  misc_feature (63)..(96): Pfam Name: AUX_IAA Pfam Description: AUX/IAA family
  misc_feature: SWISSPROT Homolog: IAA20_ARATH Auxin-responsive protein IAA20 (Indoleacetic acid-induced protein 20) with e-value of 2.6e-91 and BLAST sequence identity of 100.0
  misc_feature: SWISSPROT Homolog: IAA30_ARATH Putative auxin-responsive protein IAA30 (Putative indoleacetic acid-induced protein 30) with e-value of 8.2e-72 and BLAST sequence identity of 83.0
  misc_feature: SWISSPROT Homolog: IAA4_ORYSA Auxin-responsive protein IAA4 (Indoleacetic acid-induced protein 4) with e-value of 6.5e-30 and BLAST sequence identity of 52.7
  misc_feature: SWISSPROT Homolog: IAA31_ARATH Auxin-responsive protein IAA31 (Indoleacetic acid-induced protein 31) with e-value of 7.0e-27 and BLAST sequence identity of 59.8
  misc_feature: SWISSPROT Homolog: IAA8_ORYSA Auxin-responsive protein IAA8 (Indoleacetic acid-induced protein 8) with e-value of 5.7e-25 and BLAST sequence identity of 42.8
  misc_feature 419108:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(157): Functional Homolog of  Ceres CDNA ID no. 23516633 at SEQ ID NO. 3785 with e-value of 3.69E-27 and BLAST sequence identity of 53.6
MGRGATSSSSSSFESSNYPSVSSKSSLSQLKKDLSTDLRLGLSISTSQQENPSTPSDQQLSDWPPIKPFLRKALASEENECSSATFFVKVYMEGIPIGRKLNLLAHDGPEMDIEHSGQCHVLTYEDKEGDWLIVGDVPWEMFLPSVRRLKITRADSL

SEQ ID NO: 3745 - protein, 510 aa, Arabidopsis thaliana
  misc_feature (1)..(510): Ceres CDNA ID no. 23516818
  misc_feature (1)..(510): Also Known As Ceres GEMINI ID 5109A1
  misc_feature (33)..(478): Pfam Name: p450 Pfam Description: Cytochrome P450
  misc_feature 419186:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
MILVLASLFAVLILNVLLWRWLKASACKAQRLPPGPPRLPILGNLLQLGPLPHRDLASLCDKYGPLVYLRLGNVDAITTNDPDTIREILLRQDDVFSSRPKTLAAVHLAYGCGDVALAPMGPHWKRMRRICMEHLLTTKRLESFTTQRAEEARYLIRDVFKRSETGKPINLKEVLGAFSMNNVTRMLLGKQFFGPGSLVSPKEAQEFLHITHKLFWLLGVIYLGDYLPFWRWVDPSGCEKEMRDVEKRVDEFHTKIIDEHRRAKLEDEDKNGDMDFVDVLLSLPGENGKAHMEDVEIKALIQDMIAAATDTSAVTNEWAMAEAIKQPRVMRKIQEELDNVVGSNRMVDESDLVHLNYLRCVVRETFRMHPAGPFLIPHESVRATTINGYYIPAKTRVFINTHGLGRNTKIWDDVEDFRPERHWPVEGSGRVEISHGPDFKILPFSAGKRKCPGAPLGVTMVLMALARLFHCFEWSSPGNIDTVEVYGMTMPKAKPLRAIAKPRLAAHLYT

SEQ ID NO: 3746 - DNA, 1566 bp, Populus balsamifera subsp. trichocarpa
  misc_feature (1)..(1566): Ceres ANNOT ID no. 1444427
  misc_feature 419308:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atggacattattgccaccttgttttcactcctactctttctggttatagttgcaaacttcatactacggtggggaaatttgaagtcacagcataaatccaaaaggcttcctccaggcccgccaagattgcctgttttcggcaaccttctacagcttggccagcagcctcaccgggacttagcttccttgtgtgataaatatgggccactagtctacctccgacttggcagcgtggatgccattaccaccaacgatcctgaaatcatacgcgaaatacttgtacgccaagatgaagttttcgcatcccggccgagaactctcgcagccgtccacctagcttatgggtgtggagatgtggccttggccccattaggtccacattggaagagaatgaggaggatctgcatggagcaactactaaccacaaggaggctcgagtcttttgcaaatcaccgtgccgatgaagcccaacatctggtcatggatgtttggtcccggacccaaacaggaaagcctttgagcttgagggaagtgcttggtgccttttccatgaacaatgtgactaggatgttgctaggtaagcaatattttggtgcagaatcagcaggcccacaagaggccatggaattcatgcacataacccatgagttgtttcggcttctgggggtgatctaccttggtgattatttaccattttggaggtggattgaccctcatggctgtgaaaagaaaatgagggaagtggagaaaagagtggatgattttcacaataaaattattgaagaacacagaaagacaaggaagacaaagagaaaggaaactggagaggaagacaaagacatggactttgttgatgttctactatcattgcctggtgagaatgggaaagaacacatggatgatgtagagatcaaagctctaattcaggacatgatagctgctgctacagacacttcagctgtaaccaatgaatgggcaatggcagaggtgatcaagcatccacgtgtcctttccaaaatacaacaggagcttgattcagttgtgggtcccaatcgaatggtcacggaatctgatttggcccaccttaactacttacgctgcgttgtacgggaaacattccgcatgcacccagctgggcctttgcttatcccgcatgagtccttacgcgccaccacaatcaatggctaccacatccctgacaaaacccgggtatttatcaacactcatgggctgggccgaaatactaaactctgggccgatgtcgaggagtttcgtcccgagagacattggctggctgatgggagccgagtggagataagccacggagctgattttaagatattgccattcagcgcaggtaaaaggaaatgccctggcgcaccacttggtgtgactctggtactcatggctttggctcgactctttcattgttttgactggaccccgccagaggggctaagccccgaagatattgacacgactgaggtttatggcatgaccatgcccaaggctaagcccttgttggctatggctcggccacgcttggcagagcatatgtaccactga

SEQ ID NO: 3747 - protein, 521 aa, Populus balsamifera subsp. trichocarpa
  misc_feature (1)..(521): Ceres ANNOT ID no. 1444427
  misc_feature (37)..(508): Pfam Name: p450 Pfam Description: Cytochrome P450
  misc_feature: SWISSPROT Homolog: C71A1_PERAE Cytochrome P450 71A1 (EC 1.14.-.-) (CYPLXXIA1) (ARP-2) with e-value of 8.3e-95 and BLAST sequence identity of 40.3
  misc_feature: SWISSPROT Homolog: F3PH_PETHY Flavonoid 3'-monooxygenase EC 1.14.13.21(Flavonoid 3'-hydroxylase) (Cytochrome P450 75B2) with e-value of 2.9e-92 and BLAST sequence identity of 37.0
  misc_feature: SWISSPROT Homolog: C75A2_SOLME Flavonoid 3',5'-hydroxylase (EC 1.14.13.88) (F3'5'H) (Cytochrome P450 75A2) (CYPLXXVA2) (P-450EG1) with e-value of 5.6e-89 and BLAST sequence identity of 34.3
  misc_feature: SWISSPROT Homolog: C75A3_PETHY Flavonoid 3',5'-hydroxylase 2 (EC 1.14.13.88) (F3'5'H) (Cytochrome P450 75A3) (CYPLXXVA3) with e-value of 6.6e-86 and BLAST sequence identity of 35.0
  misc_feature: SWISSPROT Homolog: F3PH_ARATH Flavonoid 3'-monooxygenase EC 1.14.13.21(Flavonoid 3'-hydroxylase) (AtF3'H) (Cytochrome P450 75B1) (TRANSPARENT TESTA 7 protein) with e-value of 1.8e-85 and BLAST sequence identity of 37.0
  misc_feature 419434:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(521): Functional Homolog of  Ceres CDNA ID no. 23516818 at SEQ ID NO. 3792 with e-value of 1.60E-218 and BLAST sequence identity of 80.1
MDIIATLFSLLLFLVIVANFILRWGNLKSQHKSKRLPPGPPRLPVFGNLLQLGQQPHRDLASLCDKYGPLVYLRLGSVDAITTNDPEIIREILVRQDEVFASRPRTLAAVHLAYGCGDVALAPLGPHWKRMRRICMEQLLTTRRLESFANHRADEAQHLVMDVWSRTQTGKPLSLREVLGAFSMNNVTRMLLGKQYFGAESAGPQEAMEFMHITHELFRLLGVIYLGDYLPFWRWIDPHGCEKKMREVEKRVDDFHNKIIEEHRKTRKTKRKETGEEDKDMDFVDVLLSLPGENGKEHMDDVEIKALIQDMIAAATDTSAVTNEWAMAEVIKHPRVLSKIQQELDSVVGPNRMVTESDLAHLNYLRCVVRETFRMHPAGPLLIPHESLRATTINGYHIPDKTRVFINTHGLGRNTKLWADVEEFRPERHWLADGSRVEISHGADFKILPFSAGKRKCPGAPLGVTLVLMALARLFHCFDWTPPEGLSPEDIDTTEVYGMTMPKAKPLLAMARPRLAEHMYH

SEQ ID NO: 3748 - protein, 244 aa, Arabidopsis thaliana
  misc_feature (1)..(244): Ceres CDNA ID no. 23518705
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
MEELDFSSKTTTSRLKLFGFSVDGEEDFSDQSVKTNLSSVSPERGEFPAGSSGRSGGGVRSRGGGGGGGERKYECQYCCREFGNSQALGGHQNAHKKERQQLKRAQLQATRNAAANFSNAGSASQFLRNPIVSAFAPPPHLLSSSAVPQPMGGPWMYLPRVSPSQLHVSHGCVIQDGSGGAGAGGFSYEYGARDSGFGVVGAQMRHVQAHGPRPSVNGFSREVGTTFDDGLGLDLHLSLAPAGH

SEQ ID NO: 3749 - DNA, 744 bp, Populus balsamifera subsp. trichocarpa
  misc_feature (1)..(744): Ceres ANNOT ID no. 1463957
  misc_feature 419658:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
atggcagagctagactacgaaacaaaacataactcaacctctacacgcttaaaactattcggcttcaacgtctcagaagatgaagaacaaataaccacaacagactctctcaagtcatcttcttgtaattctcctgacgactcctcttttgctacagctacaacgacagtcccagctacggcttcaggagacagcagaaaatacgagtgtcagtactgctgtagggaattcgcaaactcacaagcccttggtggccatcaaaacgcacacaaaaaagaaagacagcaactcaaacgagctcaaatgcaagccacaagaaacgcagctgcggctgccgtttcttttggtagaaaccctatgatctctgcctttgctcctcctccccatctcctggcccaagcagcaggccaggttatggtcccggcggcttctccgtcgtgggtttacttgccacgtgctgcaacaccgtttcacgtttcacatgggtgtgtgttccctagtggggtgagtgggaggggtggagggggcttaccatatggtgacagtgtaggagattttggattttctactagtgctagtgggccacaccaacaactgcaaagtagggcccattttagcagtgtagttgatgatcatagtgggcctacatcattgagtaggttctccgaaggtgacgatgggcctaactttgatgaaaaactgggcttggacttgcatcttagtcttgctccagctgggccatga

SEQ ID NO: 3750 - protein, 247 aa, Populus balsamifera subsp. trichocarpa
  misc_feature (1)..(247): Ceres ANNOT ID no. 1463957
  misc_feature: SWISSPROT Homolog: ZFP6_ARATH Zinc finger protein 6 with e-value of 3.8e-28 and BLAST sequence identity of 46.0
  misc_feature: SWISSPROT Homolog: ZFP5_ARATH Zinc finger protein 5 with e-value of 7.9e-19 and BLAST sequence identity of 73.2
  misc_feature: SWISSPROT Homolog: KNU_ARATH Zinc-finger protein KNUCKLES with e-value of 1.2e-07 and BLAST sequence identity of 64.7
  misc_feature: SWISSPROT Homolog: ZFP4_ARATH Zinc finger protein 4 with e-value of 2.2e-07 and BLAST sequence identity of 35.9
  misc_feature: SWISSPROT Homolog: RBE_ARATH Probable transcriptional regulator RABBIT EARS with e-value of 4.1e-07 and BLAST sequence identity of 44.6
  misc_feature 419765:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature (1)..(247): Functional Homolog of  Ceres CDNA ID no. 23518705 at SEQ ID NO. 3795 with e-value of 2.59E-51 and BLAST sequence identity of 57.5
MAELDYETKHNSTSTRLKLFGFNVSEDEEQITTTDSLKSSSCNSPDDSSFATATTTVPATASGDSRKYECQYCCREFANSQALGGHQNAHKKERQQLKRAQMQATRNAAAAAVSFGRNPMISAFAPPPHLLAQAAGQVMVPAASPSWVYLPRAATPFHVSHGCVFPSGVSGRGGGGLPYGDSVGDFGFSTSASGPHQQLQSRAHFSSVVDDHSGPTSLSRFSEGDDGPNFDEKLGLDLHLSLAPAGP

SEQ ID NO: 3751 - DNA, 738 bp, Populus balsamifera subsp. trichocarpa
  misc_feature (1)..(738): Ceres ANNOT ID no. 1458961
  misc_feature 419867:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
atggcagagctggactacgaaacaaaacacaactcaaccactacgtctacacgattaaaactattcggcttcaacgtctcagaagatgaagaactaatagctacaacatactcgagttctctcaagtcatcttcttgtaatactccggactcgtcctctttcggtacagcgacagctacaggagacagtaggaaatacgagtgtcagtactgctctagggaatttgcaaactcacaagcccttggtggccaccaaaacgcacacaaaaaagaaagacagcaactcaaacgagctcaaatgcaagccacaagaaacgcagctgcagctgccgtttcctttggtagaaaccctatgatctctgccttcgctcctcctccgcacctcctggcccaggcagcaggccaggttgtggtcccggaggcttctcagtcgtgggtttacttgcctcgggcggcgccaccgtttcatgtttcacatgggagtgtgtttcctaggggggtgggtgggaggggtgtagggagcttaacgtatggtggtagtgtaggagattttggattggcctctagtgctagtgggccataccagcaagtgcaaagtagggcccatattagcagggtcattggtgatctgaatgggcctacatcattgagcaggttctctaaaagtgatggtggacctagctttgatgataaattgagcctggacttgcatcttagtctttctccagctgggccatga

SEQ ID NO: 3752 - protein, 245 aa, Populus balsamifera subsp. trichocarpa
  misc_feature (1)..(245): Ceres ANNOT ID no. 1458961
  misc_feature: SWISSPROT Homolog: ZFP6_ARATH Zinc finger protein 6 with e-value of 3.8e-28 and BLAST sequence identity of 46.0
  misc_feature: SWISSPROT Homolog: ZFP5_ARATH Zinc finger protein 5 with e-value of 7.9e-19 and BLAST sequence identity of 73.2
  misc_feature: SWISSPROT Homolog: KNU_ARATH Zinc-finger protein KNUCKLES with e-value of 1.2e-07 and BLAST sequence identity of 64.7
  misc_feature: SWISSPROT Homolog: ZFP4_ARATH Zinc finger protein 4 with e-value of 2.2e-07 and BLAST sequence identity of 35.9
  misc_feature: SWISSPROT Homolog: RBE_ARATH Probable transcriptional regulator RABBIT EARS with e-value of 4.1e-07 and BLAST sequence identity of 44.6
  misc_feature 419974:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature (1)..(245): Functional Homolog of  Ceres CDNA ID no. 23518705 at SEQ ID NO. 3795 with e-value of 8.09E-48 and BLAST sequence identity of 57.3
MAELDYETKHNSTTTSTRLKLFGFNVSEDEELIATTYSSSLKSSSCNTPDSSSFGTATATGDSRKYECQYCSREFANSQALGGHQNAHKKERQQLKRAQMQATRNAAAAAVSFGRNPMISAFAPPPHLLAQAAGQVVVPEASQSWVYLPRAAPPFHVSHGSVFPRGVGGRGVGSLTYGGSVGDFGLASSASGPYQQVQSRAHISRVIGDLNGPTSLSRFSKSDGGPSFDDKLSLDLHLSLSPAGP

SEQ ID NO: 3753 - protein, 326 aa, Arabidopsis thaliana
  misc_feature (1)..(326): Ceres CDNA ID no. 23519977
  misc_feature (14)..(298): Pfam Name: Aldo_ket_red Pfam Description: Aldo/keto reductase family
  misc_feature: Utility: ABA Useful for making plants with enhanced tolerance to drought
  misc_feature: Utility: Mannitol Useful for making plants with enhanced tolerance to drought
  misc_feature: Utility: PEG Useful for making plants with increased tolerance to drought
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
MSLTTVPTLAIRSGPSGHHSMPVLGFGTAASPLPEPTMLKETVIEAIKLGYRHFDTSPRYQTEEPIGEALAEAVSLGLVRSRSEFFVTTKLWCADAHGGLVVPAIKRSLKNLKLDYLDLYIIHWPVSSKPGKYKFPIDEDDFMPMDFEVVWSEMEECQRLGLAKCIGVSNFSCKKLQHILSIATIPPSVNQVEMSPIWQQRKLRELCRSNDIVVTAYSVLGSRGAFWGTPKIMESDVLKEIAEAKEKTVAQVSMRWAYEQGVSMVVKSFTKERLEENLKIFDWSLTEDETQRISTEIPQFRNVHGEVYTSKKGPIKSVAEMWDGEI

SEQ ID NO: 3754 - DNA, 978 bp, Populus balsamifera subsp. trichocarpa
  misc_feature (1)..(978): Ceres ANNOT ID no. 1459840
  misc_feature 420199:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
atggataacgaatcggtgagaattccagaagtcgttctagttagctccgatggccgaaaaatgccggtgttggggatgggcacatcagcttctccactagagggatctgacgaaacaaaaacagccattcttcaagcaatcgagattggtcacagacactttgatacagccacgttatacctaacagaggagccacttggagaagcaatttctgaagccttatctcgcgggctgatcaaatcacgagatgagctcttcatcacctcgaagctatggtgcagtgatgctcatggtgatcttgtcctcccagcccttaagaagagtctacggaatcttcagctggaataccttgatctttatctaattcattggcctgtgagctcgagatcagggacctatgagttccctataaacaaaggagaccttttacctatggattttaaatccgtatgggaagctatgcaagaatgtcaagatctaggtctcacgaaatccattggtgtcagcaatttctcttgtaaaaagctttcagacatccttgcctttgcaaagatccctccggcagttaatcaagtagagatcaatccattatggcaacaaaacaagctaagggaattctgcgaggccaatggaatcgttttgacagcttatgctcctttgggaaccagaggaaccatttggggaagcaacagggttatggagaatgaagtactgagagagattgcaactgctaaaggaaagagtgttgctcaggtgtgcctcaggtgggcatttgagcaaggggtctgtgtggtgctgaagagtttcaacaaaggaaggatgaaggagaaccttgagatactcaactggacattgagcgaggaagaatccaggatgatcggtgaaataccccaaagcagaggatgtcgcggagaagattacatctcagaaaaggggcctatcaagacaattgaggagctttgggatggagaaatttga

SEQ ID NO: 3755 - protein, 325 aa, Populus balsamifera subsp. trichocarpa
  misc_feature (1)..(325): Ceres ANNOT ID no. 1459840
  misc_feature (15)..(298): Pfam Name: Aldo_ket_red Pfam Description: Aldo/keto reductase family
  misc_feature: SWISSPROT Homolog: NADO1_ORYSA Probable NAD(P)H-dependent oxidoreductase 1 (EC 1.1.1.-) with e-value of 6.4e-88 and BLAST sequence identity of 51.6
  misc_feature: SWISSPROT Homolog: 6DCS_SOYBN NAD(P)H dependent 6'-deoxychalcone synthase (EC 2.3.1.170) with e-value of 2.2e-87 and BLAST sequence identity of 53.9
  misc_feature: SWISSPROT Homolog: NADO2_ORYSA Probable NAD(P)H-dependent oxidoreductase 2 (EC 1.-.-.-) with e-value of 2.9e-85 and BLAST sequence identity of 49.1
  misc_feature: SWISSPROT Homolog: AK1C1_PONPY Aldo-keto reductase family 1 member C1 homolog with e-value of 6.5e-56 and BLAST sequence identity of 42.5
  misc_feature: SWISSPROT Homolog: AK1C1_PONPY EC 1.-.-.- (20-alpha-hydroxysteroid dehydrogenase) EC 1.1.1.149 20-alpha-HSD)
  misc_feature: SWISSPROT Homolog: AK1C1_HUMAN Aldo-keto reductase family 1 member C1 with e-value of 7.4e-55 and BLAST sequence identity of 42.1
  misc_feature: SWISSPROT Homolog: AK1C1_HUMAN EC 1.1.1.-(20-alpha-hydroxysteroid dehydrogenase) EC 1.1.1.149  (Trans-1,2-dihydrobenzene-1,2-diol dehydrogenase) ( EC 1.3.1.20 (High-affinity hepatic bile acid-binding protei
  misc_feature 420333:<222: Transcription Factor
  misc_feature: Phenotype: WHOLE PLANT - ABA Useful for making plants with enhanced tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature (1)..(325): Functional Homolog of  Ceres CDNA ID no. 23519977 at SEQ ID NO. 3800 with e-value of 7.59E-107 and BLAST sequence identity of 59.7
MDNESVRIPEVVLVSSDGRKMPVLGMGTSASPLEGSDETKTAILQAIEIGHRHFDTATLYLTEEPLGEAISEALSRGLIKSRDELFITSKLWCSDAHGDLVLPALKKSLRNLQLEYLDLYLIHWPVSSRSGTYEFPINKGDLLPMDFKSVWEAMQECQDLGLTKSIGVSNFSCKKLSDILAFAKIPPAVNQVEINPLWQQNKLREFCEANGIVLTAYAPLGTRGTIWGSNRVMENEVLREIATAKGKSVAQVCLRWAFEQGVCVVLKSFNKGRMKENLEILNWTLSEEESRMIGEIPQSRGCRGEDYISEKGPIKTIEELWDGEI

SEQ ID NO: 3756 - protein, 237 aa, Arabidopsis thaliana
  misc_feature (1)..(237): Ceres CDNA ID no. 23521525
  misc_feature (1)..(237): Also Known As Ceres GEMINI ID 5109G12
  misc_feature (140)..(181): Pfam Name: zf-C3HC4 Pfam Description: Zinc finger, C3HC4 type (RING finger)
  misc_feature 420457:<222: Transcription Factor
  misc_feature: Phenotype: Activates expression of the gene endogenous to the AtPES (SEQ ID NO 4142) regalutory region Useful for modulating Terpenoid Biosynthesis
METKHLRKLLQLYQACGGEQELTKTVQNVTSSPLTPTPPPQPPSALDSTMALTIFILLVALFFMGFFSVYFRHFADSSSSTVDISSMPRTRSSRMSPRRLSTSVVVSRPYSFRRGLDSQAVRSLPVYRYTKAAKQRNEDCVICLSDFEEGETVKVIPHCGHVFHVDCVDTWLSSYVTCPLCRSNQLFSDKDLGMQEPPDQDSAEEHDTCDGVDTCVRRCSSCSSLGQRTGLERSLSL

SEQ ID NO: 3757 - DNA, 750 bp, Populus balsamifera subsp. trichocarpa
  misc_feature (1)..(750): Ceres ANNOT ID no. 1491996
  misc_feature 420527:<222: Transcription Factor
  misc_feature: Phenotype: Activates expression of the gene endogenous to the AtPES (SEQ ID NO 4142) regalutory region Useful for modulating Terpenoid Biosynthesis
atgaagccccacaaccgcaaactacaagtaccatacaacgatgcaccgttcgaacaccccatcactcccactttccaaacctctaactccaccataccaccgccaccgttcaaagaaccaaccaccataccaccgccaacaacaactttacagctacaacagcaacaacagttttattcacgcacagggtttgaaccgtctgtagccttaataattctatttctcttaatagctctcttcttcatgggattcttttctatctacacccgtaagttctccgtcaacccatcaccgtcgtcgtcacaacgcagcacgggcacaccagggccagcaagtacatccagccgtccatccagggcttctaccagctcacgaattactcgaggtcttgacccacaagttgtcaactcactgccggtgtactcttattaccatggtgatgtgaagtaccagattgagtgtgctatttgcttgggtgagtttgaggagaaagaggctgttaagatgataccaaaatgtcatcacgtgtttcatttgcagtgtattgacacgtggcttgagatgcacgtgacttgtcctgtttgtcgaggggctcagttcgttcaggagaagggcggcggtaacgatggtttgggtgtgattcaggagagggttgatcaaggtgcgagtcaaccagaggcaagatcagaggttgggaatggtgacacgtcattggaggtgaggggagaagtaataggtgttcaagcctag

SEQ ID NO: 3758 - protein, 249 aa, Populus balsamifera subsp. trichocarpa
  misc_feature (1)..(249): Ceres ANNOT ID no. 1491996
  misc_feature (154)..(195): Pfam Name: zf-C3HC4 Pfam Description: Zinc finger, C3HC4 type (RING finger)
  misc_feature: SWISSPROT Homolog: ATL2E_ARATH RING-H2 finger protein ATL2E with e-value of 4.0e-127 and BLAST sequence identity of 100.0
  misc_feature: SWISSPROT Homolog: ATL3B_ARATH RING-H2 finger protein ATL3B precursor (RING-H2 finger protein ATL6) with e-value of 9.2e-25 and BLAST sequence identity of 37.4
  misc_feature: SWISSPROT Homolog: ATL5H_ARATH RING-H2 finger protein ATL5H precursor with e-value of 1.4e-23 and BLAST sequence identity of 36.5
  misc_feature: SWISSPROT Homolog: ATL4O_ARATH RING-H2 finger protein ATL4O precursor with e-value of 5.8e-23 and BLAST sequence identity of 40.6
  misc_feature: SWISSPROT Homolog: ATL2G_ARATH RING-H2 finger protein ATL2G precursor (RING-H2 finger protein ATL9) with e-value of 3.2e-22 and BLAST sequence identity of 33.5
  misc_feature 420621:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(249): Functional Homolog of  Ceres CDNA ID no. 23521525 at SEQ ID NO. 3803 with e-value of 4.99E-32 and BLAST sequence identity of 48.9
MKPHNRKLQVPYNDAPFEHPITPTFQTSNSTIPPPPFKEPTTIPPPTTTLQLQQQQQFYSRTGFEPSVALIILFLLIALFFMGFFSIYTRKFSVNPSPSSSQRSTGTPGPASTSSRPSRASTSSRITRGLDPQVVNSLPVYSYYHGDVKYQIECAICLGEFEEKEAVKMIPKCHHVFHLQCIDTWLEMHVTCPVCRGAQFVQEKGGGNDGLGVIQERVDQGASQPEARSEVGNGDTSLEVRGEVIGVQA

SEQ ID NO: 3759 - DNA, 795 bp, Populus balsamifera subsp. trichocarpa
  misc_feature (1)..(795): Ceres ANNOT ID no. 1439136
  misc_feature 420702:<222: Transcription Factor
  misc_feature: Phenotype: Activates expression of the gene endogenous to the AtPES (SEQ ID NO 4142) regalutory region Useful for modulating Terpenoid Biosynthesis
atgaagccccacaaccgcaaactacaagtaccatacaacgatgcaccgttcgaacaccccatcactcccactttccaaacctctaactccaccataccaccgccaccgttcaaagaaccaaccaccataccaccgccaacaacaactttacagctacaacagcaacaacagttttattcacgcacagggtttgaaccgtctgtagccttaataattctatttctcttaatagctctcttcttcatgggattcttttctatctacacccgtaagttctccgtcaacccatcaccgtcgtcgtcgtcgtcgtcgtcgtcgtcgtcagaggatttctataattctcacagacaacgcagcacgggcacaccagggccagcaagtacatccagccgtccatccagggcttctaccagctcacgaattactcgaggtcttgacccacaagttgtcaactcactgccggtgtactcttattaccatggtgatgtgaagtaccagattgagtgtgctatttgcttgggtgagtttgaggagaaagaggctgttaagatgataccaaaatgtcatcacgtgtttcatttgcagtgtattgacacgtggcttgagatgcacgtgacttgtcctgtttgtcgaggggctcagttcgttcaggagaagggcggcggtaacgatggtttgggtgtgattcaggagagggttgatcaaggtgcgagtcaaccagaggcaagatcagaggttgggaatggtgacacgtcattggaggtgaggggagaagtaataggtgttcaagcctag

SEQ ID NO: 3760 - protein, 264 aa, Populus balsamifera subsp. trichocarpa
  misc_feature (1)..(264): Ceres ANNOT ID no. 1439136
  misc_feature (169)..(210): Pfam Name: zf-C3HC4 Pfam Description: Zinc finger, C3HC4 type (RING finger)
  misc_feature: SWISSPROT Homolog: ATL2E_ARATH RING-H2 finger protein ATL2E with e-value of 4.0e-127 and BLAST sequence identity of 100.0
  misc_feature: SWISSPROT Homolog: ATL3B_ARATH RING-H2 finger protein ATL3B precursor (RING-H2 finger protein ATL6) with e-value of 9.2e-25 and BLAST sequence identity of 37.4
  misc_feature: SWISSPROT Homolog: ATL5H_ARATH RING-H2 finger protein ATL5H precursor with e-value of 1.4e-23 and BLAST sequence identity of 36.5
  misc_feature: SWISSPROT Homolog: ATL4O_ARATH RING-H2 finger protein ATL4O precursor with e-value of 5.8e-23 and BLAST sequence identity of 40.6
  misc_feature: SWISSPROT Homolog: ATL2G_ARATH RING-H2 finger protein ATL2G precursor (RING-H2 finger protein ATL9) with e-value of 3.2e-22 and BLAST sequence identity of 33.5
  misc_feature 420798:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(264): Functional Homolog of  Ceres CDNA ID no. 23521525 at SEQ ID NO. 3803 with e-value of 2.70E-31 and BLAST sequence identity of 48.7
MKPHNRKLQVPYNDAPFEHPITPTFQTSNSTIPPPPFKEPTTIPPPTTTLQLQQQQQFYSRTGFEPSVALIILFLLIALFFMGFFSIYTRKFSVNPSPSSSSSSSSSSEDFYNSHRQRSTGTPGPASTSSRPSRASTSSRITRGLDPQVVNSLPVYSYYHGDVKYQIECAICLGEFEEKEAVKMIPKCHHVFHLQCIDTWLEMHVTCPVCRGAQFVQEKGGGNDGLGVIQERVDQGASQPEARSEVGNGDTSLEVRGEVIGVQA

SEQ ID NO: 3761 - protein, 387 aa, Arabidopsis thaliana
  misc_feature (1)..(387): Ceres CDNA ID no. 23522373
  misc_feature (1)..(387): Also Known As Ceres GEMINI ID 5110H5
  misc_feature (1)..(205): Pfam Name: MFMR Pfam Description: G-box binding protein MFMR
  misc_feature (326)..(365): Pfam Name: bZIP_Maf Pfam Description: bZIP Maf transcription factor
  misc_feature: Utility: Low Nitrate Useful for making plants tolerant to low nitrogen
  misc_feature 420908:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: WHOLE PLANT - Low Nitrate Useful for making plants tolerant to low nitrogen
  misc_feature: Phenotype: WHOLE PLANT - Yellow-Green Viable 3 Useful for making lethal plants for genetic confinement systems
MGSSEMEKSGKEKEPKTTPPSTSSSAPATVVSQEPSSAVSAGVAVTQDWSGFQAYSPMPPHGYVASSPQPHPYMWGVQHMMPPYGTPPHPYVTMYPPGGMYAHPSLPPGSYPYSPYAMPSPNGMAEASGNTGSVIEGDGKPSDGKEKLPIKRSKGSLGSLNMIIGKNNEAGKNSGASANGACSKSAESGSDGSSDGSDANSQNDSGSRHNGKDGETASESGGSAHGPPRNGSNLPVNQTVAIMPVSATGVPGPPTNLNIGMDYWSGHGNVSGAVPGVVVDGSQSQPWLQDEREIKRQRRKQSNRESARRSRLRKQAECDELAQRAEVLNGENSSLRAEINKLKSQYEELLAENSSLKNKFSSAPSLEGGDLDKNEQEPQRSTRQDVA

SEQ ID NO: 3762 - DNA, 1155 bp, Populus balsamifera subsp. trichocarpa
  misc_feature (1)..(1155): Ceres ANNOT ID no. 1538994
  misc_feature 421030:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: WHOLE PLANT - Low Nitrate Useful for making plants tolerant to low nitrogen
  misc_feature: Phenotype: WHOLE PLANT - Yellow-Green Viable 3 Useful for making lethal plants for genetic confinement systems
atggttagcagtgatatggataaaactgggaaggaaaaggaggccaagccaccatctgctgctcctacacaggagcagccttcaactgccagtgctacaactgtaaatccagactggtctgggtttcaggcatattctcctatacctccacctgggttcttggcatcaagtccccaagctcacccgtatatgtggggggttcagcacatcatgcctccctatggtaccccaccacatccatatgtggcaatgtatccgcatggtgtatatgctcatccatccattcctccgggttcttatccttttagtccttttgcaatgccttctccaaatggtattgctgaggcttctggaaacactcctggcagcatggaagcagatggtaggccatctgatgctaaggaaaaactgccaattaaaagatcgaaaggaagtttgggcagtttaaacatgatcactgggaagaacaatgagcatggtaaaacaacaggagtgtctgccaacggagcttattctaagagtgctgagagtggtagtgaaggctccagtgaaggaagtgatgcaaattctcagagtgactcacaaatgaagtcaggtggcaggcaagattctctggaagcacatggtgctcagaatggaggacagggtgcatctaatacgatcatgaatcaaacgatggctatcatgccaatatctgctgccagtgctccaggagctatacctggccccacaaccaacttaaatattggaatggactactggggagcccctgcttcatctactgttcctgcaattcgtgggaaagttccttctactccagttgctggaggggtagtttctactggatcacgggatggtgttcaatcgcagatttggttacaggatgaaagagagcttaagagacagagaaggaagcagtcaaacagagaatccgctcgccggtccaggttgcgtaaacaggctgaatgtgatgaactggcccaacgtgctgaagccttaaaagaagaaaatgccaatcttagatcagaagtaaaccaaatcaagagcgagtatgagcaacttcttgcggagaacgcctctctcaaggaagattttagggctggcaggaatgaccaacatatgagcaatgatacacaacagactggacaaacatag

SEQ ID NO: 3763 - protein, 384 aa, Populus balsamifera subsp. trichocarpa
  misc_feature (1)..(384): Ceres ANNOT ID no. 1538994
  misc_feature (1)..(194): Pfam Name: MFMR Pfam Description: G-box binding protein MFMR
  misc_feature (296)..(360): Pfam Name: bZIP_1 Pfam Description: bZIP transcription factor
  misc_feature: SWISSPROT Homolog: HBP1A_WHEAT Transcription factor HBP-1a (Histone-specific transcription factor HBP1) with e-value of 1.8e-51 and BLAST sequence identity of 43.7
  misc_feature: SWISSPROT Homolog: GBF3_ARATH G-box-binding factor 3 (AtbZIP55) with e-value of 1.1e-39 and BLAST sequence identity of 36.3
  misc_feature: SWISSPROT Homolog: CPRF1_PETCR Common plant regulatory factor CPRF-1 with e-value of 7.7e-37 and BLAST sequence identity of 35.2
  misc_feature: SWISSPROT Homolog: GBF1_ARATH G-box-binding factor 1 (AtbZIP41) with e-value of 1.1e-30 and BLAST sequence identity of 35.4
  misc_feature: SWISSPROT Homolog: CPRF3_PETCR Light-inducible protein CPRF-3 with e-value of 5.0e-29 and BLAST sequence identity of 47.2
  misc_feature 421167:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: WHOLE PLANT - Low Nitrate Useful for making plants tolerant to low nitrogen
  misc_feature: Phenotype: WHOLE PLANT - Yellow-Green Viable 3 Useful for making lethal plants for genetic confinement systems
  misc_feature (1)..(384): Functional Homolog of  Ceres CDNA ID no. 23522373 at SEQ ID NO. 3808 with e-value of 9.70E-123 and BLAST sequence identity of 71.0
MVSSDMDKTGKEKEAKPPSAAPTQEQPSTASATTVNPDWSGFQAYSPIPPPGFLASSPQAHPYMWGVQHIMPPYGTPPHPYVAMYPHGVYAHPSIPPGSYPFSPFAMPSPNGIAEASGNTPGSMEADGRPSDAKEKLPIKRSKGSLGSLNMITGKNNEHGKTTGVSANGAYSKSAESGSEGSSEGSDANSQSDSQMKSGGRQDSLEAHGAQNGGQGASNTIMNQTMAIMPISAASAPGAIPGPTTNLNIGMDYWGAPASSTVPAIRGKVPSTPVAGGVVSTGSRDGVQSQIWLQDERELKRQRRKQSNRESARRSRLRKQAECDELAQRAEALKEENANLRSEVNQIKSEYEQLLAENASLKEDFRAGRNDQHMSNDTQQTGQT

SEQ ID NO: 3764 - DNA, 1254 bp, Populus balsamifera subsp. trichocarpa
  misc_feature (1)..(1254): Ceres ANNOT ID no. 1447080
  misc_feature 421297:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: WHOLE PLANT - Low Nitrate Useful for making plants tolerant to low nitrogen
  misc_feature: Phenotype: WHOLE PLANT - Yellow-Green Viable 3 Useful for making lethal plants for genetic confinement systems
atgggtagcagtgatatggataaaacaggaaaggagaaggaggccaagacaccatctgctgcttctacacaggaacagccttcaactgccggtgctgccactgtaaatccagactggtctgggtttcaggcctattctcatatacctccaccagggttcttggcatcaagtccccaagctcacccatatatgtggggggttcagcacattatgcctccctatggtaccccaccacatccatatgttgcaatgtatcctcacggtgtatatgctcatccgtccattcccccgggttcttatccttttagtccttttgcaatgccttctccaaatggtatcgctgaggtttctggaaacactcctggcagcatggaagccgaaggaagaccatctgatgccaaggaaaaattacctattaaaaggtccaaaggaagcttgggcagtttaaacatgattactgggaagaataatgagcatgggagaacaacaggagcatctgctaatggagcttattcgaaaagtgctgagagtggaagtgaaggcacaagtgaaggaagtgatgcggattctcagagtgactcacaaatgaagtcaggtggcagacaagattctctggaagaaacatctcagaatggtggttctgcacatgctgctcagaatggaggacagggtgcatctacaatcatgaatcaaacaatgggtgtcctgccaatatctgctgccagtgcccctggagttatacctggtcccacaaccaacttaaatattggaatggactattggggagcccctgttgcttctagtgttcctgcaattcgtgggaaggttccttctactccagttgctggagggattgctactgctggatcacgggatggtgttcaatcgcagcattggttacaggatgaaagagagcttaagagacagagaaggaagcagtcaaacagagaatctgctcgccggtccaggttgcgtaaacagctacgtgctcctatatcaattcattggcttgcatgcatgcttttgagtcaggctgaatgcgatgagctggcccaacgtgctgaagttttaaaagaagaaaatgccaatcttagatcagaagtaaatcggatcaagagcgagtatgagcagcttcttgcagagaacgcctctctcaaggagaggctcggggaagttcatggacaagaagattccagggctggcaggaatgaccaacatacgagcaatgatacacaacagactggacaaacatag

SEQ ID NO: 3765 - protein, 417 aa, Populus balsamifera subsp. trichocarpa
  misc_feature (1)..(417): Ceres ANNOT ID no. 1447080
  misc_feature (1)..(194): Pfam Name: MFMR Pfam Description: G-box binding protein MFMR
  misc_feature (303)..(327): Pfam Name: bZIP_1 Pfam Description: bZIP transcription factor
  misc_feature: SWISSPROT Homolog: HBP1A_WHEAT Transcription factor HBP-1a (Histone-specific transcription factor HBP1) with e-value of 1.8e-51 and BLAST sequence identity of 43.7
  misc_feature: SWISSPROT Homolog: GBF3_ARATH G-box-binding factor 3 (AtbZIP55) with e-value of 1.1e-39 and BLAST sequence identity of 36.3
  misc_feature: SWISSPROT Homolog: CPRF1_PETCR Common plant regulatory factor CPRF-1 with e-value of 7.7e-37 and BLAST sequence identity of 35.2
  misc_feature: SWISSPROT Homolog: GBF1_ARATH G-box-binding factor 1 (AtbZIP41) with e-value of 1.1e-30 and BLAST sequence identity of 35.4
  misc_feature: SWISSPROT Homolog: CPRF3_PETCR Light-inducible protein CPRF-3 with e-value of 5.0e-29 and BLAST sequence identity of 47.2
  misc_feature 421436:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: WHOLE PLANT - Low Nitrate Useful for making plants tolerant to low nitrogen
  misc_feature: Phenotype: WHOLE PLANT - Yellow-Green Viable 3 Useful for making lethal plants for genetic confinement systems
  misc_feature (1)..(417): Functional Homolog of  Ceres CDNA ID no. 23522373 at SEQ ID NO. 3808 with e-value of 1.10E-119 and BLAST sequence identity of 65.9
MGSSDMDKTGKEKEAKTPSAASTQEQPSTAGAATVNPDWSGFQAYSHIPPPGFLASSPQAHPYMWGVQHIMPPYGTPPHPYVAMYPHGVYAHPSIPPGSYPFSPFAMPSPNGIAEVSGNTPGSMEAEGRPSDAKEKLPIKRSKGSLGSLNMITGKNNEHGRTTGASANGAYSKSAESGSEGTSEGSDADSQSDSQMKSGGRQDSLEETSQNGGSAHAAQNGGQGASTIMNQTMGVLPISAASAPGVIPGPTTNLNIGMDYWGAPVASSVPAIRGKVPSTPVAGGIATAGSRDGVQSQHWLQDERELKRQRRKQSNRESARRSRLRKQLRAPISIHWLACMLLSQAECDELAQRAEVLKEENANLRSEVNRIKSEYEQLLAENASLKERLGEVHGQEDSRAGRNDQHTSNDTQQTGQT

SEQ ID NO: 3766 - protein, 248 aa, Arabidopsis thaliana
  misc_feature (1)..(248): Ceres CDNA ID no. 23523867
  misc_feature (1)..(248): Also Known As Ceres GEMINI ID 5109E10
  misc_feature (143)..(170): Pfam Name: C1_3 Pfam Description: C1-like domain
  misc_feature (28)..(57): Pfam Name: C1_2 Pfam Description: C1 domain
  misc_feature 421592:<222: Transcription Factor
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
MASRPSVRHPSHNHPLRGHKAQVEDEIICSGCDLDLLGAYFKCTKSECDYFLHKSCFDLPREIRHKSHPDHPLILLYSPQNNNSTYTCDACGEYGSGFTYNCSICQYDVHVGCVSVPETMKHDEHVHPLALIYKAPCPKDHIFTCDVCDETMPHNLWLYYCQKCDYGAHLHSCVAEEEEKSKKGGRGRGGEGGSGGNGVNRGRSSANSELAAMLKAQREMEQMQIALHLEMQRAKIDKKSRKHMLKMI

SEQ ID NO: 3767 - protein, 228 aa, Arabidopsis thaliana
  misc_feature (1)..(228): Ceres CDNA ID no. 23524514
  misc_feature (1)..(228): Also Known As Ceres GEMINI ID 5110F4
  misc_feature (1)..(220): Pfam Name: AUX_IAA Pfam Description: AUX/IAA family
  misc_feature 421687:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
MNLKETELCLGLPGGTETVESPAKSGVGNKRGFSETVDLKLNLQSNKQGHVDLNTNGAPKEKTFLKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSSEYVPSYEDKDGDWMLVGDVPWPMFVESCKRLRIMKGSEAIGLAPRAMEKFKNRS

SEQ ID NO: 3768 - DNA, 747 bp, Populus balsamifera subsp. trichocarpa; identical to SEQ ID NO: 1718
  misc_feature (1)..(747): Ceres ANNOT ID no. 1459467
  misc_feature 421758:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis

SEQ ID NO: 3769 - protein, 248 aa, Populus balsamifera subsp. trichocarpa; identical to SEQ ID NO: 1719
  misc_feature (1)..(248): Ceres ANNOT ID no. 1459467
  misc_feature (13)..(240): Pfam Name: AUX_IAA Pfam Description: AUX/IAA family
  misc_feature: SWISSPROT Homolog: IAA14_ARATH Auxin-responsive protein IAA14 Indoleacetic acid-induced protein 14 (SOLITARY-ROOT protein) with e-value of 4.4e-121 and BLAST sequence identity of 100.0
  misc_feature: SWISSPROT Homolog: IAA7_ARATH Auxin-responsive protein IAA7 Indoleacetic acid-induced protein 7 (Auxin resistant 2) with e-value of 3.4e-98 and BLAST sequence identity of 82.4
  misc_feature: SWISSPROT Homolog: IAA17_ARATH Auxin-responsive protein IAA17 Indoleacetic acid-induced protein 17 (Auxin response 3) with e-value of 2.0e-77 and BLAST sequence identity of 68.1
  misc_feature: SWISSPROT Homolog: IAA16_ARATH Auxin-responsive protein IAA16 (Indoleacetic acid-induced protein 16) with e-value of 1.7e-73 and BLAST sequence identity of 64.9
  misc_feature: SWISSPROT Homolog: AUX28_SOYBN Auxin-induced protein AUX28 with e-value of 2.3e-69 and BLAST sequence identity of 63.3
  misc_feature 421855:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(248): Functional Homolog of  Ceres CDNA ID no. 23524514 at SEQ ID NO. 3814 with e-value of 9.99E-87 and BLAST sequence identity of 79.1

SEQ ID NO: 3770 - DNA, 834 bp, Populus balsamifera subsp. trichocarpa; identical to SEQ ID NO: 1720
  misc_feature (1)..(834): Ceres ANNOT ID no. 1516688
  misc_feature 421937:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis

SEQ ID NO: 3771 - protein, 267 aa, Populus balsamifera subsp. trichocarpa; identical to SEQ ID NO: 1721
  misc_feature (1)..(267): Ceres ANNOT ID no. 1516688
  misc_feature (114)..(259): Pfam Name: AUX_IAA Pfam Description: AUX/IAA family
  misc_feature: SWISSPROT Homolog: IAA14_ARATH Auxin-responsive protein IAA14 Indoleacetic acid-induced protein 14 (SOLITARY-ROOT protein) with e-value of 4.4e-121 and BLAST sequence identity of 100.0
  misc_feature: SWISSPROT Homolog: IAA7_ARATH Auxin-responsive protein IAA7 Indoleacetic acid-induced protein 7 (Auxin resistant 2) with e-value of 3.4e-98 and BLAST sequence identity of 82.4
  misc_feature: SWISSPROT Homolog: IAA17_ARATH Auxin-responsive protein IAA17 Indoleacetic acid-induced protein 17 (Auxin response 3) with e-value of 2.0e-77 and BLAST sequence identity of 68.1
  misc_feature: SWISSPROT Homolog: IAA16_ARATH Auxin-responsive protein IAA16 (Indoleacetic acid-induced protein 16) with e-value of 1.7e-73 and BLAST sequence identity of 64.9
  misc_feature: SWISSPROT Homolog: AUX28_SOYBN Auxin-induced protein AUX28 with e-value of 2.3e-69 and BLAST sequence identity of 63.3
  misc_feature 422036:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(267): Functional Homolog of  Ceres CDNA ID no. 23524514 at SEQ ID NO. 3814 with e-value of 1.10E-80 and BLAST sequence identity of 79.5

SEQ ID NO: 3772 - DNA, 741 bp, Populus balsamifera subsp. trichocarpa; identical to SEQ ID NO: 1722
  misc_feature (1)..(741): Ceres ANNOT ID no. 1488767
  misc_feature 422121:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis

SEQ ID NO: 3773 - protein, 236 aa, Populus balsamifera subsp. trichocarpa; identical to SEQ ID NO: 1723
  misc_feature (1)..(236): Ceres ANNOT ID no. 1488767
  misc_feature (2)..(228): Pfam Name: AUX_IAA Pfam Description: AUX/IAA family
  misc_feature: SWISSPROT Homolog: IAA14_ARATH Auxin-responsive protein IAA14 Indoleacetic acid-induced protein 14 (SOLITARY-ROOT protein) with e-value of 4.4e-121 and BLAST sequence identity of 100.0
  misc_feature: SWISSPROT Homolog: IAA7_ARATH Auxin-responsive protein IAA7 Indoleacetic acid-induced protein 7 (Auxin resistant 2) with e-value of 3.4e-98 and BLAST sequence identity of 82.4
  misc_feature: SWISSPROT Homolog: IAA17_ARATH Auxin-responsive protein IAA17 Indoleacetic acid-induced protein 17 (Auxin response 3) with e-value of 2.0e-77 and BLAST sequence identity of 68.1
  misc_feature: SWISSPROT Homolog: IAA16_ARATH Auxin-responsive protein IAA16 (Indoleacetic acid-induced protein 16) with e-value of 1.7e-73 and BLAST sequence identity of 64.9
  misc_feature: SWISSPROT Homolog: AUX28_SOYBN Auxin-induced protein AUX28 with e-value of 2.3e-69 and BLAST sequence identity of 63.3
  misc_feature 422218:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(236): Functional Homolog of  Ceres CDNA ID no. 23524514 at SEQ ID NO. 3814 with e-value of 7.19E-79 and BLAST sequence identity of 72.2

SEQ ID NO: 3774 - DNA, 714 bp, Populus balsamifera subsp. trichocarpa; identical to SEQ ID NO: 1726
  misc_feature (1)..(714): Ceres ANNOT ID no. 1495750
  misc_feature 422297:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis

SEQ ID NO: 3775 - protein, 229 aa, Populus balsamifera subsp. trichocarpa; identical to SEQ ID NO: 3202
  misc_feature (1)..(229): Ceres ANNOT ID no. 1495750
  misc_feature (1)..(219): Pfam Name: AUX_IAA Pfam Description: AUX/IAA family
  misc_feature: SWISSPROT Homolog: IAA14_ARATH Auxin-responsive protein IAA14 Indoleacetic acid-induced protein 14 (SOLITARY-ROOT protein) with e-value of 4.4e-121 and BLAST sequence identity of 100.0
  misc_feature: SWISSPROT Homolog: IAA7_ARATH Auxin-responsive protein IAA7 Indoleacetic acid-induced protein 7 (Auxin resistant 2) with e-value of 3.4e-98 and BLAST sequence identity of 82.4
  misc_feature: SWISSPROT Homolog: IAA17_ARATH Auxin-responsive protein IAA17 Indoleacetic acid-induced protein 17 (Auxin response 3) with e-value of 2.0e-77 and BLAST sequence identity of 68.1
  misc_feature: SWISSPROT Homolog: IAA16_ARATH Auxin-responsive protein IAA16 (Indoleacetic acid-induced protein 16) with e-value of 1.7e-73 and BLAST sequence identity of 64.9
  misc_feature: SWISSPROT Homolog: AUX28_SOYBN Auxin-induced protein AUX28 with e-value of 2.3e-69 and BLAST sequence identity of 63.3
  misc_feature 422392:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(229): Functional Homolog of  Ceres CDNA ID no. 23524514 at SEQ ID NO. 3814 with e-value of 2.30E-75 and BLAST sequence identity of 68.6

SEQ ID NO: 3776 - DNA, 690 bp, Populus balsamifera subsp. trichocarpa; identical to SEQ ID NO: 1728
  misc_feature (1)..(690): Ceres ANNOT ID no. 1452612
  misc_feature 422471:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis

SEQ ID NO: 3777 - protein, 221 aa, Populus balsamifera subsp. trichocarpa; identical to SEQ ID NO: 3212
  misc_feature (1)..(221): Ceres ANNOT ID no. 1452612
  misc_feature (1)..(218): Pfam Name: AUX_IAA Pfam Description: AUX/IAA family
  misc_feature: SWISSPROT Homolog: IAA14_ARATH Auxin-responsive protein IAA14 Indoleacetic acid-induced protein 14 (SOLITARY-ROOT protein) with e-value of 4.4e-121 and BLAST sequence identity of 100.0
  misc_feature: SWISSPROT Homolog: IAA7_ARATH Auxin-responsive protein IAA7 Indoleacetic acid-induced protein 7 (Auxin resistant 2) with e-value of 3.4e-98 and BLAST sequence identity of 82.4
  misc_feature: SWISSPROT Homolog: IAA17_ARATH Auxin-responsive protein IAA17 Indoleacetic acid-induced protein 17 (Auxin response 3) with e-value of 2.0e-77 and BLAST sequence identity of 68.1
  misc_feature: SWISSPROT Homolog: IAA16_ARATH Auxin-responsive protein IAA16 (Indoleacetic acid-induced protein 16) with e-value of 1.7e-73 and BLAST sequence identity of 64.9
  misc_feature: SWISSPROT Homolog: AUX28_SOYBN Auxin-induced protein AUX28 with e-value of 2.3e-69 and BLAST sequence identity of 63.3
  misc_feature 422566:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(221): Functional Homolog of  Ceres CDNA ID no. 23524514 at SEQ ID NO. 3814 with e-value of 3.89E-71 and BLAST sequence identity of 70.3

SEQ ID NO: 3778 - protein, 192 aa, Arabidopsis thaliana
  misc_feature (1)..(192): Ceres CDNA ID no. 23529806
  misc_feature (1)..(192): Also Known As Ceres GEMINI ID 5110F11
  misc_feature (78)..(116): Pfam Name: zf-TRAF Pfam Description: TRAF-type zinc finger
  misc_feature 422656:<222: Transcription Factor
  misc_feature: Phenotype: Activates expression of the gene endogenous to the AtDXPR (SEQ ID NO 4143) regalutory region Useful for modulating Terpenoid Biosynthesis
METATGEITIVCNHCDRDIPSLNIDLHRVHCARNLEKCKICGDMVPKKHAEEHYLNTHAPIACSMCKETIEREIFDSHKGEICPKRIVTCEFCEFPLPAVDLAEHQEVCGNRTELCYQCNSYVRLRERYNHETKCPGTVESSRRIPRAAEGDGNGRRRRDGNGVSNKRLFFTIAITGIAVIIGSLFFQRKPE

SEQ ID NO: 3779 - DNA, 606 bp, Populus balsamifera subsp. trichocarpa
  misc_feature (1)..(606): Ceres ANNOT ID no. 1443631
  misc_feature 422720:<222: Transcription Factor
  misc_feature: Phenotype: Activates expression of the gene endogenous to the AtDXPR (SEQ ID NO 4143) regalutory region Useful for modulating Terpenoid Biosynthesis
atggcagttgcatctgaggaatcaactagcatatgcagtcactgtgacagagctattccttcctcaaacattgatttgcactatgcacattgtttccgaaatctcaaaaaatgtaaaatctgtggtgatatggtccccaagaaacatgctgaggaacatttcttgaacactcatgctccggtagcctgttcactctgcagtgagacaatggaacgtgaaattctagctgtccataaaggtgaaaattgtccccaaaggattgtcacatgtgagttctgtgagtttccattgccagcagttgatctagctgagcatcaggaggtatgtgggaatcggacagaactctgtcacatgtgtaataaatacattagactgcgagaaagatataatcatgagtctagatgcactggcttaccagatactactgtagagtcttccagggatgtgagggctgctgaaagaagacagccacaaggtccccagagaaggcagccacaggacttttcacggaaacgacttctattcactattgctataactggcattgctgttctgttaggatcatttctcttccagaagaaaactgaggatagtcaagtgcattag

SEQ ID NO: 3780 - protein, 201 aa, Populus balsamifera subsp. trichocarpa
  misc_feature (1)..(201): Ceres ANNOT ID no. 1443631
  misc_feature (78)..(129): Pfam Name: zf-TRAF Pfam Description: TRAF-type zinc finger
  misc_feature 422773:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(201): Functional Homolog of  Ceres CDNA ID no. 23529806 at SEQ ID NO. 3825 with e-value of 8.80E-74 and BLAST sequence identity of 70.8
MAVASEESTSICSHCDRAIPSSNIDLHYAHCFRNLKKCKICGDMVPKKHAEEHFLNTHAPVACSLCSETMEREILAVHKGENCPQRIVTCEFCEFPLPAVDLAEHQEVCGNRTELCHMCNKYIRLRERYNHESRCTGLPDTTVESSRDVRAAERRQPQGPQRRQPQDFSRKRLLFTIAITGIAVLLGSFLFQKKTEDSQVH

SEQ ID NO: 3781 - protein, 240 aa, Arabidopsis thaliana
  misc_feature (1)..(240): Ceres CDNA ID no. 23529931
  misc_feature (1)..(240): Also Known As Ceres GEMINI ID 5109H10
  misc_feature (74)..(119): Pfam Name: zf-C3HC4 Pfam Description: Zinc finger, C3HC4 type (RING finger)
  misc_feature 422859:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
MQSSSSSGGDDLEKQQQQQQKDKSPQKQSESANESNHLTIVVCNGDSSREELVGQIPPEKEVSLSRNGSSHEQCRVCLQDKEEVLIELGCQCRGGLAKAHRSCIDAWFRTKGSNQCEICQVVAVNVTPPETQPTTNYWVWRIDPSYRQEERERGCFSPLWVAFSILIGGLMLDVLISITLGVSALPVNIIIGVIVVLGLGTALRLTLEFCYEWSLRRAVHRAVQRAEANNFSNIAYPPAL

SEQ ID NO: 3782 - DNA, 762 bp, Populus balsamifera subsp. trichocarpa
  misc_feature (1)..(762): Ceres ANNOT ID no. 1520459
  misc_feature 422933:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atgcctatacagatgagcccttttgatcttgttgagagtaaagtggtttatgggaatcagatgcagaatgatgggtctggtagagatggcaccaccagagctggtggagatgtgcccctcactgaggttgacctggagaagcaggataacagtaaggtgttaacgcaagaaggcggtaatggggtcttgtcagggaattctgattattcaccagtgattgccattgtggtttctaatggcgagtctcctgtggctgccagcaaggaagagttgcatagtgtggattttcccagaaaagggtcgttgtcaaggacttcaagttcgcacgaacaatgcagagtttgtcagcaggagaaggaagaagttctcatagatcttggatgcaaatgtaaaggcggtcttgcaaaagcccatcgcacatgtattgatacctggtttagcacaagagggtccaacaaatgtgagatatgccaggctgtagctgtaaatgtgtcacctccagaatctcagccaattggctgttttagtcctctttgggtggcgttctcaatccttattggtggtctcttgttggatgtgctgatatccatcacccttggtgtttctgccttacctgttaacataataattggggtcattgttgttctcggacttggaaccgcgcttcggctagccctggaattctgccatgagtggagttttaggagagcagttcaaagggcagatgccaatgagaatcatggttaccatccagcttcgtag

SEQ ID NO: 3783 - protein, 233 aa, Populus balsamifera subsp. trichocarpa
  misc_feature (1)..(233): Ceres ANNOT ID no. 1520459
  misc_feature (92)..(137): Pfam Name: zf-C3HC4 Pfam Description: Zinc finger, C3HC4 type (RING finger)
  misc_feature: SWISSPROT Homolog: MARH2_HUMAN Membrane-associated RING finger protein 2 with e-value of 5.1e-06 and BLAST sequence identity of 25.7
  misc_feature: SWISSPROT Homolog: MARH2_HUMAN Membrane-associated RING-CH protein II MARCH-II (RING finger protein 172)
  misc_feature: SWISSPROT Homolog: MARH2_MOUSE Membrane-associated RING finger protein 2 (Membrane-associated RING-CH protein II) (MARCH-II) with e-value of 9.1e-06 and BLAST sequence identity of 25.6
  misc_feature 423014:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(233): Functional Homolog of  Ceres CDNA ID no. 23529931 at SEQ ID NO. 3828 with e-value of 1.69E-63 and BLAST sequence identity of 71.4
MQNDGSGRDGTTRAGGDVPLTEVDLEKQDNSKVLTQEGGNGVLSGNSDYSPVIAIVVSNGESPVAASKEELHSVDFPRKGSLSRTSSSHEQCRVCQQEKEEVLIDLGCKCKGGLAKAHRTCIDTWFSTRGSNKCEICQAVAVNVSPPESQPIGCFSPLWVAFSILIGGLLLDVLISITLGVSALPVNIIIGVIVVLGLGTALRLALEFCHEWSFRRAVQRADANENHGYHPAS

SEQ ID NO: 3784 - DNA, 657 bp, Populus balsamifera subsp. trichocarpa
  misc_feature (1)..(657): Ceres ANNOT ID no. 1494925
  misc_feature 423093:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atgcagaatgacgtgtctgatagagacagcaccaccagagctggtgctggtggtttagcccttactgaggttgacctggagaagcaggataacagtaaggctttgccgcaagaaggcggtaatgagatcttgtcagggaattctggttttccaccagtgattgccattgcgttttctaatggtgagtctactgctcatgtggctgccagcaaggaagagttgcctggtgtagattctcccagaaaagggtccttgtcaaggacttcaagtctgcacgaacaatgcagagtttgccagcaggagaaggaagaagttctcatagatcttggatgcaaatgtaaaggtggtcttgcaaaagcccaccgcacatgtatagatacctggtttagcagaagaggatccaacaaatgtgagatatgccatccactttgggtggcattctcaattcttactggtggcctcttgttggatgtgctgatatccatcacccttggtgtctctgccttacctgttaacataataatcggggtcattgttgtgctcggacttggaaccgcgcttcggctagccctggacttctgcattaagtggagttttaggagaccagtgcagagggcagatgccaatgtgaatcacgggtatcatccagctttgtag

SEQ ID NO: 3785 - protein, 218 aa, Populus balsamifera subsp. trichocarpa
  misc_feature (1)..(218): Ceres ANNOT ID no. 1494925
  misc_feature (95)..(140): Pfam Name: zf-C3HC4 Pfam Description: Zinc finger, C3HC4 type (RING finger)
  misc_feature: SWISSPROT Homolog: MARH2_HUMAN Membrane-associated RING finger protein 2 with e-value of 5.1e-06 and BLAST sequence identity of 25.7
  misc_feature: SWISSPROT Homolog: MARH2_HUMAN Membrane-associated RING-CH protein II MARCH-II (RING finger protein 172)
  misc_feature: SWISSPROT Homolog: MARH2_MOUSE Membrane-associated RING finger protein 2 (Membrane-associated RING-CH protein II) (MARCH-II) with e-value of 9.1e-06 and BLAST sequence identity of 25.6
  misc_feature 423170:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(218): Functional Homolog of  Ceres CDNA ID no. 23529931 at SEQ ID NO. 3828 with e-value of 2.69E-47 and BLAST sequence identity of 67.2
MQNDVSDRDSTTRAGAGGLALTEVDLEKQDNSKALPQEGGNEILSGNSGFPPVIAIAFSNGESTAHVAASKEELPGVDSPRKGSLSRTSSLHEQCRVCQQEKEEVLIDLGCKCKGGLAKAHRTCIDTWFSRRGSNKCEICHPLWVAFSILTGGLLLDVLISITLGVSALPVNIIIGVIVVLGLGTALRLALDFCIKWSFRRPVQRADANVNHGYHPAL

SEQ ID NO: 3786 - protein, 185 aa, Arabidopsis thaliana
  misc_feature (1)..(185): Ceres CDNA ID no. 23530467
  misc_feature (159)..(181): Pfam Name: AUX_IAA Pfam Description: AUX/IAA family
  misc_feature: Phenotype: ROSETTE LEAVES - Lanceolate Shaped Useful for making plants with increased biomass and foliage
MYCSDPPHPLHLVASDKQQKDHKLILSWKKPTMDSDPLGVFPNSPKYHPYYSQTTEFGGVIDLGLSLRTIQHEIYHSSGQRYCSNEGYRRKWGYVKVTMDGLVVGRKVCVLDHGSYSTLAHQLEDMFGMQSVSGLRLFQMESEFCLVYRDEEGLWRNAGDVPWNEFIESVERLRITRRNDAVLPF

SEQ ID NO: 3787 - protein, 77 aa, Arabidopsis thaliana
  misc_feature (1)..(77): Ceres CDNA ID no. 23530811
  misc_feature (35)..(74): Pfam Name: Tom7 Pfam Description: TOM7 family
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
MAAKSTLKIKGKAKPSKGSSSSSSSSASSKYKVFKDWTNWSLQKAKVATHYGFIPLIIIIGMNSDPKPHLFHLLSPV

SEQ ID NO: 3788 - DNA, 225 bp, Populus balsamifera subsp. trichocarpa
  misc_feature (1)..(225): Ceres ANNOT ID no. 1453922
  misc_feature 423360:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
atggcgtctagggtttctctgaagacaaaaggcaagagcagcagcggcaagggagcaaaaggcatggaagagaaatcagcgtcacagtatttcaaagaatggagcacatggtcatttaaaaaggccaaagttatcactcactatggattcattcctatgattattatcattggaatgaactctgagcctaaaccacagattcatcagctccttagtcctttctga

SEQ ID NO: 3789 - protein, 74 aa, Populus balsamifera subsp. trichocarpa
  misc_feature (1)..(74): Ceres ANNOT ID no. 1453922
  misc_feature (32)..(71): Pfam Name: Tom7 Pfam Description: TOM7 family
  misc_feature: SWISSPROT Homolog: TOM7B_ARATH Mitochondrial import receptor subunit TOM7-2 (Translocase of outer membrane 7 kDa subunit 2) with e-value of 6.0e-37 and BLAST sequence identity of 100.0
  misc_feature: SWISSPROT Homolog: TOM7A_ARATH Mitochondrial import receptor subunit TOM7-1 (Translocase of outer membrane 7 kDa subunit 1) with e-value of 3.6e-23 and BLAST sequence identity of 66.7
  misc_feature: SWISSPROT Homolog: TOM7A_SOLTU Mitochondrial import receptor subunit TOM7-1 (Translocase of outer membrane 7 kDa subunit 1) with e-value of 3.2e-15 and BLAST sequence identity of 52.1
  misc_feature 423430:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature (1)..(74): Functional Homolog of  Ceres CDNA ID no. 23530811 at SEQ ID NO. 3834 with e-value of 3.30E-19 and BLAST sequence identity of 60.2
MASRVSLKTKGKSSSGKGAKGMEEKSASQYFKEWSTWSFKKAKVITHYGFIPMIIIIGMNSEPKPQIHQLLSPF

SEQ ID NO: 3790 - protein, 558 aa, Arabidopsis thaliana
  misc_feature (1)..(558): Ceres CDNA ID no. 23539673
  misc_feature (1)..(558): Also Known As Ceres GEMINI ID 5110C6
  misc_feature (161)..(466): Pfam Name: Frigida Pfam Description: Frigida-like protein
  misc_feature 423499:<222: Transcription Factor
  misc_feature: Phenotype: Activates expression of the gene endogenous to the AtSS1 (SEQ ID NO 4158) regalutory region Useful for modulating Alkaloid Biosynthesis
MEDTRSVASLMDSTSSKIQQLQKAFAELESQRAVTLNLKWKELEEHFHGLERSLKRRFHELEDQEKEYETKTRKAQELLEKKKAAVEAKEKAALERLQKKRDAAMFTINSALDKYNNAPVSKPSVGERWPQNAVEDSSNVFAADSITDDNPDGIVQDVQISPVMGNYEVKAYPQLLKLCGDMDSTGLHKFVSDNRKNLASLKEEIPMAFRAAANPASLVLDSLEGFYPMEAPTADGKKDANLLGMRRTCIMLMECLSILLSGLDRNCLAVVLSQNVKHRAKTIAEGWNPLLESLDMDACNGNSLEAHAFLQLLATFAIVADFKEDELLKLIPMVSRRRQAAELCRSLGLAEKMPGVIEVLVNSGKQIDAVNLAFAFELTEQFSPVSLLKSYLIEARRSSPQGRPGNASPAVQDEFNERELIGLKTVIKCIEEHSLEEQYPVEPLHKRILQLEKAKADKKRATEPMKPQPKRPRGAQPRVTDNNNNINNNKTGYGRVIPERYPQYVYDNRPFLSGPIMAAQPPPPPPPQTYTFNPAPAHGNFYANCYQYQAPPPPPYFH

SEQ ID NO: 3791 - DNA, 1638 bp, Populus balsamifera subsp. trichocarpa
  misc_feature (1)..(1638): Ceres ANNOT ID no. 1472261
  misc_feature 423629:<222: Transcription Factor
  misc_feature: Phenotype: Activates expression of the gene endogenous to the AtSS1 (SEQ ID NO 4158) regalutory region Useful for modulating Alkaloid Biosynthesis
atggaagattctgaatcagttgcaacactcatggactcaacaacgtctaagatacatcaacttcagaaagcatttgctgaacttgaaagtcaccgggctgtaacactcaacctgaaatggaaagaacttgaggagcatttccatgggcttgaaagatctttgaagaggcggtttcacgagttggaagatcaagaaaagcagtacgaaaccaaaactaggagagccagggaaatattagagaaacgagaagctgctgttgtggccaaagaacaagattcattggagaaactccaagagaaacgagatgctgctatcttttccatttcgaatgctctacagaagcacaggaaggtatcttctgtggaacctgctgttgtgtcctatgatgaccaatttggatcaccagctattgatgaccaaccacctgaagccatgactgctgaaagtaacttaggtgaaataatagatccttctgaaaatggaaatttggagtatccacagttagtcgaactatgtgaacagatggactcagaaggactgcacaaatttatttctgacaaccgtaagaaccttgcggtcctaaaagaggaaattccacttgctttaaaggctgcagcaaacccagctcaatttgtgttgaactctctggaagatttttaccccaaggaagtgtcaaatgttgatggaaagaaagactcaaccttattgggtgtccgccgaacctgtatcatgttgatggaatgccttagcattttgttaatgtatgcagatctagtttctgtatctgatgtaatttcagaagatgttaaagatcaggcaaaggctattgctgaagagtggaagccaagattggattctttggacgtggatgctaacaatgggaactccttggaagcacatgcctttttgcaacttttagctacctttgggattgcttctgattttgatgaggaagagttatccaggctaatcccaatggtttctcgtcgtcgccaagcagctgaactatgtcgttttctagggctgtcggagaaaatgccaggtgtaattgaagtattggtaaatagtggaaggcaaattgatgcagtgaacttggcctttgcatttgacttaacggaacagttctcaccagttactctactgaaatcatacttgaaggaggcaagaaaagtttcttcatcattcaagcctggaaatgcatctcccatcactgggcagaatgaggtcaacgaacgagagctggcagccctcaaggctgtgatcaagtgcatcgaagagcataaacttgaggagcagtatcctggggatccgctccaaaaacgccttcttcagctagagaaggccaaggcagaaaagaaaagggcaaccgaagctgccaagcctcaacccaagagaccacgtgccagtggcgtcggatgcgggccccgcgtcactagcagtgttcctgagaggacattctatcctagagtacccgagaggtacccgcagtacgtgtacgacagaccatacatttacactggacctgctgacaaccatgttcctcaactcatgagttctgctgctacatacaacttctctcccagtcacggcaactactttggaaatggctaccagtaccagaccccgtatcatcactag

SEQ ID NO: 3792 - protein, 545 aa, Populus balsamifera subsp. trichocarpa
  misc_feature (1)..(545): Ceres ANNOT ID no. 1472261
  misc_feature (157)..(460): Pfam Name: Frigida Pfam Description: Frigida-like protein
  misc_feature: SWISSPROT Homolog: FRIGI_ARATH FRIGIDA protein with e-value of 1.1e-23 and BLAST sequence identity of 28.6
  misc_feature 423723:<222: Transcription Factor
  misc_feature: Phenotype: Activates expression of the gene endogenous to the AtSS1 (SEQ ID NO 4158) regalutory region Useful for modulating Alkaloid Biosynthesis
  misc_feature (1)..(545): Functional Homolog of  Ceres CDNA ID no. 23539673 at SEQ ID NO. 3837 with e-value of 6.00E-178 and BLAST sequence identity of 68.3
MEDSESVATLMDSTTSKIHQLQKAFAELESHRAVTLNLKWKELEEHFHGLERSLKRRFHELEDQEKQYETKTRRAREILEKREAAVVAKEQDSLEKLQEKRDAAIFSISNALQKHRKVSSVEPAVVSYDDQFGSPAIDDQPPEAMTAESNLGEIIDPSENGNLEYPQLVELCEQMDSEGLHKFISDNRKNLAVLKEEIPLALKAAANPAQFVLNSLEDFYPKEVSNVDGKKDSTLLGVRRTCIMLMECLSILLMYADLVSVSDVISEDVKDQAKAIAEEWKPRLDSLDVDANNGNSLEAHAFLQLLATFGIASDFDEEELSRLIPMVSRRRQAAELCRFLGLSEKMPGVIEVLVNSGRQIDAVNLAFAFDLTEQFSPVTLLKSYLKEARKVSSSFKPGNASPITGQNEVNERELAALKAVIKCIEEHKLEEQYPGDPLQKRLLQLEKAKAEKKRATEAAKPQPKRPRASGVGCGPRVTSSVPERTFYPRVPERYPQYVYDRPYIYTGPADNHVPQLMSSAATYNFSPSHGNYFGNGYQYQTPYHH

SEQ ID NO: 3793 - DNA, 1635 bp, Populus balsamifera subsp. trichocarpa
  misc_feature (1)..(1635): Ceres ANNOT ID no. 1445638
  misc_feature 423861:<222: Transcription Factor
  misc_feature: Phenotype: Activates expression of the gene endogenous to the AtSS1 (SEQ ID NO 4158) regalutory region Useful for modulating Alkaloid Biosynthesis
atggaagatactgaaccagttgcaacactcatggactctacaacgtctaggatacagcaacttcagaaagcatttgctgaacttgaaagtcaccgggctgtaacactcaacctgaaatggaaagaacttgaggaacatttccatgggcttgaaagatctttgaagaggcggtttcatgagttggaagatcaagaaaagcagtatgaaaccaaaactaggagagccagggaaatattagagaagcgggaagctgctgttatggccaaggaacaagcttcattggagaagctccaagagaaacaagatgctgctgtctttgccattgcgaatgctctacagaagcacaggaaagtatcatctgcagaacctgctgctgtgccttatgatggccaatgtgagtcaccaactattgatgaccaaccacctgatgccatgactgctgaaagtaacttaggagaaataatagatccttctgaaaatggaaatttggagtatccacagttagtcaaactatgtgaacagatggactcagaaggactgcacaaatttatatctgataaccgtaagaaccttgctgtcctcaaggaggaaatcccacttgctttgaaggctgcagtaaacccagcccagttggtgttggactctctcgaagatttctaccccaaggaagtggcaaatgttgatggaaagaaagattcaaccttattgggtctccgccgaacctgtatcatgttgatggaatgccttagcattttgctaatgtatacagatctcgtttctgtatctgccttaatttcagaagatgttaaagatcaggcaaaggcaattgctgaagagtggaagccaaaattggactctttggatgtggatgctaacaacgggaactccttggaggcacatgcctttttgcaacttctggccacatttgggattgcttctgattttgatgtggaagaaatatccaggctaataccaatggtttctcgtcgtcgccaagcagcagaactatgtcgatttcttgggctatcagagagaatgccaggtgtaattgaagtactggtgaatagtggaaggcaaatcgatgcagtaaacttggcttttgcttttgacttgatggaactgttctcaccagtacctctactgaaatcatacttgaaggaggcgagaaaagtggcttcatcaggcaagcctggaagtgcatctcccaccactgtgcagaatgatgtcaatgaacgagagctgactgccctcaaggctgtgatcaaatgcattgaagagcataaacttgaggagcagtatcccgtggatcccctccaaaagcgccttcatcagctagagaaggccaaggcagacaagaagagggcaaatgaagttgccaagcctcaacccaagagacctcgtgccagcggtgtcggatgtgggccccgcgtcactaacaatgctcctgagaagattttctatcctagagtacctgataggtacccacagtacgtgtatgacagaccatatatttactctggacccgctgacaaccatgttcccccactcatgagttctgcgacttacaacttctctcccagtcatggcaactactttggaaatggctaccagtatcagaccccgtatcttcactag

SEQ ID NO: 3794 - protein, 544 aa, Populus balsamifera subsp. trichocarpa
  misc_feature (1)..(544): Ceres ANNOT ID no. 1445638
  misc_feature (157)..(460): Pfam Name: Frigida Pfam Description: Frigida-like protein
  misc_feature: SWISSPROT Homolog: FRIGI_ARATH FRIGIDA protein with e-value of 1.1e-23 and BLAST sequence identity of 28.6
  misc_feature 423955:<222: Transcription Factor
  misc_feature: Phenotype: Activates expression of the gene endogenous to the AtSS1 (SEQ ID NO 4158) regalutory region Useful for modulating Alkaloid Biosynthesis
  misc_feature (1)..(544): Functional Homolog of  Ceres CDNA ID no. 23539673 at SEQ ID NO. 3837 with e-value of 6.89E-177 and BLAST sequence identity of 67.9
MEDTEPVATLMDSTTSRIQQLQKAFAELESHRAVTLNLKWKELEEHFHGLERSLKRRFHELEDQEKQYETKTRRAREILEKREAAVMAKEQASLEKLQEKQDAAVFAIANALQKHRKVSSAEPAAVPYDGQCESPTIDDQPPDAMTAESNLGEIIDPSENGNLEYPQLVKLCEQMDSEGLHKFISDNRKNLAVLKEEIPLALKAAVNPAQLVLDSLEDFYPKEVANVDGKKDSTLLGLRRTCIMLMECLSILLMYTDLVSVSALISEDVKDQAKAIAEEWKPKLDSLDVDANNGNSLEAHAFLQLLATFGIASDFDVEEISRLIPMVSRRRQAAELCRFLGLSERMPGVIEVLVNSGRQIDAVNLAFAFDLMELFSPVPLLKSYLKEARKVASSGKPGSASPTTVQNDVNERELTALKAVIKCIEEHKLEEQYPVDPLQKRLHQLEKAKADKKRANEVAKPQPKRPRASGVGCGPRVTNNAPEKIFYPRVPDRYPQYVYDRPYIYSGPADNHVPPLMSSATYNFSPSHGNYFGNGYQYQTPYLH

SEQ ID NO: 3795 - DNA, 1719 bp, Populus balsamifera subsp. trichocarpa
  misc_feature (1)..(1719): Ceres ANNOT ID no. 1483570
  misc_feature 424093:<222: Transcription Factor
  misc_feature: Phenotype: Activates expression of the gene endogenous to the AtSS1 (SEQ ID NO 4158) regalutory region Useful for modulating Alkaloid Biosynthesis
atggctaattctgagcaagttgtggaaaatgatgctggatcctctctgatagaacagcttgggagggcattacatgagctagaagcttgcaaggattcttctgaggaaaaggttcagtggatggaaattgaagaacatttccgcaaccttgagacggtgttaaagaaaaaatctgaagagttagaagctagggagaaagaatatgaagagaaagaagctgaaactcgtgcattgcttgctgagagagaggtggctgttgtcactaaggaactagaactcctagatcgaatacaggagctaaaagatactgctgtttctgtcatcgcagaggcacgagctaatcaccagcccagctctttggagtgcattgatggtggagataacatagacagaaaggtaagcagctctcttgctgaaataaattatccaggggagtattctcaaaaaatgggtgaaactgctgatggtgtggctgctgatgttaagccacgtccagagctcacacaattttgcgagcagatggatgcaaaagggcttctgagtttttccatggagaatcaaaaaaatttatatgccatccgtgatgaactttctgttgcactagaaattgcaactgaaccagcccgtttggtgctggattcactagaggggttttatcctcctgttgaaaccggccaacaaatggataagaaggatgctgcccttcagggcatgcgcaaatcctgtgttatatttatggaagccatggccgccttattggcaagaattgacccaggtgctgatcaccttctaaaccctgaaataaagcagcaagccaaggcatttgctgatgaatggaagcctaagttggctagtgcgggcactgatgctaccaatggagatccattggaagcagaagcattcttgcagctcctttcaacttttagaattgcttcggagtttgatgaagaagaactctgcaagcttgttcttgtaattgcccagcgcaggcaagcacctgagctctgccattctcttggtttaacacacaaaataccaggtgttgttgagtcattggtcaacgatgggaaacaaattgatgctgttcgatttatccatgccttccagcttactgaaattttccctcctgttcccctcctgaagacatacttgaaggatttgagaagaaactcacagaacacacaaagaaagggtggaaactcaggaggtggtgcaggtgtacaggttgatggaaatgcactagagcttgcagcactgaaggttgtcatcaggtgtgttgaagagtacaagcttgaagctgactacccacttgatccacttcagaaaaggcttgctcaattggagaaatcgaaatctgataagaagagggcaggtgattttggtaaacattaccaatcgaagaaaccaaaagttaatcgaggttatcgtggattacgaggtgctgccactggtcctgcaagtggttggcgagctccacctccttggacagcgtaccctggaatgctgcctgagaggtatcctcatactgttccaaatccctatgaatatcagattcctagccaatctgcatatggtcagcaagctaatgatcaaaagatgtactacaatcctcaagatgacagggttaccgctgcctcctcatacagtgcagctcctcctaattatggcagttatatgggtgctggaacgcgatcctcacaccaaccatatatgcagtag

SEQ ID NO: 3796 - protein, 572 aa, Populus balsamifera subsp. trichocarpa
  misc_feature (1)..(572): Ceres ANNOT ID no. 1483570
  misc_feature (153)..(462): Pfam Name: Frigida Pfam Description: Frigida-like protein
  misc_feature: SWISSPROT Homolog: FRIGI_ARATH FRIGIDA protein with e-value of 1.1e-23 and BLAST sequence identity of 28.6
  misc_feature 424189:<222: Transcription Factor
  misc_feature: Phenotype: Activates expression of the gene endogenous to the AtSS1 (SEQ ID NO 4158) regalutory region Useful for modulating Alkaloid Biosynthesis
  misc_feature (1)..(572): Functional Homolog of  Ceres CDNA ID no. 23539673 at SEQ ID NO. 3837 with e-value of 3.10E-93 and BLAST sequence identity of 44.6
MANSEQVVENDAGSSLIEQLGRALHELEACKDSSEEKVQWMEIEEHFRNLETVLKKKSEELEAREKEYEEKEAETRALLAEREVAVVTKELELLDRIQELKDTAVSVIAEARANHQPSSLECIDGGDNIDRKVSSSLAEINYPGEYSQKMGETADGVAADVKPRPELTQFCEQMDAKGLLSFSMENQKNLYAIRDELSVALEIATEPARLVLDSLEGFYPPVETGQQMDKKDAALQGMRKSCVIFMEAMAALLARIDPGADHLLNPEIKQQAKAFADEWKPKLASAGTDATNGDPLEAEAFLQLLSTFRIASEFDEEELCKLVLVIAQRRQAPELCHSLGLTHKIPGVVESLVNDGKQIDAVRFIHAFQLTEIFPPVPLLKTYLKDLRRNSQNTQRKGGNSGGGAGVQVDGNALELAALKVVIRCVEEYKLEADYPLDPLQKRLAQLEKSKSDKKRAGDFGKHYQSKKPKVNRGYRGLRGAATGPASGWRAPPPWTAYPGMLPERYPHTVPNPYEYQIPSQSAYGQQANDQKMYYNPQDDRVTAASSYSAAPPNYGSYMGAGTRSSHQPYMQ

SEQ ID NO: 3797 - protein, 354 aa, Arabidopsis thaliana
  misc_feature (1)..(354): Ceres CDNA ID no. 23544026
  misc_feature (1)..(354): Also Known As Ceres GEMINI ID 5111D1
  misc_feature 424338:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
MIKAMALSSAGVVSHLHPPSFSSSSGLSVNRVLFRNRNASPCGLSLPILNPSRSVLVFARGKNRKGFVSSSSSSPKKNKKKSLDGADNGGGEEEEDPFEALFNLLEEDLKNDNSDDEEISEEELEALADELARALGVGDDVDDIDLFGSVTGDVDVDVDNDDDDNDDDDNDDDDDDSEEDERPTKLKNWQLKRLAYALKAGRRKTSIKNLAAEVCLDRAYVLELLRDPPPKLLMLSATLPDEKPPVAAPENSSPDPSPVESLSAEDVVVEPKEKVKDEAVHVMQQRWSAQKRVKKAHIETLEKVYRRSKRPTNAVVSSIVQVTNLPRKRVLKWFEDKRAEDGVPDKRAPYQAPV

SEQ ID NO: 3798 - DNA, 1023 bp, Populus balsamifera subsp. trichocarpa
  misc_feature (1)..(1023): Ceres ANNOT ID no. 1455533
  misc_feature 424433:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
atggcgttcgctctgtcatcttcaagcgcctcaacagcatttcaaagcttaacatctttacactctagtgatggactccatctgaggccatccaatctccttcttccacgtcactctcttgctacatccaccctcgccttctctcgccgtcgaaaccacaactccacagtcacttcctcttcaaagaaaaagaagaaaagtgtatctaagaaggaagtgagggaagaagatgagatagatgaagatgcatttgaggcattgtttggtatgttagaagaagaccttaaaagtgatgatttgtcaacgggtgatggcgattatgaaaatggtgatttaagtgaaaaagaccttgaaaagcttcaacgtgagttagaggaggcactaggagttggtggagatgatgatgttgaggtagaaatggctagttcagttggggatgatgttgaggataatgacggtgatgaagaagaagaggaggagggggaaagacctgtgatgcttaagaattggcaacttcggagacttgcacgagttttaaaaattgggcgccgcaaaacaggtattaaaagtcttgctgcagagctttgtcttgatagggctattgttcttaacttgcttcgtgaccctcctccaaatcttgtcatgatgagtgctgcattacctgatgaacctgcacctacactggtgatgccggaaactaaaccaagtgaaattgttcctgaagaaacaagagaggagaatgttgtaaaatccgagagtgagatgaaattgccagttcatgttaggcaggatagttggtttgctcgaaagagactgaagaaagtccatgttgaaactcttgaaagagtctatagaagaactaagaggcccactaacacaatgattagcagcattgtacatgtgacaaacctgccccggaaaagagtggtgaaatggtttgaagataaacgtgctggagatggtgttcctgaacatcggaacccatttcaaaggtctgttcctgaaactgtatcttcaagttga

SEQ ID NO: 3799 - protein, 340 aa, Populus balsamifera subsp. trichocarpa
  misc_feature (1)..(340): Ceres ANNOT ID no. 1455533
  misc_feature (268)..(327): Pfam Name: Homeobox Pfam Description: Homeobox domain
  misc_feature: SWISSPROT Homolog: YG3R_YEAST Hypothetical 22.2 kDa protein in NSR1-TIF4631 intergenic region with e-value of 1.3e-08 and BLAST sequence identity of 35.5
  misc_feature: SWISSPROT Homolog: NO29_XENLA Nucleoplasmin-like protein NO29 (NOVA) with e-value of 3.6e-08 and BLAST sequence identity of 51.9
  misc_feature: SWISSPROT Homolog: CASQ1_RANES Calsequestrin-1 precursor (Calsequestrin, skeletal muscle isoform) with e-value of 9.0e-08 and BLAST sequence identity of 39.8
  misc_feature: SWISSPROT Homolog: FKBP4_SPOFR 46 kDa FK506-binding nuclear protein (EC 5.2.1.8) (Peptidyl-prolyl cis-trans isomerase) (PPIase) (Rotamase) with e-value of 1.5e-07 and BLAST sequence identity of 23.5
  misc_feature: SWISSPROT Homolog: VHS3_YEAST Protein VHS3 (Viable in a HAL3 SIT4 background protein 3) with e-value of 1.2e-06 and BLAST sequence identity of 46.1
  misc_feature 424540:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (1)..(340): Functional Homolog of  Ceres CDNA ID no. 23544026 at SEQ ID NO. 3844 with e-value of 1.40E-73 and BLAST sequence identity of 55.7
MAFALSSSSASTAFQSLTSLHSSDGLHLRPSNLLLPRHSLATSTLAFSRRRNHNSTVTSSSKKKKKSVSKKEVREEDEIDEDAFEALFGMLEEDLKSDDLSTGDGDYENGDLSEKDLEKLQRELEEALGVGGDDDVEVEMASSVGDDVEDNDGDEEEEEEGERPVMLKNWQLRRLARVLKIGRRKTGIKSLAAELCLDRAIVLNLLRDPPPNLVMMSAALPDEPAPTLVMPETKPSEIVPEETREENVVKSESEMKLPVHVRQDSWFARKRLKKVHVETLERVYRRTKRPTNTMISSIVHVTNLPRKRVVKWFEDKRAGDGVPEHRNPFQRSVPETVSSS

SEQ ID NO: 3800 - protein, 506 aa, Arabidopsis thaliana
  misc_feature (1)..(506): Ceres CDNA ID no. 23544617
  misc_feature (1)..(506): Also Known As Ceres GEMINI ID 5110D6
  misc_feature (70)..(92): Pfam Name: zf-C2H2 Pfam Description: Zinc finger, C2H2 type
  misc_feature 424654:<222: Transcription Factor
  misc_feature: Phenotype: Activates expression of the gene endogenous to the AtHMGS (SEQ ID NO 4144) regalutory region Useful for modulating Terpenoid Biosynthesis
MTTEDQTISSSGGYVQSSSTTDHVDHHHHDQHESLNPPLVKKKRNLPGNPDPEAEVIALSPKTLMATNRFLCEICGKGFQRDQNLQLHRRGHNLPWKLKQRTSKEVRKRVYVCPEKSCVHHHPTRALGDLTGIKKHFCRKHGEKKWKCEKCAKRYAVQSDWKAHSKTCGTREYRCDCGTIFSRRDSFITHRAFCDALAEETARLNAASHLKSFAATAGSNLNYHYLMGTLIPSPSLPQPPSFPFGPPQPQHHHHHQFPITTNNFDHQDVMKPASTLSLWSGGNINHHQQVTIEDRMAPQPHSPQEDYNWVFGNANNHGELITTSDSLITHDNNINIVQSKENANGATSLSVPSLFSSVDQITQDANAASVAVANMSATALLQKAAQMGATSSTSPTTTITTDQSAYLQSFASKSNQIVEDGGSDRFFASFGSNSVELMSNNNNGLHEIGNPRNGVTVVSGMGELQNYPWKRRRVDIGNAGGGGQTRDFLGVGVQTICHSSSINGWI

SEQ ID NO: 3801 - DNA, 1272 bp, Populus balsamifera subsp. trichocarpa
  misc_feature (1)..(1272): Ceres ANNOT ID no. 1541623
  misc_feature 424775:<222: Transcription Factor
  misc_feature: Phenotype: Activates expression of the gene endogenous to the AtHMGS (SEQ ID NO 4144) regalutory region Useful for modulating Terpenoid Biosynthesis
atggcaacagaagaagcaataacaagtagtaacaatggttttgttgaaaaccctgttggtggatccaatcctcctgctctaaagaagaagagaaacctcccaggaactccagatcctgaagcagaagtcatagctttatcaccaaaaactctcatggccaccaacagattcttgtgtgaaatatgcggtaaagggtttcagagagatcaaaacctacaactccataggagaggacacaaccttccatggaagctcaagcaaaggactaacaaagaagtaaaaaaacgtgtttatgtctgccctgaaaagacctgtgtccatcatcatccttctagggctcttggagacttaacaggtataaagaagcacttttgtaggaagcatggagagaagaagtggaagtgtgaaaaatgttcaaaaagatacgctgtgcaatcagattggaaagcgcactcaaagacttgtggcactagggagtacaaatgtgactgtgggactctattttcaaggagagatagcttcatcactcacagggccttctgtgatgccttagcagaggaaacagcaagagtaaatgcagtatctagcataaacaacttgactgctgggagcatcaattatcatctgatggggaatccattagggcctaacatggcacaacatttctcttcaattttcaagccaatttcaagcaatgatcaccaaacaagacagggaggagtttccttgtggatgaaccaaggattcaattggccagtttttggaaataagatctcttcaaataatgctcacgaggaactgacaagcactttagtacttcctttaaccaacgttaaggaagcagctgctgcaagtcagctagcaagtgttccttcattgtatagcacccaacaacagcagtcccatcaaacaacttcggccaacatgtcagccactgctttgctgcaaaaagctgctcagatcggtgcaacttcaactgatccatcattccttggaagttttgcgctaaagagcaatgctaaaaaagttcaagatgggaacaagttctgtggactatatggttcaagccctgtaagcactaatccagcaagcgacgtggagaactcgggaagtgatcagatctcctctttgaatcagcttcaaatgtaccctaaaaggcagaaaatatttcaaagtgatcaagatagtcctgcaggagggcaaactagagactttcttggtgttggtgtacaagccatatgccacccatcatctatcaatggctggatttaa

SEQ ID NO: 3802 - protein, 423 aa, Populus balsamifera subsp. trichocarpa
  misc_feature (1)..(423): Ceres ANNOT ID no. 1541623
  misc_feature (57)..(79): Pfam Name: zf-C2H2 Pfam Description: Zinc finger, C2H2 type
  misc_feature: SWISSPROT Homolog: TT1_ARATH TRANSPARENT TESTA 1 protein (Zinc finger protein TT1) (TTL1) with e-value of 4.8e-18 and BLAST sequence identity of 35.7
  misc_feature: SWISSPROT Homolog: ZN235_HUMAN Zinc finger protein 235 (Zinc finger protein 93 homolog) (Zfp-93) (Zinc finger protein HZF6) (Fragment) with e-value of 8.8e-11 and BLAST sequence identity of 30.1
  misc_feature: SWISSPROT Homolog: ZFP58_MOUSE Zinc finger protein 58 (Zfp-58) (Zinc finger protein Mfg-1) (Fragment) with e-value of 1.4e-10 and BLAST sequence identity of 30.6
  misc_feature: SWISSPROT Homolog: ZN239_MOUSE Zinc finger protein 239 (Zfp-239) (Zinc finger protein MOK-2) with e-value of 5.0e-10 and BLAST sequence identity of 27.1
  misc_feature: SWISSPROT Homolog: ZNF45_HUMAN Zinc finger protein 45 (BRC1744) with e-value of 2.6e-09 and BLAST sequence identity of 33.6
  misc_feature 424890:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(423): Functional Homolog of  Ceres CDNA ID no. 23544617 at SEQ ID NO. 3847 with e-value of 3.70E-123 and BLAST sequence identity of 70.9
MATEEAITSSNNGFVENPVGGSNPPALKKKRNLPGTPDPEAEVIALSPKTLMATNRFLCEICGKGFQRDQNLQLHRRGHNLPWKLKQRTNKEVKKRVYVCPEKTCVHHHPSRALGDLTGIKKHFCRKHGEKKWKCEKCSKRYAVQSDWKAHSKTCGTREYKCDCGTLFSRRDSFITHRAFCDALAEETARVNAVSSINNLTAGSINYHLMGNPLGPNMAQHFSSIFKPISSNDHQTRQGGVSLWMNQGFNWPVFGNKISSNNAHEELTSTLVLPLTNVKEAAAASQLASVPSLYSTQQQQSHQTTSANMSATALLQKAAQIGATSTDPSFLGSFALKSNAKKVQDGNKFCGLYGSSPVSTNPASDVENSGSDQISSLNQLQMYPKRQKIFQSDQDSPAGGQTRDFLGVGVQAICHPSSINGWI

SEQ ID NO: 3803 - DNA, 1281 bp, Populus balsamifera subsp. trichocarpa
  misc_feature (1)..(1281): Ceres ANNOT ID no. 1509108
  misc_feature 425004:<222: Transcription Factor
  misc_feature: Phenotype: Activates expression of the gene endogenous to the AtHMGS (SEQ ID NO 4144) regalutory region Useful for modulating Terpenoid Biosynthesis
atggcagcagaagaagcaataactagtagttataatggttctgtcgaaaatcctgttggtggatccaatccccctgctctaaagaagaagagaaaccttccaggaacaccagatcctgaagcagaagtcatagctttatcaccaaaaactctcatggccaccaacagattcttgtgtgaaatatgtggtaaagggtttcaaagggatcaaaatctacaactccataggagaggacacaaccttccatggaagctgaagcaaaggacaaataatgaagtaagaaagcgcgtttatgtctgccctgaaaagacctgtgtccaccatcatccctctagggctcttggagacttaacaggtataaagaagcacttttgtaggaagcatggtgagaagaaatggaagtgtgaaaaatgttcgaagagatatgctgtccagtcagattggaaagcacactcaaagacttgtggcactagggaatacaaatgtgactgtgggactctattttcaaggagagatagcttcatcactcatagggccttctgtgatgccttagcagaggaaacagcaagagtaaatgcagtatctagcataagaaacttaactgctggcaacatcagttatcatctaccggggaacccattagggcctaacatggcacaacatttctcttcaattttcaagccaatttcaagtaatgatcaccacacaagacaaggaggactttccttgtggatgcaccaaggaggattaaattggccagtgtttggaaacaagatctcttcaaataatgctcacgaggagctgacaagcactttagtacttcctttaagcaatgttaaggaagcagctgctgcaagtcagctagtaagtgttccttcattgtacagtacccaacaacaacaatcccatcaaacaacttcagcaaatatgtcagccactgctttgctgcaaaaagctactcagattggtgcaacctcaacagatccatcattccttgggagttttgggctaaagagcttcagtactaaagctcaagatgggaacaacaagttctgtggactgtatggttcaagccctataagcactaacccagcaagtgatatggaaaactcaggaaatgatgagattcccactttgaatcagcttcaaatgtattctgctaaaaggcagaaaatatttcaaagtgatcaagatagccctgcaggagggcaaactagagactttcttggtgttggtgtacaagccatatgccacccatcgtctatcaatggatggatttaa

SEQ ID NO: 3804 - protein, 426 aa, Populus balsamifera subsp. trichocarpa
  misc_feature (1)..(426): Ceres ANNOT ID no. 1509108
  misc_feature (57)..(79): Pfam Name: zf-C2H2 Pfam Description: Zinc finger, C2H2 type
  misc_feature: SWISSPROT Homolog: TT1_ARATH TRANSPARENT TESTA 1 protein (Zinc finger protein TT1) (TTL1) with e-value of 4.8e-18 and BLAST sequence identity of 35.7
  misc_feature: SWISSPROT Homolog: ZN235_HUMAN Zinc finger protein 235 (Zinc finger protein 93 homolog) (Zfp-93) (Zinc finger protein HZF6) (Fragment) with e-value of 8.8e-11 and BLAST sequence identity of 30.1
  misc_feature: SWISSPROT Homolog: ZFP58_MOUSE Zinc finger protein 58 (Zfp-58) (Zinc finger protein Mfg-1) (Fragment) with e-value of 1.4e-10 and BLAST sequence identity of 30.6
  misc_feature: SWISSPROT Homolog: ZN239_MOUSE Zinc finger protein 239 (Zfp-239) (Zinc finger protein MOK-2) with e-value of 5.0e-10 and BLAST sequence identity of 27.1
  misc_feature: SWISSPROT Homolog: ZNF45_HUMAN Zinc finger protein 45 (BRC1744) with e-value of 2.6e-09 and BLAST sequence identity of 33.6
  misc_feature 425119:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(426): Functional Homolog of  Ceres CDNA ID no. 23544617 at SEQ ID NO. 3847 with e-value of 4.29E-120 and BLAST sequence identity of 67.7
MAAEEAITSSYNGSVENPVGGSNPPALKKKRNLPGTPDPEAEVIALSPKTLMATNRFLCEICGKGFQRDQNLQLHRRGHNLPWKLKQRTNNEVRKRVYVCPEKTCVHHHPSRALGDLTGIKKHFCRKHGEKKWKCEKCSKRYAVQSDWKAHSKTCGTREYKCDCGTLFSRRDSFITHRAFCDALAEETARVNAVSSIRNLTAGNISYHLPGNPLGPNMAQHFSSIFKPISSNDHHTRQGGLSLWMHQGGLNWPVFGNKISSNNAHEELTSTLVLPLSNVKEAAAASQLVSVPSLYSTQQQQSHQTTSANMSATALLQKATQIGATSTDPSFLGSFGLKSFSTKAQDGNNKFCGLYGSSPISTNPASDMENSGNDEIPTLNQLQMYSAKRQKIFQSDQDSPAGGQTRDFLGVGVQAICHPSSINGWI

SEQ ID NO: 3805 - protein, 254 aa, Arabidopsis thaliana
  misc_feature (1)..(254): Ceres CDNA ID no. 23544687
  misc_feature (1)..(254): Also Known As Ceres GEMINI ID 5109C3
  misc_feature (63)..(112): Pfam Name: HLH Pfam Description: Helix-loop-helix DNA-binding domain
  misc_feature 425247:<222: Transcription Factor
  misc_feature: Phenotype: Activates expression of the gene endogenous to the AtPES (SEQ ID NO 4142) regalutory region Useful for modulating Terpenoid Biosynthesis
MENSYDSSKWSDSTTPYMVSWSLQSESSDSDWNRFNLGFSSSSFGGNFPADDCVGGIEKAESLSRSHRLAEKRRRDRINSHLTALRKLVPNSDKLDKAALLATVIEQVKELKQKAAESPIFQDLPTEADEVTVQPETISDFESNTNTIIFKASFCCEDQPEAISEIIRVLTKLQLETIQAEIISVGGRMRINFILKDSNCNETTNIAASAKALKQSLCSALNRITSSSTTTSSVCRIRSKRQRWFLSSHYSHNE

SEQ ID NO: 3806 - DNA, 780 bp, Populus balsamifera subsp. trichocarpa
  misc_feature (1)..(780): Ceres ANNOT ID no. 1517998
  misc_feature 425320:<222: Transcription Factor
  misc_feature: Phenotype: Activates expression of the gene endogenous to the AtPES (SEQ ID NO 4142) regalutory region Useful for modulating Terpenoid Biosynthesis
atggaagatcactattctccttgctggcctgctgctcctgcagaggcaaactgggatcaaacaagtgctgcagtatatgatgagtcctttttagtcccatgcccatctcatgcttctgcctctgccaactttcaagtatacggattcccttcgtggtcagtaccgcttcaggaggcttcagaagataaagctgcttcgagttccaagagtcatagccaagctgagaaacggcgacgggacaggattaatgcacaactgggaattcttaggaaactcgttcctaaatcagaaaagatggacaaggcagctctcctaggaagtgcgattgatcatgtgaaggatctcaaacaaaaagcaacggaaatcagcagaactttcacaatcccaactgaagttgatgaagtgacggttgattgtgatgtttctcaagttacaagccctcccagcaccaacaaagacaaggacaacacatttatcagggcatctgtttgctgcgatgatcggccagaactgttttcggagcttattacggtgctcaaaggccttagactaaccatagttagagctgatattgctagtgtaggtggaagagttaagagcatattagtactttgcagtgagtgcagtgaagaggggagtgtttcaattagcactattaaacagtcgcttaatctagttttgagtagaatcgcttcatcatcagtgccatcaaattatcgtattagaagcaagaggcaaaggttctttttgccttctcatttgtcagaacaatatgaataa

SEQ ID NO: 3807 - protein, 259 aa, Populus balsamifera subsp. trichocarpa
  misc_feature (1)..(259): Ceres ANNOT ID no. 1517998
  misc_feature (67)..(116): Pfam Name: HLH Pfam Description: Helix-loop-helix DNA-binding domain
  misc_feature: SWISSPROT Homolog: SPT_ARATH Protein SPATULA with e-value of 2.5e-06 and BLAST sequence identity of 54.3
  misc_feature: SWISSPROT Homolog: PIF3_ARATH Phytochrome-interacting factor 3(Phytochrome-associated protein 3) (Basic helix-loop-helix protein 8) (bHLH8) (AtbHLH008) with e-value of 3.5e-06 and BLAST sequence identity of 45.6
  misc_feature 425394:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(259): Functional Homolog of  Ceres CDNA ID no. 23544687 at SEQ ID NO. 3852 with e-value of 1.50E-39 and BLAST sequence identity of 54.2
MEDHYSPCWPAAPAEANWDQTSAAVYDESFLVPCPSHASASANFQVYGFPSWSVPLQEASEDKAASSSKSHSQAEKRRRDRINAQLGILRKLVPKSEKMDKAALLGSAIDHVKDLKQKATEISRTFTIPTEVDEVTVDCDVSQVTSPPSTNKDKDNTFIRASVCCDDRPELFSELITVLKGLRLTIVRADIASVGGRVKSILVLCSECSEEGSVSISTIKQSLNLVLSRIASSSVPSNYRIRSKRQRFFLPSHLSEQYE

SEQ ID NO: 3808 - DNA, 780 bp, Populus balsamifera subsp. trichocarpa
  misc_feature (1)..(780): Ceres ANNOT ID no. 1458313
  misc_feature 425478:<222: Transcription Factor
  misc_feature: Phenotype: Activates expression of the gene endogenous to the AtPES (SEQ ID NO 4142) regalutory region Useful for modulating Terpenoid Biosynthesis
atggaagatcacttctctccttgttggcctgctgctcctgcagaggcaaactgggttcaaacaagtgctgcagtatatgatgagtcctttttagtgccatgcccatctcatgcctctgcttctgccaactttcaagttaatggattcccttcgtggtctataccgattcaggaggcttcggagaataaagctgcttctaattccaagagtcatagccaagctgagaagcggcgccgggacaggattaatgcacagctgggaattcttaggaaactcattcccaaatcagaaaagatggacaaggcagctctgctaggaagcgcgattgatcatgtgaaggatctcaagcaaaaagcaacggaaatcagcagaactttcacaatcccaactgaagttgatgaagtaacggttgattgtgatgtttctcaagctacaaacccttctagcaccaacaaagacaaggacagcacgttcatcagggcttctgtttgctgcgatgatcggccagaactgttttcggagctcattcgagtgctcaggggccttagactaaccattgttagagccgatattgccagtgtaggtggaagggttaaaagcatactagtactttgcaacaagtgcagtaaagagggaggtgtttcaatcagcactattaaacagtcacttaatcttgttttgagtagaattgcttcatcatcagtgccatcaaattatcgtattagaagcaagaggcagaggttctttttgccttctcatctgtcacagcaatatacataa

SEQ ID NO: 3809 - protein, 259 aa, Populus balsamifera subsp. trichocarpa
  misc_feature (1)..(259): Ceres ANNOT ID no. 1458313
  misc_feature (67)..(116): Pfam Name: HLH Pfam Description: Helix-loop-helix DNA-binding domain
  misc_feature: SWISSPROT Homolog: SPT_ARATH Protein SPATULA with e-value of 2.5e-06 and BLAST sequence identity of 54.3
  misc_feature: SWISSPROT Homolog: PIF3_ARATH Phytochrome-interacting factor 3(Phytochrome-associated protein 3) (Basic helix-loop-helix protein 8) (bHLH8) (AtbHLH008) with e-value of 3.5e-06 and BLAST sequence identity of 45.6
  misc_feature 425552:<222: Transcription Factor
  misc_feature: Phenotype: Activates expression of the gene endogenous to the AtPES (SEQ ID NO 4142) regalutory region Useful for modulating Terpenoid Biosynthesis
  misc_feature (1)..(259): Functional Homolog of  Ceres CDNA ID no. 23544687 at SEQ ID NO. 3852 with e-value of 4.99E-39 and BLAST sequence identity of 51.5
MEDHFSPCWPAAPAEANWVQTSAAVYDESFLVPCPSHASASANFQVNGFPSWSIPIQEASENKAASNSKSHSQAEKRRRDRINAQLGILRKLIPKSEKMDKAALLGSAIDHVKDLKQKATEISRTFTIPTEVDEVTVDCDVSQATNPSSTNKDKDSTFIRASVCCDDRPELFSELIRVLRGLRLTIVRADIASVGGRVKSILVLCNKCSKEGGVSISTIKQSLNLVLSRIASSSVPSNYRIRSKRQRFFLPSHLSQQYT

SEQ ID NO: 3810 - protein, 257 aa, Arabidopsis thaliana
  misc_feature (1)..(257): Ceres CDNA ID no. 23544992
  misc_feature (1)..(257): Also Known As Ceres GEMINI ID 5110B1
  misc_feature 425644:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
MDETNGRRETHDFMNVNVESFSQLPFIRRTPPKEKAAIIRLFGQELVGDNSDNLSAEPSDHQTTTKNDESSENIKDKDKEKDKDKDKDNNNNRRFECHYCFRNFPTSQALGGHQNAHKRERQHAKRGSMTSYLHHHQPHDPHHIYGFLNNHHHRHYPSWTTEARSYYGGGGHQTPSYYSRNTLAPPSSNPPTINGSPLGLWRVPPSTSTNTIQGVYSSSPASAFRSHEQETNKEPNNWPYRLMKPNVQDHVSLDLHL

SEQ ID NO: 3811 - DNA, 723 bp, Populus balsamifera subsp. trichocarpa
  misc_feature (1)..(723): Ceres ANNOT ID no. 1454621
  misc_feature 425736:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
atggataaggttgaaagagagactcatgactttatgaatgtggaatccttctctcagcttccattcatccgccccgcacccgtcaaagaaaagggcattcgcctcttcggcatagaattcggcagcaacaacgacagtccagcagctgacgagtctgagtcagccgaaactaatgaagacaccgtaaaagaaagcgagagtagtgacaacaaccgaagatttgaatgccattactgttgcagaaacttccctacttctcaagccttaggtggccaccaaaacgcgcacaaaagagagcgtcagcacgcgaaacgtgcccacctccagtcggccatggctcacaacagccttacagatgcacactattatggccttgtaaactacaggatagattcaactccgagctcagccatgacttatccttcatggaatagccactctaacactagcaggttttacggcagtcatggctcctattcacaacaacctatcaatggaagtccattaggcttgtggcggatcccggctgttcatggtggtggtactttccatcatagtgaccgttcgatgcatcatccattaccattatttgcaggtgaggaattgaaaccctcaccggccggtactggttcaagctcgcaagggcgacatgtgggagtgaggagagaggttggttcgatacagtgcaagagtgctttaacagtgatgagggaaatcaggtga

SEQ ID NO: 3812 - protein, 240 aa, Populus balsamifera subsp. trichocarpa
  misc_feature (1)..(240): Ceres ANNOT ID no. 1454621
  misc_feature: SWISSPROT Homolog: ZFP3_ARATH Zinc finger protein 3 with e-value of 7.6e-14 and BLAST sequence identity of 34.3
  misc_feature: SWISSPROT Homolog: ZFP7_ARATH Zinc finger protein 7 with e-value of 5.3e-13 and BLAST sequence identity of 45.5
  misc_feature: SWISSPROT Homolog: ZFP6_ARATH Zinc finger protein 6 with e-value of 3.0e-11 and BLAST sequence identity of 54.5
  misc_feature: SWISSPROT Homolog: KNU_ARATH Zinc-finger protein KNUCKLES with e-value of 1.0e-08 and BLAST sequence identity of 69.4
  misc_feature: SWISSPROT Homolog: ZFP4_ARATH Zinc finger protein 4 with e-value of 6.6e-08 and BLAST sequence identity of 41.0
  misc_feature 425838:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the EcBBE (SEQ ID NO 4156) regalutory region and/or the EcNMCH3(SEQ ID NO 4157)  regulatory region. Useful for modulating Alkaloid Biosynthesis
  misc_feature (1)..(240): Functional Homolog of  Ceres CDNA ID no. 23544992 at SEQ ID NO. 3857 with e-value of 3.09E-39 and BLAST sequence identity of 59.7
MDKVERETHDFMNVESFSQLPFIRPAPVKEKGIRLFGIEFGSNNDSPAADESESAETNEDTVKESESSDNNRRFECHYCCRNFPTSQALGGHQNAHKRERQHAKRAHLQSAMAHNSLTDAHYYGLVNYRIDSTPSSAMTYPSWNSHSNTSRFYGSHGSYSQQPINGSPLGLWRIPAVHGGGTFHHSDRSMHHPLPLFAGEELKPSPAGTGSSSQGRHVGVRREVGSIQCKSALTVMREIR

SEQ ID NO: 3813 - protein, 485 aa, Arabidopsis thaliana
  misc_feature (1)..(485): Ceres CDNA ID no. 23545147
  misc_feature (46)..(484): Pfam Name: p450 Pfam Description: Cytochrome P450
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
MVLEPNFVLSWVFLCIAATISSTLFFFRKKHHRFITKKIQKKKKLLPGEMGLPWIGETMDFYKAQKSNRVFEDFVNPRIIKHGNIFKTRIMGSPTIVVNGAEANRLILSNEFSLVVSSWPSSSVQLMGMNCIMAKQGEKHRVLRGIVANSLSYIGLESLIPKLCDTVKFHHETEWRGKEEISLYRSAKVLTFTVVFECLYGIKVEIGMLEVFERVLEGVFALPVEFPCSKFARAKKARLEIETFLVGKVREKRREMEKEGAEKPNTTLFSRLVEELIKGVITEEEVVDNMVLLVFAAHDTTSYAMSMTFKMLAQHPTCRDTLLQEHAQIKANKGEGEYLTVEDVKKMKYSWQVVRETMRLSPPIFGSFRKAVADIDYGGYTIPKGWKILWTTYGTHYNPEIFQDPMSFDPTRFDKPIQAYTYLPFGGGPRLCAGHQLAKISILVFMHFVVTGFDWSLVYPDETISMDPLPFPSLGMPIKISPKVS

SEQ ID NO: 3814 - DNA, 1434 bp, Populus balsamifera subsp. trichocarpa
  misc_feature (1)..(1434): Ceres ANNOT ID no. 1443044
  misc_feature 426084:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atgaccatacaaatatgctctttgctttcctgggctttgttttgctcaacagcaatgctcctcgccatttttttgaaacacagaaaaggctgcggcaagagtgatggaaaactaccaccaggggaaatgggacttccttggatcggtgaaacaatagagttctacagatcacaacgtgacaaccaattgttcgaagagtttgttcaaccacggatcacaaaatatggaaagatattcaaaacgaggctaatgggttctccaacaatcatcgttaatggtgctgaagctaaccggtttttcttgtccaacgaattcaagttggtagttagctcatggcctactgcatcagttcagctcatgggcataaattccatcatggaaaagcaaggggagaagcaccgatgccttcgtggaataatcgccaccagccttggccctgcagggcttgagattttagtgccaaaaatttgcgactcagttcaattgtacctagataaaaattggaatgtaagagaagagatcagtctttaccattcgaccaaagccttgacgtttactatagttttggagtgcttgctagggctcaattttgagcctggaaccctgaatacttttgagagagttttggaaggagtttttgcaccacctatttcatttcctggttccaagttttcaagagccaagaaagcaaggcgggagataaaagaaatgttgattaaagtagtaagggagaaaaggaagaagatggaaagtggtttagggggggatgaaggaatgttattttcccaattggtaagcgggatgattcgaggggagatcagtgaagaggaggttgttgataatgtggttttgctagtgtttgcagctcatgacacaacatcttttgccattgccatgaccttcaaaatgttagctgagcatccagactgccattctctcctccttcaagaacatgatgacataatgaacaagaggagatctggagaaaatctaacaatggaagacacgaagaaaatgaaatatacatggcaagttgcacgtgaaagcatgcggctttttcctcctatctttggctccttcagaaaagctattgctgacattgaatatgaaggattcacgattcccaaagggtggaaggttctgtggacaacatatggcacccactacaatgaagaatatttcaaggatcctctgacttttaatccaagaagatttgaggagccaattccaccatatgcttaccttcccttcggtggaggaccaagactttgtgcaggaaaccaactggcaaagttgaatatcctcatcttcatccactatgttgtaacgcgttacaattggtccttactctgccctggtgaacaaatcaccatggaccctctcccattcccttcccatggaatgcccatcaaagtttctctcaagtcatcttag

SEQ ID NO: 3815 - protein, 477 aa, Populus balsamifera subsp. trichocarpa
  misc_feature (1)..(477): Ceres ANNOT ID no. 1443044
  misc_feature (39)..(96): Pfam Name: p450 Pfam Description: Cytochrome P450
  misc_feature: SWISSPROT Homolog: T13H_TAXCU Taxane 13-alpha-hydroxylase (EC 1.14.13.77) (Cytochrome P450 725A2) with e-value of 6.4e-88 and BLAST sequence identity of 38.0
  misc_feature: SWISSPROT Homolog: T10H_TAXCU Taxane 10-beta-hydroxylase (EC 1.14.13.76) (5-alpha-taxadienol-10-beta-hydroxylase) (Cytochrome P450 725A1) with e-value of 4.5e-80 and BLAST sequence identity of 35.0
  misc_feature: SWISSPROT Homolog: C90A1_ARATH Cytochrome P450 90A1 (EC 1.14.-.-) with e-value of 7.8e-60 and BLAST sequence identity of 33.2
  misc_feature: SWISSPROT Homolog: C85A2_ARATH Cytochrome P450 85A2 (EC 1.14.-.-) (Brassinosteroid-6-oxidase 2) (BR6ox 2) (C6-oxidase 2) with e-value of 9.2e-57 and BLAST sequence identity of 31.9
  misc_feature: SWISSPROT Homolog: CP120_SYNY3 Putative cytochrome P450 120 (EC 1.14.-.-) with e-value of 2.4e-56 and BLAST sequence identity of 31.2
  misc_feature 426231:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(477): Functional Homolog of  Ceres CDNA ID no. 23545147 at SEQ ID NO. 3860 with e-value of 5.70E-166 and BLAST sequence identity of 64.1
MTIQICSLLSWALFCSTAMLLAIFLKHRKGCGKSDGKLPPGEMGLPWIGETIEFYRSQRDNQLFEEFVQPRITKYGKIFKTRLMGSPTIIVNGAEANRFFLSNEFKLVVSSWPTASVQLMGINSIMEKQGEKHRCLRGIIATSLGPAGLEILVPKICDSVQLYLDKNWNVREEISLYHSTKALTFTIVLECLLGLNFEPGTLNTFERVLEGVFAPPISFPGSKFSRAKKARREIKEMLIKVVREKRKKMESGLGGDEGMLFSQLVSGMIRGEISEEEVVDNVVLLVFAAHDTTSFAIAMTFKMLAEHPDCHSLLLQEHDDIMNKRRSGENLTMEDTKKMKYTWQVARESMRLFPPIFGSFRKAIADIEYEGFTIPKGWKVLWTTYGTHYNEEYFKDPLTFNPRRFEEPIPPYAYLPFGGGPRLCAGNQLAKLNILIFIHYVVTRYNWSLLCPGEQITMDPLPFPSHGMPIKVSLKSS

SEQ ID NO: 3816 - protein, 557 aa, Arabidopsis thaliana
  misc_feature (1)..(557): Ceres CDNA ID no. 23548978
  misc_feature (1)..(557): Also Known As Ceres GEMINI ID 5109A6
  misc_feature (174)..(528): Pfam Name: UCH Pfam Description: Ubiquitin carboxyl-terminal hydrolase
  misc_feature 426396:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
MSARISFLKNPDPCNHLSDYKLRYGTDGYKSFNNLFRCFNDARIKIKLQGIDIPRCSYCSVYQKRLYICLICRSISCSSHILLHTQLNKGHDIAIDVERSELYCCACIDQVYDSEFDEVVVSKQLFGLGMSVKSGADVVAVRSNKKRRLDSQLIIGSNFLVSPRDRREKWTFPLGLRGLNNLGSTCFMNAVLQALVHAPPLRNFWLSGQHNRDLCPRRTMGLLCLPCDLDVIFSAMFSGDRTPYSPAHLLYSWWQHSTNLATYEQQDSHEFFISLLDRIHENEGKSKCLYQDNEECQCITHKAFSGLLRSDVTCTTCGSTSTTYDPFIDISLTLDSMNGFSPADCRKNRYSGGPSVNAIMPTLSGCLDFFTRSEKLGPDQKLNCQSCGEKRESSKQMSIRRLPLLLCLHVKRFEHSLTRKTSRKIDSYLQYPFRLNMSPYLSSSIIGKRFGNRIFAFDGEGEYDSSSSSSPSAEFEIFAVVTHKGMLESGHYVTYLRLKGLWYRCDDAWINEVEEEVVRGCECYMLFYAQETVIQKAHKELSYQVISMADAFPFADC

SEQ ID NO: 3817 - DNA, 1668 bp, Populus balsamifera subsp. trichocarpa
  misc_feature (1)..(1668): Ceres ANNOT ID no. 1508925
  misc_feature 426527:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
atggaaacaaggagctctgtgtttgcaaacccaaaaccctgtaagcatcttacagattataagctgaggcatggcttgagtggatacaaattccttcaaaaatggctcaaaacctttccaaatggaaagacaagcattaaaatgtgtgaaacaaagatgcccaaatgcagtttttgtagtgggattcgtcaaggtagactgtttctgtgtttgatttgttcttcaatgtcttgttcagaccatacccttttgcatagtcaatctgagaatggccatgatatagctgttgacattgaaagatcagaactttattgttgttcttgtagtgatcaggtctatgaccttgattttgataaggtagttgtggctaaaaatattgtggatatgccaagtaagacacgtgatagtgttgttgatgatttaatgaggagatcaagcaagaggaggaggttgaattcagtggtggatttggatttgataaggtctaaattttttgtttggatgaggggtcgaagggcgaaatcgtgctatccattgggattaagaggattgaataatttgggcagtacttgtttcatgaattctattttgcaagctttgctccatgcaccaccgttcaggaattacttcttgagtgagagacacgaccgtgaaacttgtaggaaaagatcatcggatcaatcgtgtttggcttgtgatattggtgtaattttctcagctgtttattccggggatcggacaccttatagtccagctcagtttctttacagttggtggcagcattcggcaaatctagctagctacgagcagcaggatgctcatgaattcttcatttcagtgttagatggaatccatgagagagagggaaaggagagaaatccaaacaaagataatggagattgtcagtgtattgctcatagggttttctcaggtatgctaagatcagatctaacctgcacaacttgtgggtttacttccacaacttacgacccttgtgttgacatttcgctcaacatggacacaagcagcttttcttcagtggatgtggctaacaaatctgttaggccgaatgaggacaccggcagttctacccttttggcttgtttggatctgttcacaaggcctgagaggttggggtctgatcagaaactgtactgccaaaattgtcaagaaaagagggactcgttgaagcaaatgtctattaaaaggcttccactggtcttgtcattgcatatcaagcggtttgagcactcttccttgagaagaacatcaagaaaaattgattggcatttacagtttcctttttctctggatatgaccccatatttatctccatcaattgtcagaaacaggtttggaaatagaatttttgggtttgagagtgatgaagcggatatctctgcagaatttgagatttttgctgtagtcactcattctgggatgctagactcaggtcattacgtgacttatctgcgcctgcaaaaccaatggtacaagtgcgatgatgcttggattactgaagttgatgagaggattgtgagagcgtcacagtgttatatgattttctatgtgcagaggatgctttattacaaagcaaatgaggatttgagctgcacgccaatgccttcaaggagggacccgtttgttccgattgccggttgttgctga

SEQ ID NO: 3818 - protein, 555 aa, Populus balsamifera subsp. trichocarpa
  misc_feature (1)..(555): Ceres ANNOT ID no. 1508925
  misc_feature (179)..(523): Pfam Name: UCH Pfam Description: Ubiquitin carboxyl-terminal hydrolase
  misc_feature (56)..(128): Pfam Name: zf-UBP Pfam Description: Zn-finger in ubiquitin-hydrolases and other protein
  misc_feature: SWISSPROT Homolog: UBP51_HUMAN Ubiquitin carboxyl-terminal hydrolase 51 with e-value of 7.1e-82 and BLAST sequence identity of 35.6
  misc_feature: SWISSPROT Homolog: UBP51_HUMAN EC 3.1.2.15 (Ubiquitin thioesterase 51) Ubiquitin-specific-processing protease 51 Deubiquitinating enzyme 51
  misc_feature: SWISSPROT Homolog: UBP22_HUMAN Ubiquitin carboxyl-terminal hydrolase 22 with e-value of 1.1e-81 and BLAST sequence identity of 35.9
  misc_feature: SWISSPROT Homolog: UBP22_HUMAN EC 3.1.2.15 (Ubiquitin thioesterase 22) Ubiquitin-specific-processing protease 22 Deubiquitinating enzyme 22
  misc_feature: SWISSPROT Homolog: UBP22_MOUSE Ubiquitin carboxyl-terminal hydrolase 22 with e-value of 3.1e-81 and BLAST sequence identity of 35.6
  misc_feature: SWISSPROT Homolog: UBP22_MOUSE EC 3.1.2.15 (Ubiquitin thioesterase 22) Ubiquitin-specific-processing protease 22 Deubiquitinating enzyme 22
  misc_feature: SWISSPROT Homolog: UBP8_SCHPO Probable ubiquitin carboxyl-terminal hydrolase 8 with e-value of 7.5e-64 and BLAST sequence identity of 33.8
  misc_feature: SWISSPROT Homolog: UBP8_SCHPO EC 3.1.2.15 (Ubiquitin thioesterase 8) Ubiquitin-specific processing protease 8 Deubiquitinating enzyme 8
  misc_feature: SWISSPROT Homolog: UBP8_YEAST Ubiquitin carboxyl-terminal hydrolase 8 with e-value of 5.1e-40 and BLAST sequence identity of 32.8
  misc_feature: SWISSPROT Homolog: UBP8_YEAST EC 3.1.2.15 (Ubiquitin thioesterase 8) Ubiquitin-specific processing protease 8 Deubiquitinating enzyme 8
  misc_feature 426702:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (1)..(555): Functional Homolog of  Ceres CDNA ID no. 23548978 at SEQ ID NO. 3863 with e-value of 4.90E-176 and BLAST sequence identity of 59.9
METRSSVFANPKPCKHLTDYKLRHGLSGYKFLQKWLKTFPNGKTSIKMCETKMPKCSFCSGIRQGRLFLCLICSSMSCSDHTLLHSQSENGHDIAVDIERSELYCCSCSDQVYDLDFDKVVVAKNIVDMPSKTRDSVVDDLMRRSSKRRRLNSVVDLDLIRSKFFVWMRGRRAKSCYPLGLRGLNNLGSTCFMNSILQALLHAPPFRNYFLSERHDRETCRKRSSDQSCLACDIGVIFSAVYSGDRTPYSPAQFLYSWWQHSANLASYEQQDAHEFFISVLDGIHEREGKERNPNKDNGDCQCIAHRVFSGMLRSDLTCTTCGFTSTTYDPCVDISLNMDTSSFSSVDVANKSVRPNEDTGSSTLLACLDLFTRPERLGSDQKLYCQNCQEKRDSLKQMSIKRLPLVLSLHIKRFEHSSLRRTSRKIDWHLQFPFSLDMTPYLSPSIVRNRFGNRIFGFESDEADISAEFEIFAVVTHSGMLDSGHYVTYLRLQNQWYKCDDAWITEVDERIVRASQCYMIFYVQRMLYYKANEDLSCTPMPSRRDPFVPIAGCC

SEQ ID NO: 3819 - DNA, 1662 bp, Populus balsamifera subsp. trichocarpa
  misc_feature (1)..(1662): Ceres ANNOT ID no. 1531291
  misc_feature 426841:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
atggctacaaggaactctgtttttgcaaacccaaaaccctgtgaacatcttgcagattataaactgaggcatggcttgagtggatacaaatccattcaaaagtggctcaaagcaagtccatatggaaagacaagcattaaaatgtgtgaaacaaagatgcccacatgccgtttttgtagtgggtttcatcaaggtagactgtttctgtgtttgatttgttcttcaatgtcttgttcagaccacacccttttgcacgctcaatctgagaatggtcatgatatagctgttgatattgaaagatcggaactttattgttgtttatgtagtgatcaggtctatgatcctgattttgataaggttgtcgtgtctaaaaatattatggatatgccaagtaagacacatgatagtgttgttgatgatttgatgaggagatcaagcaagaggaggaggttgaatccagtggtggatttggatttgaaaaggtccaaacttctggtttcaatgatggatcgaagggcgaaatcgtgctatccgttgggattgagaggactgaacaatttggggagtacttgtttcatgaactctgtgttgcaggcattgctacatgcaccaccattcaggaattacttcttgagtgagagacacgaccccgaaacttgtaagaaaagatcatcagatcaattgtgtttggcttgtgattttggtgttattttctcagctgtgtactcaggggatcggactccttatagtccagctcagttcctttacagttggtggcagcattcagcaaatctagctagttacgagcagcaggatgctcatgaattcttcatttcagtgttagatggaatccatgagagagagggaaaggagaggagttcaaataaagataatggaggttgtcaatgtattgctcatagggttttctcagggatgttgagatctgatgtgacctgcacaacttgtggatttacttccacaacttatgacccttgtgttgatatttcgctcaacatggacacaaccaacttctctacagtgaatgtggctaacaagtctgttagagaggacacaggcagatctacccttttggcttgtttggatctgttcacaaggcctgagaggttggggtctgaccagaaactgtactgccaaaattgtcaagaaaagagggactcgttgaaacaaatgtctattaaaaggcttccattggtcttgtcgttacatatcaagcggttcgagcactcttccctgagaagatcgtcaagaaaaattgattggtacttgcagtttcctttttctttggacatgaccccatatttatcaccctcaattgtcagaaacaggtttggaaatagagtttttgggtttgagagtgacaaaccagatatctcttcagaattcgagatttttgctgttgtcactcattcagggatgctagactcaggtcattatgtcacttatctgcgcctacaaaaccaatggtacaagtgcgatgacgcgtggattactgaagttgatgagagaattgtgagagcagcacaatgctatatgattttctatgtgcagaagatgctttattgcaaagcaaatgaggattggagctgcatgccaatatccacaaggagggacccatttgttccaattgctggttgttgctaa

SEQ ID NO: 3820 - protein, 553 aa, Populus balsamifera subsp. trichocarpa
  misc_feature (1)..(553): Ceres ANNOT ID no. 1531291
  misc_feature (179)..(521): Pfam Name: UCH Pfam Description: Ubiquitin carboxyl-terminal hydrolase
  misc_feature (56)..(128): Pfam Name: zf-UBP Pfam Description: Zn-finger in ubiquitin-hydrolases and other protein
  misc_feature: SWISSPROT Homolog: UBP51_HUMAN Ubiquitin carboxyl-terminal hydrolase 51 with e-value of 7.1e-82 and BLAST sequence identity of 35.6
  misc_feature: SWISSPROT Homolog: UBP51_HUMAN EC 3.1.2.15 (Ubiquitin thioesterase 51) Ubiquitin-specific-processing protease 51 Deubiquitinating enzyme 51
  misc_feature: SWISSPROT Homolog: UBP22_HUMAN Ubiquitin carboxyl-terminal hydrolase 22 with e-value of 1.1e-81 and BLAST sequence identity of 35.9
  misc_feature: SWISSPROT Homolog: UBP22_HUMAN EC 3.1.2.15 (Ubiquitin thioesterase 22) Ubiquitin-specific-processing protease 22 Deubiquitinating enzyme 22
  misc_feature: SWISSPROT Homolog: UBP22_MOUSE Ubiquitin carboxyl-terminal hydrolase 22 with e-value of 3.1e-81 and BLAST sequence identity of 35.6
  misc_feature: SWISSPROT Homolog: UBP22_MOUSE EC 3.1.2.15 (Ubiquitin thioesterase 22) Ubiquitin-specific-processing protease 22 Deubiquitinating enzyme 22
  misc_feature: SWISSPROT Homolog: UBP8_SCHPO Probable ubiquitin carboxyl-terminal hydrolase 8 with e-value of 7.5e-64 and BLAST sequence identity of 33.8
  misc_feature: SWISSPROT Homolog: UBP8_SCHPO EC 3.1.2.15 (Ubiquitin thioesterase 8) Ubiquitin-specific processing protease 8 Deubiquitinating enzyme 8
  misc_feature: SWISSPROT Homolog: UBP8_YEAST Ubiquitin carboxyl-terminal hydrolase 8 with e-value of 5.1e-40 and BLAST sequence identity of 32.8
  misc_feature: SWISSPROT Homolog: UBP8_YEAST EC 3.1.2.15 (Ubiquitin thioesterase 8) Ubiquitin-specific processing protease 8 Deubiquitinating enzyme 8
  misc_feature 427016:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature (1)..(553): Functional Homolog of  Ceres CDNA ID no. 23548978 at SEQ ID NO. 3863 with e-value of 3.20E-172 and BLAST sequence identity of 60.4
MATRNSVFANPKPCEHLADYKLRHGLSGYKSIQKWLKASPYGKTSIKMCETKMPTCRFCSGFHQGRLFLCLICSSMSCSDHTLLHAQSENGHDIAVDIERSELYCCLCSDQVYDPDFDKVVVSKNIMDMPSKTHDSVVDDLMRRSSKRRRLNPVVDLDLKRSKLLVSMMDRRAKSCYPLGLRGLNNLGSTCFMNSVLQALLHAPPFRNYFLSERHDPETCKKRSSDQLCLACDFGVIFSAVYSGDRTPYSPAQFLYSWWQHSANLASYEQQDAHEFFISVLDGIHEREGKERSSNKDNGGCQCIAHRVFSGMLRSDVTCTTCGFTSTTYDPCVDISLNMDTTNFSTVNVANKSVREDTGRSTLLACLDLFTRPERLGSDQKLYCQNCQEKRDSLKQMSIKRLPLVLSLHIKRFEHSSLRRSSRKIDWYLQFPFSLDMTPYLSPSIVRNRFGNRVFGFESDKPDISSEFEIFAVVTHSGMLDSGHYVTYLRLQNQWYKCDDAWITEVDERIVRAAQCYMIFYVQKMLYCKANEDWSCMPISTRRDPFVPIAGCC

SEQ ID NO: 3821 - protein, 274 aa, Arabidopsis thaliana
  misc_feature (1)..(274): Ceres CDNA ID no. 23551244
  misc_feature (113)..(172): Pfam Name: WRKY Pfam Description: WRKY DNA -binding domain
  misc_feature: Phenotype: ROSETTE LEAVES - Curled 2 Useful for making ornamental plants with altered leaf shape
  misc_feature: Phenotype: ROSETTE LEAVES - Lanceolate Shaped Useful for making plants with increased biomass and foliage
MEEEGYQWARRCGNNAVEDPFVYEPPLFFLPQDQHHMHGLMPNEDFIANKFVTSTLYSGPRIQDIANALALVEPLTHPVREISKSTVPLLERSTLSKVDRYTLKVKNNSNGMCDDGYKWRKYGQKSIKNSPNPRSYYKCTNPICNAKKQVERSIDESNTYIITYEGFHFHYTYPFFLPDKTRQWPNKKTKIHKHNAQDMNKKSQTQEESKEAQLGELTNQNHPVNKAQENTPANLEEGLFFPVDQCRPQQGLLEDVVAPAMKNIPTRDSVLTAS

SEQ ID NO: 3822 - DNA, 915 bp, Populus balsamifera subsp. trichocarpa
  misc_feature (1)..(915): Ceres ANNOT ID no. 1454030
  misc_feature 427244:<222: Transcription Factor
  misc_feature: Phenotype: ROSETTE LEAVES - Curled 2 Useful for making ornamental plants with altered leaf shape
  misc_feature: Phenotype: ROSETTE LEAVES - Lanceolate Shaped Useful for making plants with increased biomass and foliage
atggaagaagtaataaagagtagtacatggtttgatcatgagagtgaagatgagcttgttagagagcttcttgatgatgaatctcctttctttttcttgccaaaggagaaaaaccaatccaaaccaagtcctacgaatgaacaaactattaaccagctcacatccaaagtctattcaggcccaacaatccaagatattgagaatgctttatcgacgtcaagcagagaagaccaatcccaagcagtttcacaagccagaatttcattgttgcaaaagggtttgagtaagatggagaacaacaagtacactctaaaactgaagagatgtggcgatgggatggctgatgatggttataaatggaggaaatatgggcaaaaatctatcaagaacagcccacatcctagaagctattataggtgcacgaacgcacggtgcagtgcaaaaaagcaggtggagaggtgcagcgaggatccagacacgctcgtcatcacttacgaaggactccatttacactttacatacccttacttcttatcgaaccagccacagcatgatgatccaccttccaagaagcctaaaggaaccatttcagaagccgagttccaagcccatgcaacccaacgaacaccagaacaagcccaagagtactcggcacatgtcaccagccctggttccctgcctagcaccagcacagctgatgattacgtgcatgaatcgggtttggaagcaataggtcctcaagggttgcttgaagatgtggtgccttatatggttcggaatccatcaaactacaacgtgtcttcaaattcctcatcttcatcttaccgttctccgcctgcctcaccaccttcctccctgtcttggtctccttcccattcatttttcgatattgccttggatactagcatcgcatga

SEQ ID NO: 3823 - protein, 304 aa, Populus balsamifera subsp. trichocarpa
  misc_feature (1)..(304): Ceres ANNOT ID no. 1454030
  misc_feature (114)..(173): Pfam Name: WRKY Pfam Description: WRKY DNA -binding domain
  misc_feature: SWISSPROT Homolog: WRK49_ARATH Probable WRKY transcription factor 49 (WRKY DNA-binding protein 49) with e-value of 2.4e-152 and BLAST sequence identity of 100.0
  misc_feature: SWISSPROT Homolog: WRK57_ARATH Probable WRKY transcription factor 57 (WRKY DNA-binding protein 57) with e-value of 2.3e-21 and BLAST sequence identity of 34.6
  misc_feature: SWISSPROT Homolog: WRK58_ARATH Probable WRKY transcription factor 58 (WRKY DNA-binding protein 58) with e-value of 1.5e-18 and BLAST sequence identity of 57.6
  misc_feature: SWISSPROT Homolog: WRK43_ARATH Probable WRKY transcription factor 43 (WRKY DNA-binding protein 43) with e-value of 2.7e-18 and BLAST sequence identity of 50.6
  misc_feature: SWISSPROT Homolog: WRK32_ARATH Probable WRKY transcription factor 32 (WRKY DNA-binding protein 32) with e-value of 4.3e-18 and BLAST sequence identity of 37.3
  misc_feature 427354:<222: Transcription Factor
  misc_feature: Phenotype: ROSETTE LEAVES - Curled 2 Useful for making ornamental plants with altered leaf shape
  misc_feature: Phenotype: ROSETTE LEAVES - Lanceolate Shaped Useful for making plants with increased biomass and foliage
  misc_feature (1)..(304): Functional Homolog of  Ceres CDNA ID no. 23551244 at SEQ ID NO. 3868 with e-value of 7.70E-43 and BLAST sequence identity of 45.0
MEEVIKSSTWFDHESEDELVRELLDDESPFFFLPKEKNQSKPSPTNEQTINQLTSKVYSGPTIQDIENALSTSSREDQSQAVSQARISLLQKGLSKMENNKYTLKLKRCGDGMADDGYKWRKYGQKSIKNSPHPRSYYRCTNARCSAKKQVERCSEDPDTLVITYEGLHLHFTYPYFLSNQPQHDDPPSKKPKGTISEAEFQAHATQRTPEQAQEYSAHVTSPGSLPSTSTADDYVHESGLEAIGPQGLLEDVVPYMVRNPSNYNVSSNSSSSSYRSPPASPPSSLSWSPSHSFFDIALDTSIA

SEQ ID NO: 3824 - DNA, 930 bp, Populus balsamifera subsp. trichocarpa
  misc_feature (1)..(930): Ceres ANNOT ID no. 1475651
  misc_feature 427454:<222: Transcription Factor
  misc_feature: Phenotype: ROSETTE LEAVES - Curled 2 Useful for making ornamental plants with altered leaf shape
  misc_feature: Phenotype: ROSETTE LEAVES - Lanceolate Shaped Useful for making plants with increased biomass and foliage
atggaaggagaagtaatcagtagtagttggtttagtgagagtgaagaagatgagcttgtgagagagctccttgatgatgtatcccctttctttttcttgccagaggaaagaaaccaatccaaagcagcaagtcccactccaaggaatgaagaagctatgaaccagctcatttccaaagtgtattcagggccaacaaagcaagatattgagaatgctttgtcgatgacaagccgaagagaccaaccccaaccagtttcacaagccagattctcattgttgcaaaagggtttgagtaagattgagaacaacaagtacactgtaaaactgaagagctgtgacaatggtgtggctggtgatggttataaatggaggaaatacgggcagaagtctatcaagaatagcacacatcccagaagctactacaggtgcacgaaccgacggtgcggtgcaaaaaagcaggtggagaggtccagcgaggatccagacacgctcgtcatcacctacgaagggctccatttacacttttctcacccatatttcttatcgaaccagccacaacatgttgatccgccttccaagaaacctaagaggaccatttcagaggacgagtttcaagcccatgaaacccgacaaccaccagaacaaggccaagaatgctccacacatgtgaccagtcctggttccctgcctagctcaagcacagctgatgattacatgcaagaatcggacctggaagcgatgggtcctcgagggttgcttgaagatgtggtgccttttatgattcgaaacccatcgaactacaatgtgtcttcttattcttcatcttcgtcctatcgttctccccctacttcaccatcttcctccttgtcttggtctcccattctttcccattcgtgtttcgatgttggcttaaacactagcattgggtga

SEQ ID NO: 3825 - protein, 309 aa, Populus balsamifera subsp. trichocarpa
  misc_feature (1)..(309): Ceres ANNOT ID no. 1475651
  misc_feature (117)..(176): Pfam Name: WRKY Pfam Description: WRKY DNA -binding domain
  misc_feature: SWISSPROT Homolog: WRK49_ARATH Probable WRKY transcription factor 49 (WRKY DNA-binding protein 49) with e-value of 2.4e-152 and BLAST sequence identity of 100.0
  misc_feature: SWISSPROT Homolog: WRK57_ARATH Probable WRKY transcription factor 57 (WRKY DNA-binding protein 57) with e-value of 2.3e-21 and BLAST sequence identity of 34.6
  misc_feature: SWISSPROT Homolog: WRK58_ARATH Probable WRKY transcription factor 58 (WRKY DNA-binding protein 58) with e-value of 1.5e-18 and BLAST sequence identity of 57.6
  misc_feature: SWISSPROT Homolog: WRK43_ARATH Probable WRKY transcription factor 43 (WRKY DNA-binding protein 43) with e-value of 2.7e-18 and BLAST sequence identity of 50.6
  misc_feature: SWISSPROT Homolog: WRK32_ARATH Probable WRKY transcription factor 32 (WRKY DNA-binding protein 32) with e-value of 4.3e-18 and BLAST sequence identity of 37.3
  misc_feature 427564:<222: Transcription Factor
  misc_feature: Phenotype: ROSETTE LEAVES - Curled 2 Useful for making ornamental plants with altered leaf shape
  misc_feature: Phenotype: ROSETTE LEAVES - Lanceolate Shaped Useful for making plants with increased biomass and foliage
  misc_feature (1)..(309): Functional Homolog of  Ceres CDNA ID no. 23551244 at SEQ ID NO. 3868 with e-value of 5.60E-40 and BLAST sequence identity of 42.6
MEGEVISSSWFSESEEDELVRELLDDVSPFFFLPEERNQSKAASPTPRNEEAMNQLISKVYSGPTKQDIENALSMTSRRDQPQPVSQARFSLLQKGLSKIENNKYTVKLKSCDNGVAGDGYKWRKYGQKSIKNSTHPRSYYRCTNRRCGAKKQVERSSEDPDTLVITYEGLHLHFSHPYFLSNQPQHVDPPSKKPKRTISEDEFQAHETRQPPEQGQECSTHVTSPGSLPSSSTADDYMQESDLEAMGPRGLLEDVVPFMIRNPSNYNVSSYSSSSSYRSPPTSPSSSLSWSPILSHSCFDVGLNTSIG

SEQ ID NO: 3826 - protein, 125 aa, Arabidopsis thaliana
  misc_feature (1)..(125): Ceres CDNA ID no. 23553534
  misc_feature (1)..(125): Also Known As Ceres GEMINI ID 5109E2
  misc_feature (41)..(120): Pfam Name: ParBc Pfam Description: ParB-like nuclease domain
  misc_feature 427678:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
MANLMMRLPISLRSFSVSASSSNGSPPVIGGSSGGVGPMIVELPLEKIRRPLMRTRSNDQNKVKELMDSIRQIGLQVPIDVIEVDGTYYGFSGCHRYEAHQKLGLPTIRCKIRKGTKETLRHHLR

SEQ ID NO: 3827 - DNA, 378 bp, Populus balsamifera subsp. trichocarpa
  misc_feature (1)..(378): Ceres ANNOT ID no. 1469045
  misc_feature 427728:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atggcaaattttgttttgagactgccagcaaccagtttcaggggcttctctatttcagcttcatcaaatggggctgttccagggacaagtactagagcacaaaatggagggccagtgatcttagagctgcctcttgataagataaggaggcctttgatgagaaccagagctaatgatccaaataaggtgaaagaactcatggatagcatcaaagaaattggtcttcaagtacctattgatgtgcttgaggtcgatggagtttactatggattctcgggttgccatcgttatgaagctcaccagcgccttgggctccccacaattcgttgcaaaattcgacgcggaacaaaagaaactctaaggcatcacctccgctga

SEQ ID NO: 3828 - protein, 125 aa, Populus balsamifera subsp. trichocarpa
  misc_feature (1)..(125): Ceres ANNOT ID no. 1469045
  misc_feature (41)..(120): Pfam Name: ParBc Pfam Description: ParB-like nuclease domain
  misc_feature: SWISSPROT Homolog: SRX_DROME Putative sulfiredoxin (EC 1.8.98.2) with e-value of 8.1e-10 and BLAST sequence identity of 34.4
  misc_feature: SWISSPROT Homolog: SRXN1_HUMAN Sulfiredoxin-1 (EC 1.8.98.2) with e-value of 2.1e-09 and BLAST sequence identity of 38.8
  misc_feature: SWISSPROT Homolog: SRX1_SCHPO Putative sulfiredoxin (EC 1.8.98.2) with e-value of 5.4e-09 and BLAST sequence identity of 39.2
  misc_feature: SWISSPROT Homolog: SRXN1_MOUSE Sulfiredoxin-1 (EC 1.8.98.2) (Neoplastic progression protein 3) with e-value of 5.7e-09 and BLAST sequence identity of 34.4
  misc_feature: SWISSPROT Homolog: SRX1_YEAST Sulfiredoxin (EC 1.8.98.2) (Sulphiredoxin) with e-value of 7.6e-06 and BLAST sequence identity of 30.0
  misc_feature 427814:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(125): Functional Homolog of  Ceres CDNA ID no. 23553534 at SEQ ID NO. 3873 with e-value of 3.49E-47 and BLAST sequence identity of 76.6
MANFVLRLPATSFRGFSISASSNGAVPGTSTRAQNGGPVILELPLDKIRRPLMRTRANDPNKVKELMDSIKEIGLQVPIDVLEVDGVYYGFSGCHRYEAHQRLGLPTIRCKIRRGTKETLRHHLR

SEQ ID NO: 3829 - protein, 325 aa, Arabidopsis thaliana
  misc_feature (1)..(325): Ceres CDNA ID no. 23555942
  misc_feature (1)..(267): Pfam Name: Str_synth Pfam Description: Strictosidine synthase
  misc_feature: Utility: Mannitol Useful for making plants with enhanced tolerance to drought
  misc_feature: Utility: PEG Useful for making plants with increased tolerance to drought
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
MASFVFVISLLLLSFSSAVFSDDASFQKLPVPDKRSGPESFAFDSTGGFYTGVSGGKILKYVPGKGYVDFAQITDSSNSAWCNGALGTAFAGKCGRPAGIALNSKTGDLYVADAPLGLHVISPAGGLATKLADSVDGKPFKFLDGLDVDPTTGVVYFTSFSSKFGPREVLIAVGLKDASGKLFKYDPATKAVTELMEGLSGAAGCAVSSDGSFVLVSEFIKSNIKKYWIKGPKAGTIEDFSSLVSNPDNIRRVGSTGNFWVASVVNKVVMPTDPRAVKLDANGKVLQTIFLKNEFGNTLLSEVNEFNGHLYIGTLTGPFAGVMKL

SEQ ID NO: 3830 - DNA, 1008 bp, Populus balsamifera subsp. trichocarpa
  misc_feature (1)..(1008): Ceres ANNOT ID no. 1473401
  misc_feature 427982:<222: Transcription Factor
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
atggctctcctccgcccaagcactaaagcagctatggtatcgatactgtccatttttgtcttctgttttccttctactgttctctctgaatccttcaggcaaatcttcttgccacccacaggcttcggccctgaatcccttgcctttgaatctcccggtggagccttctatactggtgttaatgacggtcgtgttcttagataccaaccacctactggcagctggacatcctttgccattacctcaccaaaccggacgatagcactttgcgatggcaccaccgatcccgataaaggacctatctgcggaaggcctttgggtttggcgtatagtccttccacaaaattgctctacatagccgatgcatattatggactctttgttgctgactcaaatgggagacttgctaaacaaattgccaccagtgctgaaggacaacgttttgtcgcttgcaatgctttggatatagaccctatcacaggaaacatctattttacagatgctagtgctgtctatgatctaaggaattcctcgaaagctcttcttgccaatgactcaacaggaaggttaatgaaatatgacgtgaggaaaaatcaagtcaccgtgttattgagaaatctttcggtggcagtgggggttgcagtcagtaaagatggcgggtttgtcctcgtctcggagttcgttggcaataggattcgacgatattggctcacaggacgggatgccgggacttcagatatattcctaagcaaccttaacattgtgaggccaaacaacatcaagagaactagtttgggcgattttcggatagcagctgcaactgttagacaagattcacaaacactggtgcccataagagtcagagtcgacgagcatggtagaatctcggagactgtgtctcttgaggcacagtatggaagtactcccatcagcgaagttcaacagtctggtctctcgttatatgttagctcaaggggtgtgaatttcgttggtgtttatactccttaa

SEQ ID NO: 3831 - protein, 335 aa, Populus balsamifera subsp. trichocarpa
  misc_feature (1)..(335): Ceres ANNOT ID no. 1473401
  misc_feature (287)..(330): Pfam Name: Str_synth Pfam Description: Strictosidine synthase
  misc_feature: SWISSPROT Homolog: STS1_ARATH Strictosidine synthase 1 precursor (EC 4.3.3.2) (SS-1) with e-value of 3.1e-143 and BLAST sequence identity of 81.0
  misc_feature: SWISSPROT Homolog: STS3_ARATH Strictosidine synthase 3 precursor (EC 4.3.3.2) (SS-3) with e-value of 2.8e-126 and BLAST sequence identity of 74.7
  misc_feature: SWISSPROT Homolog: STSY_RAUMA Strictosidine synthase precursor (EC 4.3.3.2) (Fragment) with e-value of 1.2e-54 and BLAST sequence identity of 39.5
  misc_feature: SWISSPROT Homolog: STSY_RAUSE Strictosidine synthase precursor (EC 4.3.3.2) with e-value of 1.2e-54 and BLAST sequence identity of 39.5
  misc_feature: SWISSPROT Homolog: STSY_CATRO Strictosidine synthase precursor (EC 4.3.3.2) with e-value of 1.2e-52 and BLAST sequence identity of 38.9
  misc_feature 428094:<222: Transcription Factor
  misc_feature: Phenotype: WHOLE PLANT - Mannitol Useful for making plants with enhanced tolerance to drought
  misc_feature: Phenotype: WHOLE PLANT - PEG Useful for making plants with increased tolerance to drought
  misc_feature (1)..(335): Functional Homolog of  Ceres CDNA ID no. 23555942 at SEQ ID NO. 3876 with e-value of 5.80E-54 and BLAST sequence identity of 40.2
MALLRPSTKAAMVSILSIFVFCFPSTVLSESFRQIFLPPTGFGPESLAFESPGGAFYTGVNDGRVLRYQPPTGSWTSFAITSPNRTIALCDGTTDPDKGPICGRPLGLAYSPSTKLLYIADAYYGLFVADSNGRLAKQIATSAEGQRFVACNALDIDPITGNIYFTDASAVYDLRNSSKALLANDSTGRLMKYDVRKNQVTVLLRNLSVAVGVAVSKDGGFVLVSEFVGNRIRRYWLTGRDAGTSDIFLSNLNIVRPNNIKRTSLGDFRIAAATVRQDSQTLVPIRVRVDEHGRISETVSLEAQYGSTPISEVQQSGLSLYVSSRGVNFVGVYTP

SEQ ID NO: 3832 - protein, 391 aa, Arabidopsis thaliana
  misc_feature (1)..(391): Ceres CDNA ID no. 23557940
  misc_feature (1)..(391): Also Known As Ceres GEMINI ID 5111B1
  misc_feature (243)..(291): Pfam Name: bZIP_1 Pfam Description: bZIP transcription factor
  misc_feature 428211:<222: Transcription Factor
  misc_feature: Phenotype: Activates expression of the gene endogenous to the AtHMGS (SEQ ID NO 4144) regalutory region Useful for modulating Terpenoid Biosynthesis
MASSKGSQSVRNLMYPGKHALLPPKIPFPSVSASYSEYIPTGLIGSRHGQKLSNEKTHHQRTSSESHLVEELPFWLDDLLNEQPESPARKCGHRRSSSDSYAYLDVANATNISLTLQNDFSYRNTVLSTQRGVQELDRNKNAQDAAFYSGASFLKQKSRQRDSLVATGACPSWLPFARENGGGKNLGALYMSQDATVISSERKNYAEPFSHDPKMLSSEENNSNPSPVTYEADNTKRAKQQFAQRSRVRKLQYISELERNVQTLQAEGSKVSAELDFLNQRNLILSMENKALKKRLESIAQEKLIKQYSTVLKIVYLMSSVYYPVEQEVLEKEIGRLRALYQQQQQTQKPSASRGRATSKDLDSQFSSLSLNTKDSNCRRDSVSVMGQFHF

SEQ ID NO: 3833 - DNA, 1146 bp, Populus balsamifera subsp. trichocarpa
  misc_feature (1)..(1146): Ceres ANNOT ID no. 1446018
  misc_feature 428311:<222: Transcription Factor
  misc_feature: Phenotype: Activates expression of the gene endogenous to the AtHMGS (SEQ ID NO 4144) regalutory region Useful for modulating Terpenoid Biosynthesis
atggcaaattccaaggggtcagcgaacataagaaatttgatgtactcagggaaacatccattacttcctccaaaaagtccttttcctagtgtttcgccatcttacattgatcatgttcccagcaatagttttggatcaaaaactgctcaaaagcctagagagggaaacacacatcatcagcgaacttcttctgagactctcttcatagaggagcagccttcgtggcttgatgatcttcttaatgagccagagacacctgttcgtagaggaggtcataggcgttcatcaagtgactcctttgcgtacatagatgtagctaatgcttctaacatagattatgcagagcaggatgactacatatataaaaatgtgatgtccataccttcttggagatctcatgactttgatcatcaccaagatgtcaggcaagcttctctctattctgaaatgaacttgacaaaacagaagaatagggtttgggattcatctttaaatgcccctacctttccaagtagtctttcctctgtcagggagaatgctggtatgcggagttcaggatcatcatgtgccccacgggaagcagattgtgtttcggagagtgaaaagcaagatccactcgatggtccacatgatccaaaaatttcattagaaaaaaaggacagttcaaattccaaatcttctgcatcagatactgatacaaaacgtgctaaacagcagtttgcccagcgctccagggtccgtaaacttcagtacatagctgagctggaaagaaatgtacaagctttgcaggcaagtatctctatctctgcagaagctgcctgtgaggcagaaggatcagaagtttcagctgagctcgaatttgtcaatcagcaaaatcttattctaagcatggagaataaagctcttaagcaacggttagaaaatttggcccaggagcagcttatcaaatacttggagcatgaagttctggagagggagattggaaggctacgtgccttgtatcagcagcagcagcagcagccacagcaaatgaaaccttctagccatcgccgtagtaacagcagggacctggactcccaatttgcaaacctctctatgaatgccaattctagccgagaccctgtgactggttcactccgcatttag

SEQ ID NO: 3834 - protein, 381 aa, Populus balsamifera subsp. trichocarpa
  misc_feature (1)..(381): Ceres ANNOT ID no. 1446018
  misc_feature (241)..(264): Pfam Name: bZIP_1 Pfam Description: bZIP transcription factor
  misc_feature: SWISSPROT Homolog: RF2A_ORYSA Transcription factor RF2a with e-value of 1.1e-08 and BLAST sequence identity of 28.2
  misc_feature: SWISSPROT Homolog: POF21_ARATH Probable transcription factor PosF21 (AtbZIP59) with e-value of 4.7e-07 and BLAST sequence identity of 24.9
  misc_feature: SWISSPROT Homolog: RF2B_ORYSA Transcription factor RF2b with e-value of 6.8e-07 and BLAST sequence identity of 44.9
  misc_feature: SWISSPROT Homolog: OCS1_MAIZE Ocs element-binding factor 1 (OCSBF-1) with e-value of 2.5e-06 and BLAST sequence identity of 27.5
  misc_feature 428412:<222: Transcription Factor
  misc_feature: Phenotype: Activates expression of the gene endogenous to the AtHMGS (SEQ ID NO 4144) regalutory region Useful for modulating Terpenoid Biosynthesis
  misc_feature (1)..(381): Functional Homolog of  Ceres CDNA ID no. 23557940 at SEQ ID NO. 3879 with e-value of 2.30E-91 and BLAST sequence identity of 57.6
MANSKGSANIRNLMYSGKHPLLPPKSPFPSVSPSYIDHVPSNSFGSKTAQKPREGNTHHQRTSSETLFIEEQPSWLDDLLNEPETPVRRGGHRRSSSDSFAYIDVANASNIDYAEQDDYIYKNVMSIPSWRSHDFDHHQDVRQASLYSEMNLTKQKNRVWDSSLNAPTFPSSLSSVRENAGMRSSGSSCAPREADCVSESEKQDPLDGPHDPKISLEKKDSSNSKSSASDTDTKRAKQQFAQRSRVRKLQYIAELERNVQALQASISISAEAACEAEGSEVSAELEFVNQQNLILSMENKALKQRLENLAQEQLIKYLEHEVLEREIGRLRALYQQQQQQPQQMKPSSHRRSNSRDLDSQFANLSMNANSSRDPVTGSLRI

SEQ ID NO: 3835 - protein, 383 aa, Arabidopsis thaliana
  misc_feature (1)..(383): Ceres CDNA ID no. 23640482
  misc_feature (1)..(383): Also Known As Ceres GEMINI ID 5110E11
  misc_feature 428525:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
MSSPERALLNLLTDIALSFDGAILGLTLAVSAVGSALKYASTNAALKKIKDAPEVSISDLRSLLPASEDKSETNDNRKSNDQRIVVVRGVVKPKISGDEGYKNNNVLISPETGDKALIIQRTQTYVYSGWKRLFQSTGHRFMLERSLRKHGADFTRTVPFVIVGKDQQSNSSFVAVNMDGSRQPLPLTTVYNRLQPINSSFLQAFLYPDYPVGLLDIEKILPPGKDITAVGIYSFNNGVPEIKSCQDLPYFLSEMTKDKMIEDLMEQTNFIFLGSVILGIVSVGILSYAAVRTWNKWKQWNHQRELPQRPNDSVVDDEPEDADEIPDGELCVICVSRRRVPAFIPCGHVVCCRRCASTVERELNPKCPVCLQSIRGSMRVYYS

SEQ ID NO: 3836 - DNA, 1176 bp, Populus balsamifera subsp. trichocarpa
  misc_feature (1)..(1176): Ceres ANNOT ID no. 1446359
  misc_feature 428630:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
atggcatcacgtgcccatgagcaagcactggccgccatgctatcccatcttgctctctccttcgacggagcaattcttggcgcggctcttgcctacgccgctgtacgttcatttctcaattttacagcaaactctaaatcccttgccaaaatccgcaaggcacccactctctccgtctccgacctccgctctctccttcaaaatcatgatcaagaccatcaggaccaggagcagaagctcgtgattgtcagaggacaagtagaggctaaatcagccgttgatgggtccgggaagaagagctcgagggactctaatgttttgctttctcatgagtctggtgacaaggctgttattctacaaagaactcaaacttgtatatacaacgaatggaagggcttttttggatggacttccgacttacgatctatctttggaagatctttgaaagaacaagaaacaacctttttaagaacggttccttttacgcttgttgaaggtggtcaatggccacaatctgattatgttatcgtgaacatggatggatcaagtcaccccctacctcttacgatggtttatcatcagttgcaacccattgttgcttctcgttatacattcattcaggcgctttttggtcatgaataccctgttggggtgcttcatgaggagaaaatccttccattagggaagtgtatcagtgctgttggcatatgcaattctaaagatggaattccagagataaaatcttgcaaagaacttccctattttctggctgacatgaccaaagatgaaatggtggcagatcttgccttcaaggcgaaaatactgctatggagtggtattgttcttggttcactttctattggagtccttggctttgctgtcatgaggaactggaataaatggaaagcgtggaggcaaagacgctctcagcagccaatccacactaccagtgatgaagatgtctctcaaattgatgacaacgaggatgctggagatgtgcctgaggggcagttgtgtgtgatctgcttgatgaggagaagacgggctgccttcattccctgtgggcatcttgcatgttgtcatacctgtgccgtatcagttgaaagtgaggtatcacccaaatgccctctctgtaggcaggcagttcgaaattctatcaggatttttgaatgttga

SEQ ID NO: 3837 - protein, 391 aa, Populus balsamifera subsp. trichocarpa
  misc_feature (1)..(391): Ceres ANNOT ID no. 1446359
  misc_feature (339)..(378): Pfam Name: zf-C3HC4 Pfam Description: Zinc finger, C3HC4 type (RING finger)
  misc_feature: SWISSPROT Homolog: IAP_GVCP Apoptosis inhibitor IAP with e-value of 1.8e-07 and BLAST sequence identity of 32.9
  misc_feature: SWISSPROT Homolog: IAP1_DROME Apoptosis 1 inhibitor (Inhibitor of apoptosis 1) (dIAP1) (Protein thread) with e-value of 4.9e-07 and BLAST sequence identity of 47.5
  misc_feature: SWISSPROT Homolog: BIRC8_PANTR Baculoviral IAP repeat-containing protein 8 with e-value of 5.1e-07 and BLAST sequence identity of 40.9
  misc_feature: SWISSPROT Homolog: BIRC8_PANTR Inhibitor of apoptosis-like protein 2 IAP-like protein 2 ILP-2
  misc_feature: SWISSPROT Homolog: LRSM1_MOUSE Ubiquitin ligase protein LRSAM1 with e-value of 6.4e-07 and BLAST sequence identity of 33.8
  misc_feature: SWISSPROT Homolog: LRSM1_MOUSE EC 6.3.2.- Leucine-rich repeat and sterile alpha motif-containing protein 1 Tsg101-associated ligase
  misc_feature: SWISSPROT Homolog: BIRC8_GORGO Baculoviral IAP repeat-containing protein 8 (Inhibitor of apoptosis-like protein 2) (IAP-like protein 2) with e-value of 1.1e-06 and BLAST sequence identity of 39.4
  misc_feature 428764:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(391): Functional Homolog of  Ceres CDNA ID no. 23640482 at SEQ ID NO. 3882 with e-value of 1.09E-93 and BLAST sequence identity of 50.9
MASRAHEQALAAMLSHLALSFDGAILGAALAYAAVRSFLNFTANSKSLAKIRKAPTLSVSDLRSLLQNHDQDHQDQEQKLVIVRGQVEAKSAVDGSGKKSSRDSNVLLSHESGDKAVILQRTQTCIYNEWKGFFGWTSDLRSIFGRSLKEQETTFLRTVPFTLVEGGQWPQSDYVIVNMDGSSHPLPLTMVYHQLQPIVASRYTFIQALFGHEYPVGVLHEEKILPLGKCISAVGICNSKDGIPEIKSCKELPYFLADMTKDEMVADLAFKAKILLWSGIVLGSLSIGVLGFAVMRNWNKWKAWRQRRSQQPIHTTSDEDVSQIDDNEDAGDVPEGQLCVICLMRRRRAAFIPCGHLACCHTCAVSVESEVSPKCPLCRQAVRNSIRIFEC

SEQ ID NO: 3838 - DNA, 1173 bp, Populus balsamifera subsp. trichocarpa
  misc_feature (1)..(1173): Ceres ANNOT ID no. 1438865
  misc_feature 428880:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
atgtcatcacgttcccatgagcaagcactggccgccctgctatcccaacttgctctctccttcgacggagcaattctcggggcagctcttgcctacgccgccgtacgttcaattctcaattacactgcaaattccaaatcccttgccaaaatcagcaaggcacccactctctccgtctccgacctccgatcgctccttcaaaatcacgatcaagaccaccaggaccatgagcataacctcgtaattgtcaaaggaatcgttgaggctaaatcagccgttgaatggacatggaaggagagctttagaccccctaaggtcttgctttctcataattctgcttataaggcggttattcttcaaaaaactcaaacttgtatatacaacgaatggaagggctttttaggatggacttccgagttgcgggctatctttggcagatctttgaaagaacaagaaacaaccttattaagaacggttccttttatactagttgaaggtgctcaatggccacggtctgattatgttatcgtgaacatggtcggatcagcacaccccctacctcttacaactgtttatcatcagttgcaacgcattgctgcttctcgttatacattcattcaggcactttttggtcatgaataccctgttggggtgcttcacgaggagaaaatcctgccattagggaagtgtatcagtgctgttggcatttgcaattctaaaaaaggaattcctgagataaaatcttgcaaggatcttccctattttctggctgacattaccaaagatcaaatggtggcagatcttgccttcaaggcgaaaatacagctatggagtggtatttttcttggttcactttcaattggggtccttggcttcgctgttatgaggaactggaataaatggcaagcgtggaggcaaagacactctcacctgccgaaccatactaccattgatgcagatgtctctcggattgatgaagatgaagcaggagatgtgccagatggacagttgtgtgtgatctgcttaacgaggagaaggcgatctgcattcattccctgtgggcatcttgcatgctgtcatttctgtgctatatcagttgaaagtgaggtatcccccaaatgccctctctgtaggcaggcaatccgaaattctatcagggtttttgaatgttga

SEQ ID NO: 3839 - protein, 390 aa, Populus balsamifera subsp. trichocarpa
  misc_feature (1)..(390): Ceres ANNOT ID no. 1438865
  misc_feature (338)..(377): Pfam Name: zf-C3HC4 Pfam Description: Zinc finger, C3HC4 type (RING finger)
  misc_feature: SWISSPROT Homolog: IAP_GVCP Apoptosis inhibitor IAP with e-value of 1.8e-07 and BLAST sequence identity of 32.9
  misc_feature: SWISSPROT Homolog: IAP1_DROME Apoptosis 1 inhibitor (Inhibitor of apoptosis 1) (dIAP1) (Protein thread) with e-value of 4.9e-07 and BLAST sequence identity of 47.5
  misc_feature: SWISSPROT Homolog: BIRC8_PANTR Baculoviral IAP repeat-containing protein 8 with e-value of 5.1e-07 and BLAST sequence identity of 40.9
  misc_feature: SWISSPROT Homolog: BIRC8_PANTR Inhibitor of apoptosis-like protein 2 IAP-like protein 2 ILP-2
  misc_feature: SWISSPROT Homolog: LRSM1_MOUSE Ubiquitin ligase protein LRSAM1 with e-value of 6.4e-07 and BLAST sequence identity of 33.8
  misc_feature: SWISSPROT Homolog: LRSM1_MOUSE EC 6.3.2.- Leucine-rich repeat and sterile alpha motif-containing protein 1 Tsg101-associated ligase
  misc_feature: SWISSPROT Homolog: BIRC8_GORGO Baculoviral IAP repeat-containing protein 8 (Inhibitor of apoptosis-like protein 2) (IAP-like protein 2) with e-value of 1.1e-06 and BLAST sequence identity of 39.4
  misc_feature 429014:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(390): Functional Homolog of  Ceres CDNA ID no. 23640482 at SEQ ID NO. 3882 with e-value of 1.30E-86 and BLAST sequence identity of 48.7
MSSRSHEQALAALLSQLALSFDGAILGAALAYAAVRSILNYTANSKSLAKISKAPTLSVSDLRSLLQNHDQDHQDHEHNLVIVKGIVEAKSAVEWTWKESFRPPKVLLSHNSAYKAVILQKTQTCIYNEWKGFLGWTSELRAIFGRSLKEQETTLLRTVPFILVEGAQWPRSDYVIVNMVGSAHPLPLTTVYHQLQRIAASRYTFIQALFGHEYPVGVLHEEKILPLGKCISAVGICNSKKGIPEIKSCKDLPYFLADITKDQMVADLAFKAKIQLWSGIFLGSLSIGVLGFAVMRNWNKWQAWRQRHSHLPNHTTIDADVSRIDEDEAGDVPDGQLCVICLTRRRRSAFIPCGHLACCHFCAISVESEVSPKCPLCRQAIRNSIRVFEC

SEQ ID NO: 3840 - protein, 767 aa, Arabidopsis thaliana
  misc_feature (1)..(767): Ceres CDNA ID no. 23651543
  misc_feature (1)..(767): Also Known As Ceres GEMINI ID 5109B7
  misc_feature (578)..(650): Pfam Name: S1 Pfam Description: S1 RNA binding domain
  misc_feature 429144:<222: Transcription Factor
  misc_feature: Phenotype: Activates expression of the gene endogenous to the AtDXPR (SEQ ID NO 4143) regalutory region Useful for modulating Terpenoid Biosynthesis
MDVLALSSSASAAAPSASLAGKFLSFPSRVRVRRNRENLLAKQKKFLVSASKREEPKLNEWDQMELNFGRLLGEDPKLTLAKIVARKVDPEASFIDIEKSFYKNKGKIPEVEEIPLDWSKDNKKKSTSSLDGLKLVKPVLKDGVKFERPVMKKPSPVLKKPLVEAVAAPKVQRLPNVILRKPSSFYTSNGDDEESKLRLKPNLTLKMRNERENERFSDMTLLRKPEPVSVVAEEEDKPLSDDLTMEEGEQEGGTYSQYTLLEKPEARLQPVNVEEEVGDSGGVESSEIVNNSIQKPEARPELENIEKEVADSGVLESSEIENNSIPTEMQLNSEMSSEEKTINSDPLERIPSKPISQTIVEASLQGKPQRLDPSSAEPSVPNIGKPSVVNHEGRQVSVELKGPPTRSSLEENDWNKAESLVKTELRADVELISSSTRGFAVSYGSLIGFLPYRNLAAKWKFLAFESWLRRKGVDPSPYRQNLGVIGGQDVTSKSPSPDSSLDSEVATTINGEVSSDMKLEDLLMVYDREKQKFLSSFVGQKIKVNVVMANRNSRKLIFSMRPRENEEEVEKKRTLMAKLRVGDVVKCCIKKITYFGIFCELEGVPALVHQSEVSWDATLDPASYFKIGQIVEAKVHQLDFALERIFLSLKEITPDPLTEALESVVGGDNDQLGGRLQAAELDAEWPDVESLIKELEMVEGIQSVSKSRFFLSPGLAPTFQVYMAPMFENQYKLLARAGNRVQELIVEASLSKEEMKSTIMSCTNRVE

SEQ ID NO: 3841 - DNA, 2400 bp, Populus balsamifera subsp. trichocarpa
  misc_feature (1)..(2400): Ceres ANNOT ID no. 1447411
  misc_feature 429313:<222: Transcription Factor
  misc_feature: Phenotype: Activates expression of the gene endogenous to the AtDXPR (SEQ ID NO 4143) regalutory region Useful for modulating Terpenoid Biosynthesis
atggactgtcttgctcttgccaccacctcagccacttcatcttccttctctgtgagaaaaatactgtttccttcaccatcagttgcagtaagagcaagaagtagcagaaaagaaatatggtttcctaggaaaaatgggttcttggttttggctgcaaaagaagaaggacaaccaaagctggaccagtgggaccaaatggagctcaagtttggtcatttacttggtgaagaccccaaacttactcttgctaagataatggctagaaaagaaaacccggatgtttcatatcttgaagttgagaaatcattttacaagaataagggtagagcagtagaaataaaggaggttccttttgatgtttcaatgaaaaagaaaccatccaatacaataaaggaggttccttttgatgtttcaatgaaaaagaaaccatccaatgtattggatggtttgaatttagttcggccggttccgaaggaaggatttaaatttcaagaagaggataagccagtagctcctcccaagataaagaaatcaaaccaacctgttgaaaaagcaatggataacgcaaagcgtagtgttccaaatgttattttgagaaagccatctttgtatgtagaggatgatgtggaagataggccatctaggaatagggtgaatattttaccaaatttaacattgaaaatgggaaatgatcaaaataaggagaagtttagtgatatgacactattgagaaagccacgaccaatgagtgttgatgagaagccagattctggcaatttgggaactgaagttaatcatgatggtgctggaatgagggttgaaaaagaagaaggtgagaatagatatagtggttttacgctgttaaaaaaacccaaaactatgaagattgagttcaaggagtcttcagaaaccggggatgcctcatttgtggaggagcaagaagtagaagataactacatatcaggaaggcagccatcggagaagagcaatattgagttcactgaagaggaagctgccctaaaccaacaatctggtaacaatttggttgattctgctgtcaagatctctatggaagctgcattgcaagggaaaccaaagagattagaccaatatgttgaagcgacatcagcctctagagtagaagatttgaatcttgtaaatgctgaaaatcttggaaatgctaatgaggatgtcacttccatatcaccactggaggatgctgattggaaaagggcagatgatttgcttaggacaggagatagagtagaagttgagttaattagcttcagcgtaagaggtttcattgtatcttttggctctctggtaggatttttgccataccgtaacctagctgcaaggtggaagttcttagcttttgagtcatggttgaaacagaaaggcttggatccatcactctacaagaaaaacttaggaataattggaagctacaatgtcccagaaaagaacagttctcttgattcaagcattgttccaaatatggatagaaaaattgaggtagaaaataagccggatatgaagttagaggatcttcttatgctatatgaccaagaaaaactgaagttcctgtcttcttttgttggtcagaaaatcaaagtgaacgtggttattgctgatagaaaattgaggaaacttgtagtttctctgaggccaaaagagaaggaagagttggttgagaaaaagagacatctcatggctacacttcaaattggggatgttgtgaaatgctgcatcaagaaagtaacttattttggcatttttgttgaggttgaaggtgtgcctgcgttaattcatgcatcggaggtctcatgggatgccactctgaaccctgcatcctgttttaaagttggtcagattgtggaggcaaaagttcaccaattggactttacccttcaacgtattttcttatcattgaaggagattacacctgatcctctgattgagaccctggaatctgtctttggtggtcgtgctcccctggatgggagattacaagcagcagaagcagattctgagtgggctgatgttgaaacacttgtcaaagagttgcaacaaattgaagggatccagtctgtatctagaggccgcttctttttgagtccaggtttagctcccgcatttcaggtttatatggcgtccatgtttgagaatcaatacaaattgcttgctcgatctggaaacaaagtacaagaggtaaaatttttggagtttgcagtatattaccttgaagattctgcacttcttaaatcagcatgtttgagccctgaacttttgcctcgtacaaatagcttcatgaacttgctgaaggtgatagttcaggcatcattgagcaaagaagaaatgaaatctacgattttgtcttgcactaacagagtggaatag

SEQ ID NO: 3842 - protein, 799 aa, Populus balsamifera subsp. trichocarpa
  misc_feature (1)..(799): Ceres ANNOT ID no. 1447411
  misc_feature (573)..(645): Pfam Name: S1 Pfam Description: S1 RNA binding domain
  misc_feature: SWISSPROT Homolog: RS1H_BACC1 30S ribosomal protein S1 homolog with e-value of 1.6e-13 and BLAST sequence identity of 28.6
  misc_feature: SWISSPROT Homolog: RS1_STAS1 30S ribosomal protein S1 with e-value of 1.8e-13 and BLAST sequence identity of 30.8
  misc_feature: SWISSPROT Homolog: RS1_STAAR 30S ribosomal protein S1 with e-value of 2.3e-13 and BLAST sequence identity of 35.2
  misc_feature: SWISSPROT Homolog: RS1H_BACSU 30S ribosomal protein S1 homolog with e-value of 2.9e-13 and BLAST sequence identity of 28.8
  misc_feature: SWISSPROT Homolog: RS1_STAAC 30S ribosomal protein S1 with e-value of 3.8e-13 and BLAST sequence identity of 35.2
  misc_feature 429461:<222: Transcription Factor
  misc_feature: Phenotype: Activates expression of the gene endogenous to the AtDXPR (SEQ ID NO 4143) regalutory region Useful for modulating Terpenoid Biosynthesis
  misc_feature (1)..(799): Functional Homolog of  Ceres CDNA ID no. 23651543 at SEQ ID NO. 3887 with e-value of 8.40E-188 and BLAST sequence identity of 58.4
MDCLALATTSATSSSFSVRKILFPSPSVAVRARSSRKEIWFPRKNGFLVLAAKEEGQPKLDQWDQMELKFGHLLGEDPKLTLAKIMARKENPDVSYLEVEKSFYKNKGRAVEIKEVPFDVSMKKKPSNTIKEVPFDVSMKKKPSNVLDGLNLVRPVPKEGFKFQEEDKPVAPPKIKKSNQPVEKAMDNAKRSVPNVILRKPSLYVEDDVEDRPSRNRVNILPNLTLKMGNDQNKEKFSDMTLLRKPRPMSVDEKPDSGNLGTEVNHDGAGMRVEKEEGENRYSGFTLLKKPKTMKIEFKESSETGDASFVEEQEVEDNYISGRQPSEKSNIEFTEEEAALNQQSGNNLVDSAVKISMEAALQGKPKRLDQYVEATSASRVEDLNLVNAENLGNANEDVTSISPLEDADWKRADDLLRTGDRVEVELISFSVRGFIVSFGSLVGFLPYRNLAARWKFLAFESWLKQKGLDPSLYKKNLGIIGSYNVPEKNSSLDSSIVPNMDRKIEVENKPDMKLEDLLMLYDQEKLKFLSSFVGQKIKVNVVIADRKLRKLVVSLRPKEKEELVEKKRHLMATLQIGDVVKCCIKKVTYFGIFVEVEGVPALIHASEVSWDATLNPASCFKVGQIVEAKVHQLDFTLQRIFLSLKEITPDPLIETLESVFGGRAPLDGRLQAAEADSEWADVETLVKELQQIEGIQSVSRGRFFLSPGLAPAFQVYMASMFENQYKLLARSGNKVQEVKFLEFAVYYLEDSALLKSACLSPELLPRTNSFMNLLKVIVQASLSKEEMKSTILSCTNRVE

SEQ ID NO: 3843 - protein, 496 aa, Arabidopsis thaliana; identical to SEQ ID NO: 3514
  misc_feature (1)..(496): Ceres CDNA ID no. 23653450
  misc_feature (1)..(496): Also Known As Ceres GEMINI ID 5109C6
  misc_feature (366)..(466): Pfam Name: mTERF Pfam Description: mTERF
  misc_feature 429658:<222: Transcription Factor
  misc_feature: Phenotype: Activates expression of the gene endogenous to the AtPES (SEQ ID NO 4142) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis

SEQ ID NO: 3844 - DNA, 1485 bp, Populus balsamifera subsp. trichocarpa; identical to SEQ ID NO: 3515
  misc_feature (1)..(1485): Ceres ANNOT ID no. 1441536
  misc_feature 429794:<222: Transcription Factor
  misc_feature: Phenotype: Activates expression of the gene endogenous to the AtPES (SEQ ID NO 4142) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis

SEQ ID NO: 3845 - protein, 494 aa, Populus balsamifera subsp. trichocarpa; identical to SEQ ID NO: 3516
  misc_feature (1)..(494): Ceres ANNOT ID no. 1441536
  misc_feature (118)..(464): Pfam Name: mTERF Pfam Description: mTERF
  misc_feature 429890:<222: Transcription Factor
  misc_feature: Phenotype: Activates expression of the gene endogenous to the AtPES (SEQ ID NO 4142) regalutory region Useful for modulating Terpenoid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(494): Functional Homolog of  Ceres CDNA ID no. 23653450 at SEQ ID NO. 3890 with e-value of 5.10E-165 and BLAST sequence identity of 70.5

SEQ ID NO: 3846 - protein, 804 aa, Arabidopsis thaliana
  misc_feature (1)..(804): Ceres CDNA ID no. 23655935
  misc_feature (1)..(804): Also Known As Ceres GEMINI ID 5110C8
  misc_feature (449)..(803): Pfam Name: SDA1 Pfam Description: SDA1
  misc_feature (86)..(138): Pfam Name: NUC130_3NT Pfam Description: NUC130/3NT domain
  misc_feature 430051:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
MSGSLGLTPASLKASGRSSENVSLLTLQGKIKRDPEGYETELQLIYKQFKTSVDLFHELAALSFSSTGGIGSDPSVSKDLGDRAMFLAHVTPFYPKQLAAFPAQLTGLLRTSCLAMPSGLRNHIAQALILLMNRKSLVIEDLLALFLDIQTLGDKNLRNLAFGHIVQTIRKMSITDPKHKSLQKIVISMLEQEDEAKAKRALATLCALHKKKIWLGDKNERVAIAICEACFHSSPRIMISALRFLLDYENIDDDDDSDAESDDDEESKKIDQVVINRQAVYKANNKGTSSSKKKKQAKLQRAVKSIKRKQRSSSENTTSTFSPLNHLNDAQKFAEKLFSRLQTIKGSGERVETRLMMIKVIARTIGLHKLHLLSFYPFLQNYALPHVKDITQILAAAVQSCHDGVPSDVVEPLFKQIVNQFVHDKSRPEAIAVGLNVVREMCLRVHDLMTEELLQDLALYKKSHEKAISAAARSLIALFREINPSLLVKKDRGRPGATVFIPKHYGESNVFSNVPNVELLQESDNESGSDGDQDDDGVELPIGDDVEQELIPGDCGSEDKAEEDSNDGDDMNNTEDDSDIDTSIGGDEDEEVNDSDEADTDSENEEIESEEEDGEASDSSVEDSGNKEKAKGKKRKIVDFDANLLSADTSLRALKRFAEAKNEKPSFDEGDGILSNEDFRKIKTLQAKKEAKIALARKGFKVPNSDQLSKKRVDPAKLEAHIRHKLTKEQRLELVKAGREDRGKYKSKAAVKQKKTGGSSNKQKEHRKNMPLAAIRSKAGKSKRIKKMKNSISGSQFRGRKAWK

SEQ ID NO: 3847 - DNA, 2406 bp, Populus balsamifera subsp. trichocarpa; identical to SEQ ID NO: 3530
  misc_feature (1)..(2406): Ceres ANNOT ID no. 1459700
  misc_feature 430237:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis

SEQ ID NO: 3848 - protein, 801 aa, Populus balsamifera subsp. trichocarpa; identical to SEQ ID NO: 3531
  misc_feature (1)..(801): Ceres ANNOT ID no. 1459700
  misc_feature (452)..(800): Pfam Name: SDA1 Pfam Description: SDA1
  misc_feature (79)..(130): Pfam Name: NUC130_3NT Pfam Description: NUC130/3NT domain
  misc_feature: SWISSPROT Homolog: YG58_YEAST Hypothetical 86.6 kDa protein in PFK1-TDS4 intergenic region with e-value of 1.9e-65 and BLAST sequence identity of 27.4
  misc_feature: SWISSPROT Homolog: YBLE_SCHPO Hypothetical protein C106.14c in chromosome II with e-value of 4.3e-59 and BLAST sequence identity of 27.9
  misc_feature: SWISSPROT Homolog: NMD2_YEAST Nonsense-mediated mRNA decay protein 2 (Up-frameshift suppressor 2) with e-value of 1.7e-11 and BLAST sequence identity of 25.6
  misc_feature: SWISSPROT Homolog: BFR2_EMENI Protein bfr2 with e-value of 5.7e-09 and BLAST sequence identity of 30.4
  misc_feature: SWISSPROT Homolog: AN32B_SHEEP Acidic leucine-rich nuclear phosphoprotein 32 family member B with e-value of 1.4e-08 and BLAST sequence identity of 33.1
  misc_feature: SWISSPROT Homolog: AN32B_SHEEP Leucine-rich acidic nuclear protein (LAN) Acidic protein rich in leucines
  misc_feature 430408:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature (1)..(801): Functional Homolog of  Ceres CDNA ID no. 23655935 at SEQ ID NO. 3893 with e-value of 4.30E-239 and BLAST sequence identity of 61.9

SEQ ID NO: 3849 - protein, 290 aa, Arabidopsis thaliana; identical to SEQ ID NO: 3555
  misc_feature (1)..(290): Ceres CDNA ID no. 23660631
  misc_feature (1)..(290): Also Known As Ceres GEMINI ID 5110C9
  misc_feature (212)..(241): Pfam Name: ACT Pfam Description: ACT domain
  misc_feature 430616:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis

SEQ ID NO: 3850 - DNA, 837 bp, Populus balsamifera subsp. trichocarpa; identical to SEQ ID NO: 3556
  misc_feature (1)..(837): Ceres ANNOT ID no. 1457646
  misc_feature 430713:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis

SEQ ID NO: 3851 - protein, 278 aa, Populus balsamifera subsp. trichocarpa; identical to SEQ ID NO: 3557
  misc_feature (1)..(278): Ceres ANNOT ID no. 1457646
  misc_feature (200)..(229): Pfam Name: ACT Pfam Description: ACT domain
  misc_feature 430787:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(278): Functional Homolog of  Ceres CDNA ID no. 23660631 at SEQ ID NO. 3896 with e-value of 4.19E-90 and BLAST sequence identity of 74.6

SEQ ID NO: 3852 - DNA, 942 bp, Populus balsamifera subsp. trichocarpa; identical to SEQ ID NO: 3558
  misc_feature (1)..(942): Ceres ANNOT ID no. 1518640
  misc_feature 430889:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis

SEQ ID NO: 3853 - protein, 309 aa, Populus balsamifera subsp. trichocarpa; identical to SEQ ID NO: 3559
  misc_feature (1)..(309): Ceres ANNOT ID no. 1518640
  misc_feature (231)..(260): Pfam Name: ACT Pfam Description: ACT domain
  misc_feature 430967:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature: Phenotype: Activates expression of the gene endogenous to the PsHMCOMT2 (SEQ ID NO 4162) regalutory region Useful for modulating Alkaloid Biosynthesis
  misc_feature: Phenotype: Activates expression of the gene endogenous to the PsROMT (SEQ ID NO 4161) regalutory region Useful for modulating Alkaloid Biosynthesis
  misc_feature (1)..(309): Functional Homolog of  Ceres CDNA ID no. 23660631 at SEQ ID NO. 3896 with e-value of 1.39E-82 and BLAST sequence identity of 75.6

SEQ ID NO: 3854 - protein, 190 aa, Arabidopsis thaliana
  misc_feature (1)..(190): Ceres CDNA ID no. 23660778
  misc_feature (1)..(190): Also Known As Ceres GEMINI ID 5109A5
  misc_feature (93)..(127): Pfam Name: bZIP_1 Pfam Description: bZIP transcription factor
  misc_feature 431089:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
MVPTRQEQRTTLASLTTLLLLPFRIMVLRHRPQNLDDTVKGINRSPVAENACGSMGIPNAKRNPGQRSRVRKLQYIAELERTVGMLQTVEADLSVRVASLLQTRATLSLENSQLKQQMAILKQDKLIREGEYQLLKKEAQRLKSGLGYLGSTNNSNRLVRSYSAGSNVAPRTASSHLDWNLLDLTKLNLN

SEQ ID NO: 3855 - DNA, 882 bp, Populus balsamifera subsp. trichocarpa
  misc_feature (1)..(882): Ceres ANNOT ID no. 1510945
  misc_feature 431151:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atgtcaaggcaatccctacttcctcctcgctgcccatttcggaagcatgtcgtttctcatccaattcacgaatccagtccgcaacaccatagatctccctcccaaggttcagttctggaggagaagccagcatggcttgatgatttgttaagtgatgaagatgcagattcaaaaggaaagtgtcttcgccggtcggccagtgattcggtcaccctcttggatggtattgtggattcattttcaggtttgagtccatataatgatgaagctgcttcaggtggcaatgaaacttgtagtggactggagtcagcttctatgtatggtcctaattctcctaggagaagagggaatgtgaccttctcggaaaatgccatagcatcagcactatcggagtatgcatttcaaaatcctttgcagtatgtagacggcagcctgtgcatttcggggattaaacccttggatcaaatggggaatgcatgtggttcagctggggagctcaatggcgagacaaaccctgtgaaacggcattccgggcaacgctcaagagttcgtaaactccagtatattgctgaacttgaaagaactgttaatgttctgcagactttggagtcagagttggctgtcaaggttgcttctatgcttcagaaacgtgctaccttgtccctggaaaacaacacattaaagcaacaggaggccagaatacggcaggaaaaattgatcgcagaggctcaacataaggctttgaagaaggaagctgagagaatgaaaaacaagttaggtttcacaaatttgaagttcagaaattattccagatcaagtcgccctccggaggcagctagatcaaaagttacatggcagatggcaaaacttaatcttaactag

SEQ ID NO: 3856 - protein, 188 aa, Populus balsamifera subsp. trichocarpa
  misc_feature (1)..(188): Ceres ANNOT ID no. 1510945
  misc_feature (70)..(94): Pfam Name: bZIP_1 Pfam Description: bZIP transcription factor
  misc_feature: SWISSPROT Homolog: RF2A_ORYSA Transcription factor RF2a with e-value of 1.1e-10 and BLAST sequence identity of 39.1
  misc_feature: SWISSPROT Homolog: RF2B_ORYSA Transcription factor RF2b with e-value of 3.4e-10 and BLAST sequence identity of 38.4
  misc_feature: SWISSPROT Homolog: POF21_ARATH Probable transcription factor PosF21 (AtbZIP59) with e-value of 1.7e-06 and BLAST sequence identity of 36.9
  misc_feature 431235:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(188): Functional Homolog of  Ceres CDNA ID no. 23660778 at SEQ ID NO. 3901 with e-value of 4.99E-32 and BLAST sequence identity of 57.7
MYGPNSPRRRGNVTFSENAIASALSEYAFQNPLQYVDGSLCISGIKPLDQMGNACGSAGELNGETNPVKRHSGQRSRVRKLQYIAELERTVNVLQTLESELAVKVASMLQKRATLSLENNTLKQQEARIRQEKLIAEAQHKALKKEAERMKNKLGFTNLKFRNYSRSSRPPEAARSKVTWQMAKLNLN

SEQ ID NO: 3857 - DNA, 885 bp, Populus balsamifera subsp. trichocarpa
  misc_feature (1)..(885): Ceres ANNOT ID no. 1465368
  misc_feature 431305:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atgtcaaggcaatctctccttcctcctcgctgcccatttcagaagcccgtggtttctcgaccaattcatgactcctacccacaacaccatagatctccttcccaaggttcaattttgggggagaagccggcatggcttgatgatttgttaagtgatgaagatgcagattccagggggacttgtcttcgccggtcagccagtgattcagtcaccctcttggaaggtattgtggattcgttttcgggttcgagtccttataacaatgaagctgcctcaggtgggggtgaaacttgtagtgggctggagtcagcttctatgtatggtcctaattctcctaggcgaagagggaatgtgaccttttctgagaatgccatagcttcagcactatcggagtatgcgtttcagaatcctctgcagtatgtagacggcagcttgtgcatatgggggaatactcccttggattcaatggggaatgcatgtggttcggctggggagctcaatggcgagacgagcactgtgaaacggcaatctgggcagcgctcaagagttcgcaaactccagtatattgctgaactcgaaagaactgttaatgttctgcagactttggagtcagagttggcgttcaaggttgcttcaatgcttcagaaacgtgctgccttgtccctggaaaacaacacattaaagcagcaggtggccagactgcggcaggaaaaattaatcgtggatgctcaacataagactttgaagaaggaagctgagagattgaaaaacaagttaggtagttccacaaataataagttcagaacatattccagatcaagtctttctccagaggcagctagatcagaagttacatggcagatggcgaggcttaatcttaactaa

SEQ ID NO: 3858 - protein, 189 aa, Populus balsamifera subsp. trichocarpa
  misc_feature (1)..(189): Ceres ANNOT ID no. 1465368
  misc_feature (114)..(132): Pfam Name: bZIP_2 Pfam Description: Basic region leucine zipper
  misc_feature (70)..(94): Pfam Name: bZIP_1 Pfam Description: bZIP transcription factor
  misc_feature: SWISSPROT Homolog: RF2A_ORYSA Transcription factor RF2a with e-value of 1.1e-10 and BLAST sequence identity of 39.1
  misc_feature: SWISSPROT Homolog: RF2B_ORYSA Transcription factor RF2b with e-value of 3.4e-10 and BLAST sequence identity of 38.4
  misc_feature: SWISSPROT Homolog: POF21_ARATH Probable transcription factor PosF21 (AtbZIP59) with e-value of 1.7e-06 and BLAST sequence identity of 36.9
  misc_feature 431395:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(189): Functional Homolog of  Ceres CDNA ID no. 23660778 at SEQ ID NO. 3901 with e-value of 1.00E-31 and BLAST sequence identity of 61.3
MYGPNSPRRRGNVTFSENAIASALSEYAFQNPLQYVDGSLCIWGNTPLDSMGNACGSAGELNGETSTVKRQSGQRSRVRKLQYIAELERTVNVLQTLESELAFKVASMLQKRAALSLENNTLKQQVARLRQEKLIVDAQHKTLKKEAERLKNKLGSSTNNKFRTYSRSSLSPEAARSEVTWQMARLNLN

SEQ ID NO: 3859 - protein, 678 aa, Arabidopsis thaliana
  misc_feature (1)..(678): Ceres CDNA ID no. 24365511
  misc_feature (1)..(678): Also Known As Ceres GEMINI ID 5110E8
  misc_feature (115)..(140): Pfam Name: zf-CCCH Pfam Description: Zinc finger C-x8-C-x5-C-x3-H type (and similar)
  misc_feature (328)..(422): Pfam Name: YTH Pfam Description: YT521-B-like family
  misc_feature 431485:<222: Transcription Factor
  misc_feature: Phenotype: Activates expression of the gene endogenous to the AtSS1 (SEQ ID NO 4158) regalutory region Useful for modulating Alkaloid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
MEDADGLSFDFEGGLDSGPVQNTASVPVAPPENSSSAAVNVAPTYDHSSATVAGAGRGRSFRQTVCRHWLRGLCMKGDACGFLHQFDKARMPICRFFRLYGECREQDCVYKHTNEDIKECNMYKLGFCPNGPDCRYRHAKLPGPPPPVEEVLQKIQQLTTYNYGTNRLYQARNVAPQLQDRPQGQVPMQGQPQESGNLQQQQQQQPQQSQHQVSQTLIPNPADQTNRTSHPLPQGVNSAVLNGLIASGFQQDSCDPKSHVFFISDWSPRVDCLFLCSSVAILPITYFVVKSNNRENFELSVQQGVWATQRSNEAKLNEAFDSVENVILIFSVNRTRHFQGCAKMTSRIGGYIGGGNWKHEHGTAQYGRNFSVKWLKLCELSFHKTRNLRNPYNENLPVKISRDCQELEPSVGEQLASLLYLEPDSELMAISIAAEAKREEEKAKGVNPESRAENPDIVPFEDNEEEEEEEDESEEEEESMAGGPQGRGRGRGIMWPPQMPLGRGIRPMPGMGGFPLGVMGPGDAFPYGPGGYNGMPDPFGMGPRPFGPYGPRFGGDFRGPVPGMMFPGRPPQQFPHGGYGMMGGGRGPHMGGMGNAPRGGRPMYYPPATSSARPGPSNRKTPERSDERGVSGDQQNQDASHDMEQFEVGNSLRNEESESEDEDEAPRRSRHGEGKKRR

SEQ ID NO: 3860 - DNA, 1485 bp, Populus balsamifera subsp. trichocarpa
  misc_feature (1)..(1485): Ceres ANNOT ID no. 1466223
  misc_feature 431647:<222: Transcription Factor
  misc_feature: Phenotype: Activates expression of the gene endogenous to the AtSS1 (SEQ ID NO 4158) regalutory region Useful for modulating Alkaloid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atgggagtcacctgttactgtgccactgatagcatatggtacttcattgttaagagctgcaaccttgaaaatttggagttatctgtgcagcaaggagtatgggcaacacaaaggagcaatgaacctaaactgaatgaagcttttgactctgctgaaaatgtaatcttgattttctcagtaaaccggactcggcatttccagggttgtgcaaagatgacatccaaaattggtgcttctgttggtggagggaattggaaatatgcacacggaactgcacattatgggaggaatttctcagtcaaatggttgaagctaattgcagtttcccacttgcagttgtgtgaactgtccttccacaaaactcgtcacttgagaaacccgttcaatgagaacttaccagtgaagccacctcatttggtaaataaaggacataaagcattagcactatcctttttgagaatcatacaagtaacttcactcttatcaatgcctgtaggatactttcagattagtagagattgtcaggagctagaaccctctattggtgagcaattggcgtccttactttatctggagccagatagcgacctcatggcaatctcagttgcagctgaagcaaaacgagaagaggaaaaagaaaaaggagtcaatcctgacagtggtggtgaaaaccctgacattgtcccatttgaggacaatgaagaagaggaggaggaagaaagtgaagaggaggtggaagccttcgggcatcctcttggagcagcagctcaaggcagagggagaggtagaggaatcatgtggcctcctcacattccaattgcccgtggggcaagacccatccccggcatgagagctttcccccccatgatgatgggtgctgatggtttttcatacggagctgtacctgatagcttcggaatgccagatctctttggtgtggctccccgtggattcgccccatatggtccgaggttttctggtgattttactggtgctacatctggcatgatgtttcctgggcggccttcccagccaggagctatgtttccagctggtggatttgggatgatgatgggttcaggacgtgctccgtttatggggggaatgggtcccactgcatcaaatcctcttcgaggccctcggcccggtggcatgtttgcaccacttctcgcatcatcctcccagaacaataaccggtcttttaagagagatcagagagcagcacccagtgatcgaattgacagacatagtatagaatcagatctggttaggggtgcagctggggaatcaaatgatgagacaagatacccgcaggaaacatacaaggcttcccatgaagatcaatttggtgctgtaaatagcaatagaaacgatgagagtgaaagtgaggatgaggcacctagacggtcaaggcacggggaggggaagaagaagcggcgaggatcagaaggagatgctaatcctggctcggatcacaaacagtaa

SEQ ID NO: 3861 - protein, 494 aa, Populus balsamifera subsp. trichocarpa
  misc_feature (1)..(494): Ceres ANNOT ID no. 1466223
  misc_feature (169)..(192): Pfam Name: YTH Pfam Description: YT521-B-like family
  misc_feature: SWISSPROT Homolog: YTDC1_RAT YTH domain-containing protein 1 (Putative splicing factor YT521) (RA301-binding protein) with e-value of 3.0e-21 and BLAST sequence identity of 29.2
  misc_feature: SWISSPROT Homolog: YTDC1_HUMAN YTH domain-containing protein 1 (Putative splicing factor YT521) with e-value of 4.0e-21 and BLAST sequence identity of 32.8
  misc_feature: SWISSPROT Homolog: CPSF4_HUMAN Cleavage and polyadenylation specificity factor with e-value of 1.4e-20 and BLAST sequence identity of 48.1
  misc_feature: SWISSPROT Homolog: CPSF4_HUMAN CPSF 30 kDa subunit NS1 effector domain-binding protein 1 (Neb-1) No arches homolog
  misc_feature: SWISSPROT Homolog: CPSF4_MOUSE Cleavage and polyadenylation specificity factor, 30 kDa subunit (CPSF 30 kDa subunit) (Clipper homolog) (Clipper/CPSF 30K) with e-value of 3.1e-17 and BLAST sequence identity of 42.7
  misc_feature: SWISSPROT Homolog: YTH1_YEAST Protein YTH1 with e-value of 8.3e-17 and BLAST sequence identity of 48.1
  misc_feature 431783:<222: Transcription Factor
  misc_feature: Phenotype: Activates expression of the gene endogenous to the AtSS1 (SEQ ID NO 4158) regalutory region Useful for modulating Alkaloid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(494): Functional Homolog of  Ceres CDNA ID no. 24365511 at SEQ ID NO. 3906 with e-value of 6.70E-131 and BLAST sequence identity of 74.1
MGVTCYCATDSIWYFIVKSCNLENLELSVQQGVWATQRSNEPKLNEAFDSAENVILIFSVNRTRHFQGCAKMTSKIGASVGGGNWKYAHGTAHYGRNFSVKWLKLIAVSHLQLCELSFHKTRHLRNPFNENLPVKPPHLVNKGHKALALSFLRIIQVTSLLSMPVGYFQISRDCQELEPSIGEQLASLLYLEPDSDLMAISVAAEAKREEEKEKGVNPDSGGENPDIVPFEDNEEEEEEESEEEVEAFGHPLGAAAQGRGRGRGIMWPPHIPIARGARPIPGMRAFPPMMMGADGFSYGAVPDSFGMPDLFGVAPRGFAPYGPRFSGDFTGATSGMMFPGRPSQPGAMFPAGGFGMMMGSGRAPFMGGMGPTASNPLRGPRPGGMFAPLLASSSQNNNRSFKRDQRAAPSDRIDRHSIESDLVRGAAGESNDETRYPQETYKASHEDQFGAVNSNRNDESESEDEAPRRSRHGEGKKKRRGSEGDANPGSDHKQ

SEQ ID NO: 3862 - DNA, 1143 bp, Populus balsamifera subsp. trichocarpa
  misc_feature (1)..(1143): Ceres ANNOT ID no. 1494350
  misc_feature 431917:<222: Transcription Factor
  misc_feature: Phenotype: Activates expression of the gene endogenous to the AtSS1 (SEQ ID NO 4158) regalutory region Useful for modulating Alkaloid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atggcatccaaaattggtgcttctgttggtggggggaattggaaatatgcacatggaactgcgcattatgggaggaatttctcagtcaaatggttgaagttgtgtgaactgtccttccacaaaactcgccacttgagaaacccattcaatgagaacttgccggtgaagattagtagagattgtcaagagctagaaccctctattggcgagcagttggcgtccttactttatctggagccagatagcgaacttatggcagtctcacttgcagcagaagcaaaacgagaagaggaaaaggaaaagggagtcaatcctgacagtggtggtgagaaccctgacattgtcccctttgaggacaatgaagaagaggaagaagaagaaagtgaagaggaggaggagtcctttgggcagcctcttggaccagcagctcaaggcagggggagaggtagaggaatgatgtggccttctcacaatccaatggcccgtggggctagacccatccctggcatcagaggtttcccccccatgatgatgggtgctgacgggttttcttatggagctgttacacccgatagctttggaatgccagatctctttggtgtggcatcccgtggattccccccatatggtccgaggttttctggtgattttactggtgctgcatctggtatgatgtttcctgggcggccttcccaaccgggggctgtgtttccagctggtggatttgggatgatgatgggtccaggacgtcctccctttattggggggatgggtcccactccatcaaatcttctccgaggtcctcggccaggtggcatgttttcaccgtttcctgcgccatcctcccagaacaacagccggtctgttaagagagaccagagggcggccgcaaatgatcgaaatgacaggcatagtgcagaatcagatgtggtcaggggtgcagctggggaatcaaatgacgagagaaaatacatgcaggaaacattaaaggcttcccatgaagatcaatttggtgctgtaaatagcatcagaaatgatgagagtgaaagtgaggacgaggcaccaagacggtcaaggcatggggagggaaagaagaagcgccgaggttccggagatgatgctactcctggctctgagcactaa

SEQ ID NO: 3863 - protein, 380 aa, Populus balsamifera subsp. trichocarpa
  misc_feature (1)..(380): Ceres ANNOT ID no. 1494350
  misc_feature (1)..(79): Pfam Name: YTH Pfam Description: YT521-B-like family
  misc_feature: SWISSPROT Homolog: YTDC1_RAT YTH domain-containing protein 1 (Putative splicing factor YT521) (RA301-binding protein) with e-value of 3.0e-21 and BLAST sequence identity of 29.2
  misc_feature: SWISSPROT Homolog: YTDC1_HUMAN YTH domain-containing protein 1 (Putative splicing factor YT521) with e-value of 4.0e-21 and BLAST sequence identity of 32.8
  misc_feature: SWISSPROT Homolog: CPSF4_HUMAN Cleavage and polyadenylation specificity factor with e-value of 1.4e-20 and BLAST sequence identity of 48.1
  misc_feature: SWISSPROT Homolog: CPSF4_HUMAN CPSF 30 kDa subunit NS1 effector domain-binding protein 1 (Neb-1) No arches homolog
  misc_feature: SWISSPROT Homolog: CPSF4_MOUSE Cleavage and polyadenylation specificity factor, 30 kDa subunit (CPSF 30 kDa subunit) (Clipper homolog) (Clipper/CPSF 30K) with e-value of 3.1e-17 and BLAST sequence identity of 42.7
  misc_feature: SWISSPROT Homolog: YTH1_YEAST Protein YTH1 with e-value of 8.3e-17 and BLAST sequence identity of 48.1
  misc_feature 432043:<222: Transcription Factor
  misc_feature: Phenotype: Activates expression of the gene endogenous to the AtSS1 (SEQ ID NO 4158) regalutory region Useful for modulating Alkaloid Biosynthesis
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(380): Functional Homolog of  Ceres CDNA ID no. 24365511 at SEQ ID NO. 3906 with e-value of 5.59E-111 and BLAST sequence identity of 70.6
MASKIGASVGGGNWKYAHGTAHYGRNFSVKWLKLCELSFHKTRHLRNPFNENLPVKISRDCQELEPSIGEQLASLLYLEPDSELMAVSLAAEAKREEEKEKGVNPDSGGENPDIVPFEDNEEEEEEESEEEEESFGQPLGPAAQGRGRGRGMMWPSHNPMARGARPIPGIRGFPPMMMGADGFSYGAVTPDSFGMPDLFGVASRGFPPYGPRFSGDFTGAASGMMFPGRPSQPGAVFPAGGFGMMMGPGRPPFIGGMGPTPSNLLRGPRPGGMFSPFPAPSSQNNSRSVKRDQRAAANDRNDRHSAESDVVRGAAGESNDERKYMQETLKASHEDQFGAVNSIRNDESESEDEAPRRSRHGEGKKKRRGSGDDATPGSEH

SEQ ID NO: 3864 - protein, 249 aa, Arabidopsis thaliana
  misc_feature (1)..(249): Ceres CDNA ID no. 24373996
  misc_feature (1)..(249): Also Known As Ceres GEMINI ID 5109E11
  misc_feature (48)..(96): Pfam Name: zf-C3HC4 Pfam Description: Zinc finger, C3HC4 type (RING finger)
  misc_feature 432170:<222: Transcription Factor
  misc_feature: Phenotype: Activates expression of the gene endogenous to the AtROX7 (SEQ ID NO 4155) regalutory region Useful for modulating Alkaloid Biosynthesis
MALDQSFEDAALLGELYGEGAFCFKSKKPEPITVSVPSDDTDDSNFDCNICLDSVQEPVVTLCGHLFCWPCIHKWLDVQSFSTSDEYQRHRQCPVCKSKVSHSTLVPLYGRGRCTTQEEGKNSVPKRPVGPVYRLEMPNSPYASTDLRLSQRVHFNSPQEGYYPVSGVMSSNSLSYSAVLDPVMVMVGEMVATRLFGTRVMDRFAYPDTYNLAGTSGPRMRRRIMQADKSLGRIFFFFMCCVVLCLLLF

SEQ ID NO: 3865 - DNA, 792 bp, Populus balsamifera subsp. trichocarpa
  misc_feature (1)..(792): Ceres ANNOT ID no. 1534046
  misc_feature 432243:<222: Transcription Factor
  misc_feature: Phenotype: Activates expression of the gene endogenous to the AtROX7 (SEQ ID NO 4155) regalutory region Useful for modulating Alkaloid Biosynthesis
atggccttagaccaatacatggaagaaactatggctcaaaatgactataatagagaagataagccatcactgccaaactggaaatctgtttctgagacagtcatagactctgatgatagccgctccagtggttttgattgcaatatttgcctagactccgtgcatgatccggtggtcactctttgtggtcacctctactgctggccctgcatatacaaatggcttcatttccagagcatctcggcagaaaaccaagatcagcacccacaacagcaatgtcctgtatgcaaagccgaagtttcccaatctacaatagttccactctttggccggggccaaaccacaaaaccctgcaagggcaaagcccccaatctcggtataatcattccacgaagacctcctggtcgtgcatgtggttttgactcaccaagatcacctattgccaccagcagtcctcgcgtaacaccgcaaattcatcatcggcataattatccgcatcaatcgcaacactactattctcagccagggagtaactctacttccccgatgcgtagcccagggggctctacattgaacatgcctgcgctagaggtcgggatgttcggcgaaatgatgtactcaagggtcttcggtaactcgataaccaacatccacagttacccaaattcgtatcatctagctggaagcgccagcccaagagtgagaaggcatgtaatgcaagctgataggtcgctcagcagaatctgcttcttcctcttctgctgtgtatttttgtgttttctctctttctga

SEQ ID NO: 3866 - protein, 263 aa, Populus balsamifera subsp. trichocarpa
  misc_feature (1)..(263): Ceres ANNOT ID no. 1534046
  misc_feature (47)..(96): Pfam Name: zf-C3HC4 Pfam Description: Zinc finger, C3HC4 type (RING finger)
  misc_feature: SWISSPROT Homolog: RNF5_CAEEL RING finger protein 5 with e-value of 5.4e-20 and BLAST sequence identity of 41.2
  misc_feature: SWISSPROT Homolog: PEX10_ARATH Peroxisome assembly protein 10 (Peroxin-10) (AthPEX10) (Pex10p) (PER8) with e-value of 2.8e-07 and BLAST sequence identity of 39.7
  misc_feature 432317:<222: Transcription Factor
  misc_feature: Phenotype: Activates expression of the gene endogenous to the AtROX7 (SEQ ID NO 4155) regalutory region Useful for modulating Alkaloid Biosynthesis
  misc_feature (1)..(263): Functional Homolog of  Ceres CDNA ID no. 24373996 at SEQ ID NO. 3911 with e-value of 2.50E-53 and BLAST sequence identity of 46.7
MALDQYMEETMAQNDYNREDKPSLPNWKSVSETVIDSDDSRSSGFDCNICLDSVHDPVVTLCGHLYCWPCIYKWLHFQSISAENQDQHPQQQCPVCKAEVSQSTIVPLFGRGQTTKPCKGKAPNLGIIIPRRPPGRACGFDSPRSPIATSSPRVTPQIHHRHNYPHQSQHYYSQPGSNSTSPMRSPGGSTLNMPALEVGMFGEMMYSRVFGNSITNIHSYPNSYHLAGSASPRVRRHVMQADRSLSRICFFLFCCVFLCFLSF

SEQ ID NO: 3867 - DNA, 810 bp, Populus balsamifera subsp. trichocarpa
  misc_feature (1)..(810): Ceres ANNOT ID no. 1480559
  misc_feature 432401:<222: Transcription Factor
  misc_feature: Phenotype: Activates expression of the gene endogenous to the AtROX7 (SEQ ID NO 4155) regalutory region Useful for modulating Alkaloid Biosynthesis
atggccttagaccaatacatggaagaaactatggctcaaaatgactataatagagaagataagccatcactgccaaactggaaatctgtttctgagacagtcatagactctgatgatagccgctccagtggttttgattgcaatatttgcctagactccgtgcatgatccggtggtcactctttgtggtcacctctactgctggccctgcatatacaaatggcttcatttccagagcatctcggcagaaaaccaagatcagcacccacaacagcaatgtcctgtatgcaaagccgaagtttcccaatctacaatagttccactctttggccggggccaaaccacaaaaccctgcaagggcaaagcccccaatctcggtataatcattccacgaagacctcctggtcgtgcatgtggttttgactcaccaagatcacctattgccaccagcagtcctcgcgtaacaccgcaaattcatcatcggcataattatccgcatcaatcgcaacactactattctcagccagggagtaactctacttccccgatgcgtagcccagggggctctacattgaacatgcctgcgctagaggtcgggatgttcggcgaaatgatgtactcaagggtcttcggtaactcgataaccaacatccacagttacccaaattcgtatcatctagctggaagcgccagcccaagagtgagaaggcatgaatgtcatatgcctgcgcactcagacaagtaccactatggatgttctgttctctgcatcaaatccaactacagacagagatgcgcattggctggatga

SEQ ID NO: 3868 - protein, 269 aa, Populus balsamifera subsp. trichocarpa
  misc_feature (1)..(269): Ceres ANNOT ID no. 1480559
  misc_feature (47)..(96): Pfam Name: zf-C3HC4 Pfam Description: Zinc finger, C3HC4 type (RING finger)
  misc_feature: SWISSPROT Homolog: RNF5_CAEEL RING finger protein 5 with e-value of 5.4e-20 and BLAST sequence identity of 41.2
  misc_feature: SWISSPROT Homolog: PEX10_ARATH Peroxisome assembly protein 10 (Peroxin-10) (AthPEX10) (Pex10p) (PER8) with e-value of 2.8e-07 and BLAST sequence identity of 39.7
  misc_feature 432475:<222: Transcription Factor
  misc_feature: Phenotype: Activates expression of the gene endogenous to the AtROX7 (SEQ ID NO 4155) regalutory region Useful for modulating Alkaloid Biosynthesis
  misc_feature (1)..(269): Functional Homolog of  Ceres CDNA ID no. 24373996 at SEQ ID NO. 3911 with e-value of 1.40E-43 and BLAST sequence identity of 42.5
MALDQYMEETMAQNDYNREDKPSLPNWKSVSETVIDSDDSRSSGFDCNICLDSVHDPVVTLCGHLYCWPCIYKWLHFQSISAENQDQHPQQQCPVCKAEVSQSTIVPLFGRGQTTKPCKGKAPNLGIIIPRRPPGRACGFDSPRSPIATSSPRVTPQIHHRHNYPHQSQHYYSQPGSNSTSPMRSPGGSTLNMPALEVGMFGEMMYSRVFGNSITNIHSYPNSYHLAGSASPRVRRHECHMPAHSDKYHYGCSVLCIKSNYRQRCALAG

SEQ ID NO: 3869 - protein, 293 aa, Arabidopsis thaliana
  misc_feature (1)..(293): Ceres CDNA ID no. 24374230
  misc_feature (1)..(293): Also Known As Ceres GEMINI ID 5109G4
  misc_feature (23)..(133): Pfam Name: Mov34 Pfam Description: Mov34/MPN/PAD-1 family
  misc_feature 432573:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtDXPR (SEQ ID NO 4143) regalutory region Useful for modulating Terpenoid Biosynthesis
MAATSEHTILQFVSPSSTASATTSVLTARIHPLVIFNVCDCFVRRPDSAERVIGTLLGSILPDGTVDIRNSYAVPHNESSDQVAVDIDYHHNMLASHLKVNSKETIVGWYSTGAGVNGGSSLIHDFYAREVPNPIHLTVDTGFTNGEGTIKAFVSSNLSLGDRQLVAHFQEIPVDLRMVDAERVGFDVLKATSVDKLPNDLEGMELTMERLLTLINDVYKYVDSVVGGQIAPDNNIGRFIADAVASLPKLPPQVFDNLVNDSLQDQLLLLYLSSITRTQLSLAEKLNTAAQML

SEQ ID NO: 3870 - DNA, 864 bp, Populus balsamifera subsp. trichocarpa
  misc_feature (1)..(864): Ceres ANNOT ID no. 1464743
  misc_feature 432663:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtDXPR (SEQ ID NO 4143) regalutory region Useful for modulating Terpenoid Biosynthesis
atggcggcgatcgagcagcaaacagtcctccaattcgcaccatcatcttcatcgaccctctccgcgaaggttcaccctcttgtcatcttcaacatctgcgattgctacgttaggcggcctgaccaagctgagcgcgtcattggcactctccttggctccgtcttgcccgatggcaccgttgatatccgcaactcttatgccgtccctcataatgaatcctccgaacaggtggctttggatatcgattaccatcataacttgctgctgtctcatcaaaaagtgaatcctaaggaagttattgttggatggtattcaactgggttaggagttactggcggtagtgctttgattcatgatttctattccagagaagtcccgaaccctattcatctgacggtggatacaggattcagtaatggggagggtaccataaaggcttatgtttctgtgaatctgtctcttggagaccgtccgcttgcggcacaatttcaagaagttcctcttgatcttcgaatggttgaagctgagcgcattggatttgatgttttgaagactacaatggttgacaaaattccaagtgatttggaagggatggaaatctctatgcaacggctactagctctaattgatgatgtgtacaaatatgttgatgatgtggtggaagggcacactgcaccagataataacataggacgttttatatcagacacggtcgcctcccttcccaaactttcaccaccagtgtttgataagcttgtaaatgacaatgtgcaggaccatttactcttgctgtatctgtcaagcatcactaggacacagctcagcttagcagagaagttgaatacagctgctcagatcctctga

SEQ ID NO: 3871 - protein, 287 aa, Populus balsamifera subsp. trichocarpa
  misc_feature (1)..(287): Ceres ANNOT ID no. 1464743
  misc_feature (17)..(127): Pfam Name: Mov34 Pfam Description: Mov34/MPN/PAD-1 family
  misc_feature: SWISSPROT Homolog: IF35_ARATH Eukaryotic translation initiation factor 3 subunit 5 eIF-3 epsilon (eIF3 p32 subunit) (eIF3f) with e-value of 3.1e-152 and BLAST sequence identity of 100.0
  misc_feature: SWISSPROT Homolog: IF35_HUMAN Eukaryotic translation initiation factor 3 subunit 5 (eIF3 p47 subunit) (eIF3f) with e-value of 4.2e-52 and BLAST sequence identity of 39.2
  misc_feature: SWISSPROT Homolog: IF35_MOUSE Eukaryotic translation initiation factor 3 subunit 5 (eIF3 p47 subunit) (eIF3f) with e-value of 5.4e-52 and BLAST sequence identity of 39.2
  misc_feature: SWISSPROT Homolog: PSD7_ARATH Probable 26S proteasome non-ATPase regulatory subunit 7 (26S proteasome regulatory subunit rpn8) (MOV34 protein) with e-value of 6.3e-26 and BLAST sequence identity of 28.6
  misc_feature: SWISSPROT Homolog: PSD7_DROME 26S proteasome non-ATPase regulatory subunit 7 with e-value of 5.7e-25 and BLAST sequence identity of 28.1
  misc_feature: SWISSPROT Homolog: PSD7_DROME A 26S proteasome regulatory subunit rpn8) ( A 26S proteasome regulatory subunit S12) ( Proteasome subunit p40) (Proteasome subunit p39B) (Protein Mov34)
  misc_feature 432780:<222: Transcription Factor
  misc_feature: Phenotype: Activates expression of the gene endogenous to the AtCR2 (SEQ ID NO 4153) regalutory region and/or the AtROX6(SEQ ID NO 4154)  regulatory region. Useful for modulating Alkaloid Biosynthesis
  misc_feature: Phenotype: Activates expression of the gene endogenous to the AtDXPR (SEQ ID NO 4143) regalutory region Useful for modulating Terpenoid Biosynthesis
  misc_feature (1)..(287): Functional Homolog of  Ceres CDNA ID no. 24374230 at SEQ ID NO. 3916 with e-value of 1.10E-121 and BLAST sequence identity of 79.7
MAAIEQQTVLQFAPSSSSTLSAKVHPLVIFNICDCYVRRPDQAERVIGTLLGSVLPDGTVDIRNSYAVPHNESSEQVALDIDYHHNLLLSHQKVNPKEVIVGWYSTGLGVTGGSALIHDFYSREVPNPIHLTVDTGFSNGEGTIKAYVSVNLSLGDRPLAAQFQEVPLDLRMVEAERIGFDVLKTTMVDKIPSDLEGMEISMQRLLALIDDVYKYVDDVVEGHTAPDNNIGRFISDTVASLPKLSPPVFDKLVNDNVQDHLLLLYLSSITRTQLSLAEKLNTAAQIL

SEQ ID NO: 3872 - protein, 320 aa, Arabidopsis thaliana
  misc_feature (1)..(320): Ceres CDNA ID no. 24380616
  misc_feature (1)..(320): Also Known As Ceres GEMINI ID 5110E4
  misc_feature (32)..(107): Pfam Name: FHA Pfam Description: FHA domain
  misc_feature 432889:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
MATAVGGGSDVEVGFAKLQGEDFEYYMQSYSIILGRNSKKATVDVDLSSLGGGMNISRNHARIFYDFTRRRFSLEVLGKNGCLVEGVLHLPGNPNVKLDSQDLLQIGDKEFYFLLPVRSILGGPLGPRHHVSGQTSVVPYHNYQSGPGSGSGKKGVRSRELYEYDDEDDDDDDDEEDDMRGSGKKTRRDGHEVVYASGEKKREGRSKVDREADDQQFLQLEEKDVVSSVATVLSDLCGPGEWMPMEKLHSVILKEYGNVWHHSRVRRYLSQEDWAIPEAKGKPWYGLLMLLRKYPEHFVINTRSKGRVTLEFVSLVTLLS

SEQ ID NO: 3873 - DNA, 723 bp, Populus balsamifera subsp. trichocarpa
  misc_feature (1)..(723): Ceres ANNOT ID no. 1445708
  misc_feature 432978:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
atgggagcgacgggaagcgacgtagaggccggattcgcgaagctacaaggagaagacttcgagtactatatgcaaacatactcaataatcttaggccggaactcgaaaaaatccaccgtcgatgtcgacctctcaagccttggcggtgggatgaacatatcacgcaacggcgtcgcgcgcatcttctacgatttcacgcgacgccgtttcgcacttgaagtactcggcaagaacggttgcctagtcgaaggcgtactccacctcccaggaaaccctccagtcaagttggattcacaagatctgttgcaaatcggagataaagagttttactttttgctccctgttaggagtattttgggcggggcgttagcgcctaggcaccacgtggcggttgtgccgcagtatgggtatcattccggtggggcggataggatggtgggaccggtttcggttgcgacggttaagaaggggagagcgagggagttttacgaggaggagtttgatgatgaggaggatgttggtggcagtggtggtggtgggaagaagatgaggagagagggttatgaagggtatggatatggaagtgggtctggtggtaaagcaggaatggctggagctgtagtttcaccttctttcgcagagttttcgtggggtgagggaggatgtgaaatgttagcttgcgattgggtttgtatgatggttttgagactagattatcgctag

SEQ ID NO: 3874 - protein, 240 aa, Populus balsamifera subsp. trichocarpa
  misc_feature (1)..(240): Ceres ANNOT ID no. 1445708
  misc_feature (29)..(105): Pfam Name: FHA Pfam Description: FHA domain
  misc_feature: SWISSPROT Homolog: FHL1_YEAST Pre-rRNA-processing protein FHL1 with e-value of 2.5e-12 and BLAST sequence identity of 39.8
  misc_feature: SWISSPROT Homolog: FHL1_SCHPO Fork head transcription factor 1 with e-value of 3.7e-12 and BLAST sequence identity of 36.7
  misc_feature: SWISSPROT Homolog: FOXK1_MOUSE Forkhead box protein K1 (Myocyte nuclear factor) (MNF) with e-value of 4.1e-07 and BLAST sequence identity of 38.4
  misc_feature: SWISSPROT Homolog: FKH2_SCHPO Fork head protein homolog 2 with e-value of 7.6e-06 and BLAST sequence identity of 32.1
  misc_feature 433065:<222: Transcription Factor
  misc_feature: Phenotype: Activates expression of the gene endogenous to the AtSS3 (SEQ ID NO 4159) regalutory region and/or the AtROX7(SEQ ID NO 4155)  regulatory region. Useful for modulating Alkaloid Biosynthesis
  misc_feature (1)..(240): Functional Homolog of  Ceres CDNA ID no. 24380616 at SEQ ID NO. 3919 with e-value of 1.79E-66 and BLAST sequence identity of 77.6
MGATGSDVEAGFAKLQGEDFEYYMQTYSIILGRNSKKSTVDVDLSSLGGGMNISRNGVARIFYDFTRRRFALEVLGKNGCLVEGVLHLPGNPPVKLDSQDLLQIGDKEFYFLLPVRSILGGALAPRHHVAVVPQYGYHSGGADRMVGPVSVATVKKGRAREFYEEEFDDEEDVGGSGGGGKKMRREGYEGYGYGSGSGGKAGMAGAVVSPSFAEFSWGEGGCEMLACDWVCMMVLRLDYR

SEQ ID NO: 3875 - protein, 499 aa, Arabidopsis thaliana; identical to SEQ ID NO: 555
  misc_feature (1)..(499): Ceres CDNA ID no. 36507011
  misc_feature (30)..(494): Pfam Name: p450 Pfam Description: Cytochrome P450
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Undulate Shaped Useful for making plants with increased biomass and foliage

SEQ ID NO: 3876 - DNA, 1515 bp, Populus balsamifera subsp. trichocarpa; identical to SEQ ID NO: 556
  misc_feature (1)..(1515): Ceres ANNOT ID no. 1442604
  misc_feature 433306:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Undulate Shaped Useful for making plants with increased biomass and foliage

SEQ ID NO: 3877 - protein, 504 aa, Populus balsamifera subsp. trichocarpa; identical to SEQ ID NO: 557
  misc_feature (1)..(504): Ceres ANNOT ID no. 1442604
  misc_feature (31)..(493): Pfam Name: p450 Pfam Description: Cytochrome P450
  misc_feature: SWISSPROT Homolog: C83B1_ARATH Cytochrome P450 83B1 (EC 1.14.-.-) with e-value of 2.5e-269 and BLAST sequence identity of 100.0
  misc_feature: SWISSPROT Homolog: C83A1_ARATH Cytochrome P450 83A1 (EC 1.14.-.-) (CYPLXXXIII) with e-value of 7.3e-167 and BLAST sequence identity of 63.2
  misc_feature: SWISSPROT Homolog: C71BA_ARATH Cytochrome P450 71B10 (EC 1.14.-.-) with e-value of 7.9e-106 and BLAST sequence identity of 41.2
  misc_feature: SWISSPROT Homolog: C71BV_ARATH Cytochrome P450 71B34 (EC 1.14.-.-) with e-value of 7.1e-105 and BLAST sequence identity of 41.0
  misc_feature: SWISSPROT Homolog: C71BY_ARATH Cytochrome P450 71B37 (EC 1.14.-.-) with e-value of 3.5e-103 and BLAST sequence identity of 42.1
  misc_feature 433464:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Undulate Shaped Useful for making plants with increased biomass and foliage
  misc_feature (1)..(504): Functional Homolog of  Ceres CDNA ID no. 36507011 at SEQ ID NO. 3922 with e-value of 5.60E-143 and BLAST sequence identity of 53.9

SEQ ID NO: 3878 - DNA, 1542 bp, Populus balsamifera subsp. trichocarpa; identical to SEQ ID NO: 558
  misc_feature (1)..(1542): Ceres ANNOT ID no. 1442612
  misc_feature 433628:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Undulate Shaped Useful for making plants with increased biomass and foliage

SEQ ID NO: 3879 - protein, 513 aa, Populus balsamifera subsp. trichocarpa; identical to SEQ ID NO: 559
  misc_feature (1)..(513): Ceres ANNOT ID no. 1442612
  misc_feature (32)..(493): Pfam Name: p450 Pfam Description: Cytochrome P450
  misc_feature: SWISSPROT Homolog: C83B1_ARATH Cytochrome P450 83B1 (EC 1.14.-.-) with e-value of 2.5e-269 and BLAST sequence identity of 100.0
  misc_feature: SWISSPROT Homolog: C83A1_ARATH Cytochrome P450 83A1 (EC 1.14.-.-) (CYPLXXXIII) with e-value of 7.3e-167 and BLAST sequence identity of 63.2
  misc_feature: SWISSPROT Homolog: C71BA_ARATH Cytochrome P450 71B10 (EC 1.14.-.-) with e-value of 7.9e-106 and BLAST sequence identity of 41.2
  misc_feature: SWISSPROT Homolog: C71BV_ARATH Cytochrome P450 71B34 (EC 1.14.-.-) with e-value of 7.1e-105 and BLAST sequence identity of 41.0
  misc_feature: SWISSPROT Homolog: C71BY_ARATH Cytochrome P450 71B37 (EC 1.14.-.-) with e-value of 3.5e-103 and BLAST sequence identity of 42.1
  misc_feature 433786:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Undulate Shaped Useful for making plants with increased biomass and foliage
  misc_feature (1)..(513): Functional Homolog of  Ceres CDNA ID no. 36507011 at SEQ ID NO. 3922 with e-value of 5.29E-131 and BLAST sequence identity of 48.7

SEQ ID NO: 3880 - DNA, 1542 bp, Populus balsamifera subsp. trichocarpa; identical to SEQ ID NO: 560
  misc_feature (1)..(1542): Ceres ANNOT ID no. 1442608
  misc_feature 433953:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Undulate Shaped Useful for making plants with increased biomass and foliage

SEQ ID NO: 3881 - protein, 513 aa, Populus balsamifera subsp. trichocarpa; identical to SEQ ID NO: 561
  misc_feature (1)..(513): Ceres ANNOT ID no. 1442608
  misc_feature (32)..(493): Pfam Name: p450 Pfam Description: Cytochrome P450
  misc_feature: SWISSPROT Homolog: C83B1_ARATH Cytochrome P450 83B1 (EC 1.14.-.-) with e-value of 2.5e-269 and BLAST sequence identity of 100.0
  misc_feature: SWISSPROT Homolog: C83A1_ARATH Cytochrome P450 83A1 (EC 1.14.-.-) (CYPLXXXIII) with e-value of 7.3e-167 and BLAST sequence identity of 63.2
  misc_feature: SWISSPROT Homolog: C71BA_ARATH Cytochrome P450 71B10 (EC 1.14.-.-) with e-value of 7.9e-106 and BLAST sequence identity of 41.2
  misc_feature: SWISSPROT Homolog: C71BV_ARATH Cytochrome P450 71B34 (EC 1.14.-.-) with e-value of 7.1e-105 and BLAST sequence identity of 41.0
  misc_feature: SWISSPROT Homolog: C71BY_ARATH Cytochrome P450 71B37 (EC 1.14.-.-) with e-value of 3.5e-103 and BLAST sequence identity of 42.1
  misc_feature 434111:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Undulate Shaped Useful for making plants with increased biomass and foliage
  misc_feature (1)..(513): Functional Homolog of  Ceres CDNA ID no. 36507011 at SEQ ID NO. 3922 with e-value of 1.39E-130 and BLAST sequence identity of 48.9

SEQ ID NO: 3882 - DNA, 1584 bp, Populus balsamifera subsp. trichocarpa; identical to SEQ ID NO: 562
  misc_feature (1)..(1584): Ceres ANNOT ID no. 1452827
  misc_feature 434278:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Undulate Shaped Useful for making plants with increased biomass and foliage

SEQ ID NO: 3883 - protein, 525 aa, Populus balsamifera subsp. trichocarpa; identical to SEQ ID NO: 563
  misc_feature (1)..(525): Ceres ANNOT ID no. 1452827
  misc_feature (28)..(493): Pfam Name: p450 Pfam Description: Cytochrome P450
  misc_feature: SWISSPROT Homolog: C83B1_ARATH Cytochrome P450 83B1 (EC 1.14.-.-) with e-value of 2.5e-269 and BLAST sequence identity of 100.0
  misc_feature: SWISSPROT Homolog: C83A1_ARATH Cytochrome P450 83A1 (EC 1.14.-.-) (CYPLXXXIII) with e-value of 7.3e-167 and BLAST sequence identity of 63.2
  misc_feature: SWISSPROT Homolog: C71BA_ARATH Cytochrome P450 71B10 (EC 1.14.-.-) with e-value of 7.9e-106 and BLAST sequence identity of 41.2
  misc_feature: SWISSPROT Homolog: C71BV_ARATH Cytochrome P450 71B34 (EC 1.14.-.-) with e-value of 7.1e-105 and BLAST sequence identity of 41.0
  misc_feature: SWISSPROT Homolog: C71BY_ARATH Cytochrome P450 71B37 (EC 1.14.-.-) with e-value of 3.5e-103 and BLAST sequence identity of 42.1
  misc_feature 434438:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature: Phenotype: ROSETTE LEAVES - Undulate Shaped Useful for making plants with increased biomass and foliage
  misc_feature (1)..(525): Functional Homolog of  Ceres CDNA ID no. 36507011 at SEQ ID NO. 3922 with e-value of 1.30E-125 and BLAST sequence identity of 50.6

SEQ ID NO: 3884 - protein, 315 aa, Arabidopsis thaliana
  misc_feature (1)..(315): Ceres CDNA ID no. 36507407
  misc_feature (234)..(293): Pfam Name: DUF623 Pfam Description: Protein of unknown function, DUF623
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
MTKRFKLKISRILSFKSCRLKDPSSLPFNPVSSSLRRTSPLVNSSADVTTVPQRRRSSFRLHVLTVFGCGRSSTPLDVDLRNSPVLSPPQTPTFQWESEGKWHVIAQVTEEEYETPRRKIYNGGSEKDNRRRLKKKEKSNSRRRGSISSAEEETDRESLLPSSTNLSPEYSSSELPRVTRRPRQLLKKAVIEEESESSSPPPSPARLSSFVQRLMPCTMAAAVMVEGVAVVKKSEDPYEDFKGSMMEMIVEKKMFEVAELEQLLSCFLSLNAKRHHRAIVRAFSEIWVALFSGGSGGGRRSSSFSSVRLSDYDEC

SEQ ID NO: 3885 - DNA, 1086 bp, Populus balsamifera subsp. trichocarpa
  misc_feature (1)..(1086): Ceres ANNOT ID no. 1457193
  misc_feature 434707:<222: Transcription Factor
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggctaaacgtttcaggctcaaattctctcgagtgatctcctttcaatcttgccgttccaaagacccttctactctcccatcaaatcctgtcccttcatttcttagactatctccagtcaaccacaactccatcatcatcaacaacctccatctcccaccctcacaaccacctccttccaaacctctccatcactcttccatcaggcgacatgtgtcctcggcattcacatcaatgggctgtgggtttagatcaaaaccctccacacattacctctctgaaaccgaccacaccaaatcctctccaccaactgaaaatttccactgggaagaggaagaaaaatatcacgttgtggccaagctctttgacgacgattcaacaccccgccgcaagatttacaactcttcagcctctgaggactccaaaaaccacgacgtttttctccctccatctaaaatcgagaagaaaaaacgacgagtcaaaaagaagaaaacggcatcaagaatccgcatcagcacttcctcagctgatagcgggatattttttagcggcgacgagcatgtcataaacgacgaagaaacagaaactctagtctcttcttcgaggagcttctccactgattcttcctcggaattcaatccccacttagaaacaatacgtgaatctccattttcacgtaaaaagagagctaagaaggctaaagggcgttgtgttttaaagaatggagcgaaaggaacaacgagaagaggacgaaaggaaagaaatagccgcgatggttctttgtcgcctgcaagattgtcgaggtttcagtggctgataccgtgcacggtggaggggaaggtaagagagagctttgcggtggtgaagagatcagaggacccatatgaggattttaagagatcaatgatggaaatgatactagaaaaggaaatgtttgaagagaaagatttagagcagttgttgcattgtttcttgtctttgaattcaagggagcatcatggggttattgttcaagcttttagtgagatttgggagactttgttttgtagaagaagatctatttcttatagggtttcagctgtttaa

SEQ ID NO: 3886 - protein, 361 aa, Populus balsamifera subsp. trichocarpa
  misc_feature (1)..(361): Ceres ANNOT ID no. 1457193
  misc_feature (291)..(350): Pfam Name: DUF623 Pfam Description: Protein of unknown function, DUF623
  misc_feature 434790:<222: Transcription Factor
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(361): Functional Homolog of  Ceres CDNA ID no. 36507407 at SEQ ID NO. 3931 with e-value of 4.80E-50 and BLAST sequence identity of 52.4
MAKRFRLKFSRVISFQSCRSKDPSTLPSNPVPSFLRLSPVNHNSIIINNLHLPPSQPPPSKPLHHSSIRRHVSSAFTSMGCGFRSKPSTHYLSETDHTKSSPPTENFHWEEEEKYHVVAKLFDDDSTPRRKIYNSSASEDSKNHDVFLPPSKIEKKKRRVKKKKTASRIRISTSSADSGIFFSGDEHVINDEETETLVSSSRSFSTDSSSEFNPHLETIRESPFSRKKRAKKAKGRCVLKNGAKGTTRRGRKERNSRDGSLSPARLSRFQWLIPCTVEGKVRESFAVVKRSEDPYEDFKRSMMEMILEKEMFEEKDLEQLLHCFLSLNSREHHGVIVQAFSEIWETLFCRRRSISYRVSAV

SEQ ID NO: 3887 - DNA, 1077 bp, Populus balsamifera subsp. trichocarpa
  misc_feature (1)..(1077): Ceres ANNOT ID no. 1487854
  misc_feature 434906:<222: Transcription Factor
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atggctaaacgtttcaagttcagattctctcgattgatctcctttcaatcttgccgttccaaagacccctcccctctcccatcaaatcctgttccttcatttcttagactctctccggtcaaccacaactccatcattatcaacaacctccacctcccaccatcacaaccgccttcttccaaaccccatcaacactcctccatcaagcgccatgtgtcctcagctttcacatcaatgggctgtggatttagatcaaaatcctccacgcattccctctctgaaaccgaccacgccaaatcctcacaacaaactgaaaatttccactgggcagaggaagaaaaatatcaccttgtggccaaactctttgatgacgactcaactccccgccgcaaactttacaactcttcggcctctgaggactctaaaaaccacgacgtttttctccctccgactaacatagagaggaaaaaacgacgtgtcaaaaagaagaaaagggcttcaagaatccgcattagcacttcttcagctgatagcgggttattttttaccggcgacgagaatgtcataaacgttgaagaaacggaaactttagtttcttattcaaggagcttctccactgattctccctcagaattcaatccccacttggaaacaatacgtgaatctccatttacacgtaaaaagagaggtaggaaggcgaaaggaggtgttttaaagaaaggaacaacaagaagaggacgaaaggcaagaaatagctgcgatggttcgttgtcgcctgcaagactgtcgaggcttcagtggctgataccgtgcacggtggaggggaaggtaagagagagctttgcagtggtgaagaaatcagaggacccatttgaggattttaagaggtcaatgatggaaatgatattagagaaggaaatgtttgaagagaaagatttggagcagttgctgcactgtttcctttctttgaatttaagggagcatcatggggttattgttcaggcttttagtgagatttgggatactttgttttgtagaagaagaagatccatctcttccagggtttcagctgcttaa

SEQ ID NO: 3888 - protein, 358 aa, Populus balsamifera subsp. trichocarpa
  misc_feature (1)..(358): Ceres ANNOT ID no. 1487854
  misc_feature (287)..(346): Pfam Name: DUF623 Pfam Description: Protein of unknown function, DUF623
  misc_feature 434987:<222: Transcription Factor
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(358): Functional Homolog of  Ceres CDNA ID no. 36507407 at SEQ ID NO. 3931 with e-value of 5.09E-46 and BLAST sequence identity of 49.6
MAKRFKFRFSRLISFQSCRSKDPSPLPSNPVPSFLRLSPVNHNSIIINNLHLPPSQPPSSKPHQHSSIKRHVSSAFTSMGCGFRSKSSTHSLSETDHAKSSQQTENFHWAEEEKYHLVAKLFDDDSTPRRKLYNSSASEDSKNHDVFLPPTNIERKKRRVKKKKRASRIRISTSSADSGLFFTGDENVINVEETETLVSYSRSFSTDSPSEFNPHLETIRESPFTRKKRGRKAKGGVLKKGTTRRGRKARNSCDGSLSPARLSRLQWLIPCTVEGKVRESFAVVKKSEDPFEDFKRSMMEMILEKEMFEEKDLEQLLHCFLSLNLREHHGVIVQAFSEIWDTLFCRRRRSISSRVSAA

SEQ ID NO: 3889 - protein, 313 aa, Arabidopsis thaliana
  misc_feature (1)..(313): Ceres CDNA ID no. 36508177
  misc_feature: Phenotype: INFLORESCENCE - Late Flowering Useful for modulating flowering time
  misc_feature: Phenotype: ROSETTE LEAVES - Short Petioles Useful for modulating plant size
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
MRCKRHTVDFSSSIGVCASCLRERLFTLAVSTAASENDDNDHRHSRISPPPLLFPRSVSPYVAPRKSDAGTGTGAGGRDSVASSNNRFFATPQVVVQSSSSEKVFESDRSFKKKKSGLSRFSSFFRTRSDDYDSRRDSCDASTVFSQPSSATTSRSWFSKVISVRSKKQSTTNTCYIEDLIASESDHHHHNQNRPRQRYCRGMSPAGDSTTNDESVEESPGRLRRTPVMGTPGRKKTATIGIGRSVSGMAFCLSPLVRAKPNCSSNWKAKFPPDFGYSGELKSPAKPHLSTAASFCGNRSKKLVDLGRVDHRR

SEQ ID NO: 3890 - protein, 162 aa, Arabidopsis thaliana
  misc_feature (1)..(162): Ceres CDNA ID no. 36509475
  misc_feature (37)..(146): Pfam Name: Auxin_inducible Pfam Description: Auxin responsive protein
  misc_feature: Phenotype: INFLORESCENCE - Late Flowering Useful for modulating flowering time
  misc_feature: Phenotype: ROSETTE LEAVES - Lanceolate Shaped Useful for making plants with increased biomass and foliage
MRKIIGFRIGRRVSRWIFRKTRIQRSGYNRIHSTQQACMLMRPLAKLKSWGQRLKQSFRRRSTRRSAYIPVDHKKADPVPRGHLAIYVGQKDGDCHRVLVPIVYFNHPLFGELLREAEKEYGFCHEGGITIPCLYSDFERVKTRIASGSSSRVFPWGRHCRN

SEQ ID NO: 3891 - DNA, 516 bp, Populus balsamifera subsp. trichocarpa
  misc_feature (1)..(516): Ceres ANNOT ID no. 1497025
  misc_feature 435274:<222: Transcription Factor
  misc_feature: Phenotype: INFLORESCENCE - Late Flowering Useful for modulating flowering time
  misc_feature: Phenotype: ROSETTE LEAVES - Lanceolate Shaped Useful for making plants with increased biomass and foliage
atgagaaagaatagaggtttcaagatcggcaaacggtttgtccggatctcaacttggatcttcagtcggacgcggatccacccaccgggttgcaactccataggcccatcagaatcaacatgcagttcgaagtcaaagtccttatcgaaaatcatcaattggggccgtcgtttaacaaaaggagctaaatcaatttgcagtgcaaaaccccggtcgggttatatacccgtgggtcatgaaccggtttgtgataaacctgttccagtaccaaaagggcatttggctgtttatgtgggtcaaaaagatggtgagtttcatagagttttggtgcctttgatttattttaatcaccctttgtttggtgaattattaagagaagcagaagaggaatatggttttaatcaacaaggtgggattaccattccttgccggttttcggagtttgagagggtccaaacccggattaaatcggggtcatgtggaaggaagctgacgtggaaacgtaaccaccattga

SEQ ID NO: 3892 - protein, 171 aa, Populus balsamifera subsp. trichocarpa
  misc_feature (1)..(171): Ceres ANNOT ID no. 1497025
  misc_feature (54)..(156): Pfam Name: Auxin_inducible Pfam Description: Auxin responsive protein
  misc_feature: SWISSPROT Homolog: AX10A_SOYBN Auxin-induced protein X10A with e-value of 7.8e-12 and BLAST sequence identity of 43.1
  misc_feature: SWISSPROT Homolog: A10A5_SOYBN Auxin-induced protein 10A5 with e-value of 1.0e-11 and BLAST sequence identity of 41.0
  misc_feature: SWISSPROT Homolog: AXX15_SOYBN Auxin-induced protein X15 with e-value of 1.0e-11 and BLAST sequence identity of 42.1
  misc_feature: SWISSPROT Homolog: AX6B_SOYBN Auxin-induced protein 6B with e-value of 1.6e-11 and BLAST sequence identity of 38.4
  misc_feature: SWISSPROT Homolog: AX15A_SOYBN Auxin-induced protein 15A with e-value of 2.1e-11 and BLAST sequence identity of 45.5
  misc_feature 435365:<222: Transcription Factor
  misc_feature: Phenotype: INFLORESCENCE - Late Flowering Useful for modulating flowering time
  misc_feature: Phenotype: ROSETTE LEAVES - Lanceolate Shaped Useful for making plants with increased biomass and foliage
  misc_feature (1)..(171): Functional Homolog of  Ceres CDNA ID no. 36509475 at SEQ ID NO. 3937 with e-value of 4.09E-44 and BLAST sequence identity of 58.4
MRKNRGFKIGKRFVRISTWIFSRTRIHPPGCNSIGPSESTCSSKSKSLSKIINWGRRLTKGAKSICSAKPRSGYIPVGHEPVCDKPVPVPKGHLAVYVGQKDGEFHRVLVPLIYFNHPLFGELLREAEEEYGFNQQGGITIPCRFSEFERVQTRIKSGSCGRKLTWKRNHH

SEQ ID NO: 3893 - protein, 209 aa, Arabidopsis thaliana
  misc_feature (1)..(209): Ceres CDNA ID no. 36510272
  misc_feature (20)..(140): Pfam Name: Flavoprotein Pfam Description: Flavoprotein
  misc_feature: Phenotype: INFLORESCENCE - Late Flowering Useful for modulating flowering time
  misc_feature: Phenotype: ROSETTE LEAVES - Long Petioles Useful for making plants that grow better in shade
MENGKRDRQDMEVNTTPRKPRVLLAASGSVAAIKFGNLCHCFTEWAEVRAVVTKSSLHFLDKLSLPQEVTLYTDEDEWSSWNKIGDPVLHIELRRWADVLVIAPLSANTLGKIAGGLCDNLLTCIIRAWDYTKPLFVAPAMNTLMWNNPFTERHLLSLDELGITLIPPIKKRLACGDYGNGAMAEPSLIYSTVRLFWESQAHQQTGGTS

SEQ ID NO: 3894 - DNA, 654 bp, Populus balsamifera subsp. trichocarpa
  misc_feature (1)..(654): Ceres ANNOT ID no. 1473760
  misc_feature 435515:<222: Transcription Factor
  misc_feature: Phenotype: INFLORESCENCE - Late Flowering Useful for modulating flowering time
  misc_feature: Phenotype: ROSETTE LEAVES - Long Petioles Useful for making plants that grow better in shade
atggaatactcggaacctgtgacagcagagatggagacagcacaggttaatgctgtcgccgcggccgccggtcctaggaaacctaggattctactagcggcaagtgggagtgtagctgctattaaatttgggaatctttgtcattgtttttctgaatgggctgaagtgaaagcggttgctactagggcttctttgcatttcattgatagagctgcattgcctaaggatgttgtgctctacactgacgaggatgaatggtcgagttggaataagataggagatactgtgcttcatattgagttaagacggtgggctgatatcatggttattgctcctttatctgctaatacgcttggcaagattgctggggggttgtgtgacaatctgctgacctgcattgtccgagcatgggattacagcaagccactttttgttgcgccggctatgaacactttcatgtggagcaaccctttcacagaacggcatctcatgtcaattgatgagcttggaatttccttgatcccacctgtttcaaagaggctggcatgtggagattatgggaatggtgcaatggctgaaccttctctaatctactcaactgtaagactattcttggagtcacggagtcaagccggtgatagaagagttggttaa

SEQ ID NO: 3895 - protein, 207 aa, Populus balsamifera subsp. trichocarpa
  misc_feature (1)..(207): Ceres ANNOT ID no. 1473760
  misc_feature (18)..(138): Pfam Name: Flavoprotein Pfam Description: Flavoprotein
  misc_feature: SWISSPROT Homolog: HAL3A_ARATH Phosphopantothenoylcysteine decarboxylase (EC 4.1.1.36) (Halotolerance protein Hal3a) (AtHal3a) (PPCDC) (AtCoaC) with e-value of 4.9e-113 and BLAST sequence identity of 100.0
  misc_feature: SWISSPROT Homolog: HAL3B_ARATH Probable phosphopantothenoylcysteine decarboxylase (EC 4.1.1.36) (Halotolerance protein Hal3b) (AtHal3b) with e-value of 4.0e-95 and BLAST sequence identity of 86.5
  misc_feature: SWISSPROT Homolog: COAC_MOUSE Phosphopantothenoylcysteine decarboxylase (EC 4.1.1.36) (PPC-DC) (CoaC) with e-value of 4.2e-45 and BLAST sequence identity of 50.5
  misc_feature: SWISSPROT Homolog: COAC_HUMAN Phosphopantothenoylcysteine decarboxylase (EC 4.1.1.36) (PPC-DC) (CoaC) with e-value of 3.7e-44 and BLAST sequence identity of 48.7
  misc_feature: SWISSPROT Homolog: YKI8_YEAST Hypothetical protein YKL088w with e-value of 3.6e-32 and BLAST sequence identity of 42.4
  misc_feature 435614:<222: Transcription Factor
  misc_feature: Phenotype: INFLORESCENCE - Late Flowering Useful for modulating flowering time
  misc_feature: Phenotype: ROSETTE LEAVES - Long Petioles Useful for making plants that grow better in shade
  misc_feature (1)..(207): Functional Homolog of  Ceres CDNA ID no. 36510272 at SEQ ID NO. 3940 with e-value of 1.00E-88 and BLAST sequence identity of 84.8
METAQVNAVAAAAGPRKPRILLAASGSVAAIKFGNLCHCFSEWAEVKAVATRASLHFIDRAALPKDVVLYTDEDEWSSWNKIGDTVLHIELRRWADIMVIAPLSANTLGKIAGGLCDNLLTCIVRAWDYSKPLFVAPAMNTFMWSNPFTERHLMSIDELGISLIPPVSKRLACGDYGNGAMAEPSLIYSTVRLFLESRSQAGDRRVG

SEQ ID NO: 3896 - protein, 534 aa, Arabidopsis thaliana
  misc_feature (1)..(534): Ceres CDNA ID no. 36512904
  misc_feature (67)..(528): Pfam Name: p450 Pfam Description: Cytochrome P450
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: INFLORESCENCE - Short Useful for modulating plant height
  misc_feature: Phenotype: ROSETTE LEAVES - Glossy Useful for making plants with enhanced abiotic stress tolerance
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
MATKLDTSSLLLALLSKCSLLTQTNLALSLLVASLASLALSLFFWSHPGGPAWGKYFLHRRRQTTVIPGPRGLPFVGSMSLMSNTLAHRCIAATAEKFRAERLMAFSLGETRVIVTCNPDVAKEILNSPVFADRPVKESAYSLMFNRAIGFAPYGVYWRTLRKIASNHLFSPKQIKRSETQRSVIANQIVKCLTKQSNTKGLCFARDLIKTASLNNMMCSVFGKEYELEEEHEEVSELRELVEEGYDLLGTLNWTDHLPWLSEFDPQRIRSRCSNLVPKVNRFVNRIISDHREQTRDSPSDFVDVLLSLDGPDKLSDPDIIAVLWEMIFRGTDTVAVLIEWILARMVLHPDIQSTVHNELDQIVGRSRAVEESDVVSLVYLTAVVKEVLRLHPPGPLLSWARLAITDTIIDGRRVPAGTTAMVNMWAIAHDPHVWENPLEFKPERFVAKEGEVEFSVLGSDLRLAPFGSGRRVCPGKNLGLTTVTFWTATLLHEFEWLTPSDEKTVDLSEKLRLSCEMANPLAAKLRPRRSFSV

SEQ ID NO: 3897 - DNA, 1608 bp, Populus balsamifera subsp. trichocarpa
  misc_feature (1)..(1608): Ceres ANNOT ID no. 1471370
  misc_feature 435886:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: INFLORESCENCE - Short Useful for modulating plant height
  misc_feature: Phenotype: ROSETTE LEAVES - Glossy Useful for making plants with enhanced abiotic stress tolerance
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atgagaacagacatagatagcttctggatctttgctttggcctccaaatgcagagcctttacacaagaaaatattgcatggtcacttttgatcattggtttagcctggatagttgttaccctgatttactgggcataccctggtggtccagcttggggaaaatataaactcaaaaatacttccttgacaatttctaatccaattccaggtcccaggggattccccattaccggcagcatgaagcttatgacctccttagcacatcacaagattgcagctgctgcagatgcatgcaaagccaggaggctcatggcgtttagccttggtgatactcgtgttatcgtgacatgcaatcctgatgtcgctaaagaaatattgaacagctcggtgtttgcagatcgtccagttaaagaatctgcttatagcctaatgttcaatagagcaatcgggttcgctccttatggtgtctattggcgaacccttagaaaaatagcttctacacaccttttctgccccaagcaaatcaaagctgccgagtctcaaaggctccaaattgcttctcaaatggtgtcaacgttcaatgaccgagaaaagagcagtttcagcgttcgtgaggtccttaaaagagcttcacttaacaacatgatgtgttcagtttttggacgcgaatataaattggattcatttaataatgaagttgaagagctaagagctctagttgaagaggggtacgatttattgggtacacttaactggagtgaccaccttccttggctggcagattttgaccctcaaaaaatccggttcagatgctcaaatctcgtgccaaaagtgaaccggtttgtcagccgaattatagctgaacacagagctctaaccagaagtgaaaacccagatttcgttgatgttttgttgtctctccaaggccacgataaattatcggactccgatatgattgccgtcctttgggaaatgattttcagagggactgatacagtggcggttttgattgagtggattctagcgagaatggtgcttcatcctgatgttcaatcaaaggtccacgatgagctttacaaagttgttggaagatcaagggccgttgctgaatctgatatcacggccatggtgtatctccaggcagtggtgaaggaagtgttgaggctacacccacctggcccacttctctcgtgggccaggctagccatcaccgatacaaccattgatgggtatcacgtgccgaaagggaccacagcaatggttaacatgtgggccatttcaagggacccagagttttgggaggacccacttgaatttatgcccgagagattcgtcgtgactaaggaggatgtgttggagttttctgttctcggctcggatcttaggcttgctccgtttggttccggtaggcggacttgccctggaaagacattgggcataaccacggtgaccttctgggttgcatcactgttacacgagtatgaatgggtgccgggtgaagaaaacaacgttgacctatcagaagtattgcgactgtcctgtgagatggcgaatccattgaccgttaaagtgcggcccaggcgttcctcccaaagccctctgtactag

SEQ ID NO: 3898 - protein, 535 aa, Populus balsamifera subsp. trichocarpa
  misc_feature (1)..(535): Ceres ANNOT ID no. 1471370
  misc_feature (68)..(501): Pfam Name: p450 Pfam Description: Cytochrome P450
  misc_feature: SWISSPROT Homolog: C78A3_SOYBN Cytochrome P450 78A3 (EC 1.14.-.-) with e-value of 1.6e-185 and BLAST sequence identity of 66.2
  misc_feature: SWISSPROT Homolog: C78A4_PINRA Cytochrome P450 78A4 (EC 1.14.-.-) with e-value of 3.5e-144 and BLAST sequence identity of 54.9
  misc_feature: SWISSPROT Homolog: C78AB_ORYSA Cytochrome P450 78A11 (EC 1.14.-.-) (PLASTOCHRON1 protein) with e-value of 3.0e-129 and BLAST sequence identity of 48.8
  misc_feature: SWISSPROT Homolog: C78A1_MAIZE Cytochrome P450 78A1 (EC 1.14.-.-) (CYPLXXVIII) with e-value of 2.3e-122 and BLAST sequence identity of 47.3
  misc_feature: SWISSPROT Homolog: F3PH_ARATH Flavonoid 3'-monooxygenase EC 1.14.13.21(Flavonoid 3'-hydroxylase) (AtF3'H) (Cytochrome P450 75B1) (TRANSPARENT TESTA 7 protein) with e-value of 2.0e-70 and BLAST sequence identity of 35.4
  misc_feature 436074:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: INFLORESCENCE - Short Useful for modulating plant height
  misc_feature: Phenotype: ROSETTE LEAVES - Glossy Useful for making plants with enhanced abiotic stress tolerance
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(535): Functional Homolog of  Ceres CDNA ID no. 36512904 at SEQ ID NO. 3943 with e-value of 1.20E-202 and BLAST sequence identity of 73.0
MRTDIDSFWIFALASKCRAFTQENIAWSLLIIGLAWIVVTLIYWAYPGGPAWGKYKLKNTSLTISNPIPGPRGFPITGSMKLMTSLAHHKIAAAADACKARRLMAFSLGDTRVIVTCNPDVAKEILNSSVFADRPVKESAYSLMFNRAIGFAPYGVYWRTLRKIASTHLFCPKQIKAAESQRLQIASQMVSTFNDREKSSFSVREVLKRASLNNMMCSVFGREYKLDSFNNEVEELRALVEEGYDLLGTLNWSDHLPWLADFDPQKIRFRCSNLVPKVNRFVSRIIAEHRALTRSENPDFVDVLLSLQGHDKLSDSDMIAVLWEMIFRGTDTVAVLIEWILARMVLHPDVQSKVHDELYKVVGRSRAVAESDITAMVYLQAVVKEVLRLHPPGPLLSWARLAITDTTIDGYHVPKGTTAMVNMWAISRDPEFWEDPLEFMPERFVVTKEDVLEFSVLGSDLRLAPFGSGRRTCPGKTLGITTVTFWVASLLHEYEWVPGEENNVDLSEVLRLSCEMANPLTVKVRPRRSSQSPLY

SEQ ID NO: 3899 - DNA, 1635 bp, Populus balsamifera subsp. trichocarpa
  misc_feature (1)..(1635): Ceres ANNOT ID no. 1444471
  misc_feature 436272:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: INFLORESCENCE - Short Useful for modulating plant height
  misc_feature: Phenotype: ROSETTE LEAVES - Glossy Useful for making plants with enhanced abiotic stress tolerance
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
atgagaacagacatagataacttctggatctttgctttggcctccaaatgcagagtctttacacaagaaaatattgcatggtcgcttttgatcatgggtttagcttggatagccactacccttatttactgggcataccctggtggtcctgcttggggcaaatacaaactcaaaaacacttccttcacaatttctaagccaattccaggtcccaggggattgcctcttataggcggcatgaggcttatgacctccttagcacatcacaagattgcagcggctgcagatgcatgcaaagccaggaggctcatggcgtttagccttggtgatactcgtgttatcgtgacatgcaatcctgatgtggctaaagaaatactgaacagttcggtgtttgcagatcgtccagttaaagaatctgcttatagcctaatgttcaatagagcaattgggttcgctccttatggtgtttactggcgaacccttagaaaaatagcttctacacaccttttctgccccaaacaaatcaaaactgcggcgtctcaaagacgccgaattgcttctgaaacggtgtccatgttcaatgaccatgaagggagtggtttcaccgttcgtgggatactcaagagagcttcacttaataacatgatgtgctcagtttttggacgcgagtatgaattggattcatgtaatagtgaagttgaagaactgagagctctagttgatgaagggtacgatttattgggtacacttaactggaccgaccaccttccttggctggcggattttgaccctcaaaaaatccgattcagatgctcaaatctcgtgccaaaagtgaaccggtttgtcagccgaatcctggctgagcatagagctcaagctggaaatgaaaccccggatttcgttgatgttttgctgtctcttcaaggccacgataaattatcggactccgatatgattgccgtcctttgggaaatgattttcaggggcactgatacggtggcagttttgatggagtggattctagctagaatggtacttcatcctgatgttttatcaaaggtccatgatgagcttgacaaagttgttggaagatcaagggccgtagctgaatctgatatcacggcaatggtgtatctccaggcagcagtgaaggaagtgttgaggctacacccacctggtccacttctctcgtgggccaggcttgccatcactgatacaaccatagatgggtatcacgtgcctaaagggaccacagcaatggttaacatgtgggccatttcaagggacccagattcttgggaggacccgcttgaatttatgcctgagagattcgtgactaagaagggtgagctggagttttctgttcttgggtcggatctaaggcttgctccgtttggttccggtaggcgaacctgcccgggaaagacattgggcttaactacggtgaccttttgggttgcgtcactactacacgagtatgaatggctgccgtgcgatggaaataaagttgacctatcagaagtactgggtctgtcctgtgagatggcaaatccattgaccgttaaactgcggcccaggcgttcccattataagcccactgtactaggtgtacagaactacgtactagatgtctag

SEQ ID NO: 3900 - protein, 544 aa, Populus balsamifera subsp. trichocarpa
  misc_feature (1)..(544): Ceres ANNOT ID no. 1444471
  misc_feature (68)..(523): Pfam Name: p450 Pfam Description: Cytochrome P450
  misc_feature: SWISSPROT Homolog: C78A3_SOYBN Cytochrome P450 78A3 (EC 1.14.-.-) with e-value of 1.6e-185 and BLAST sequence identity of 66.2
  misc_feature: SWISSPROT Homolog: C78A4_PINRA Cytochrome P450 78A4 (EC 1.14.-.-) with e-value of 3.5e-144 and BLAST sequence identity of 54.9
  misc_feature: SWISSPROT Homolog: C78AB_ORYSA Cytochrome P450 78A11 (EC 1.14.-.-) (PLASTOCHRON1 protein) with e-value of 3.0e-129 and BLAST sequence identity of 48.8
  misc_feature: SWISSPROT Homolog: C78A1_MAIZE Cytochrome P450 78A1 (EC 1.14.-.-) (CYPLXXVIII) with e-value of 2.3e-122 and BLAST sequence identity of 47.3
  misc_feature: SWISSPROT Homolog: F3PH_ARATH Flavonoid 3'-monooxygenase EC 1.14.13.21(Flavonoid 3'-hydroxylase) (AtF3'H) (Cytochrome P450 75B1) (TRANSPARENT TESTA 7 protein) with e-value of 2.0e-70 and BLAST sequence identity of 35.4
  misc_feature 436462:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: INFLORESCENCE - Short Useful for modulating plant height
  misc_feature: Phenotype: ROSETTE LEAVES - Glossy Useful for making plants with enhanced abiotic stress tolerance
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(544): Functional Homolog of  Ceres CDNA ID no. 36512904 at SEQ ID NO. 3943 with e-value of 8.59E-202 and BLAST sequence identity of 72.4
MRTDIDNFWIFALASKCRVFTQENIAWSLLIMGLAWIATTLIYWAYPGGPAWGKYKLKNTSFTISKPIPGPRGLPLIGGMRLMTSLAHHKIAAAADACKARRLMAFSLGDTRVIVTCNPDVAKEILNSSVFADRPVKESAYSLMFNRAIGFAPYGVYWRTLRKIASTHLFCPKQIKTAASQRRRIASETVSMFNDHEGSGFTVRGILKRASLNNMMCSVFGREYELDSCNSEVEELRALVDEGYDLLGTLNWTDHLPWLADFDPQKIRFRCSNLVPKVNRFVSRILAEHRAQAGNETPDFVDVLLSLQGHDKLSDSDMIAVLWEMIFRGTDTVAVLMEWILARMVLHPDVLSKVHDELDKVVGRSRAVAESDITAMVYLQAAVKEVLRLHPPGPLLSWARLAITDTTIDGYHVPKGTTAMVNMWAISRDPDSWEDPLEFMPERFVTKKGELEFSVLGSDLRLAPFGSGRRTCPGKTLGLTTVTFWVASLLHEYEWLPCDGNKVDLSEVLGLSCEMANPLTVKLRPRRSHYKPTVLGVQNYVLDV

SEQ ID NO: 3901 - DNA, 1599 bp, Populus balsamifera subsp. trichocarpa; identical to SEQ ID NO: 3690
  misc_feature (1)..(1599): Ceres ANNOT ID no. 1491278
  misc_feature 436663:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: INFLORESCENCE - Short Useful for modulating plant height
  misc_feature: Phenotype: ROSETTE LEAVES - Glossy Useful for making plants with enhanced abiotic stress tolerance
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage

SEQ ID NO: 3902 - protein, 532 aa, Populus balsamifera subsp. trichocarpa; identical to SEQ ID NO: 3691
  misc_feature (1)..(532): Ceres ANNOT ID no. 1491278
  misc_feature (69)..(529): Pfam Name: p450 Pfam Description: Cytochrome P450
  misc_feature: SWISSPROT Homolog: C78A3_SOYBN Cytochrome P450 78A3 (EC 1.14.-.-) with e-value of 1.6e-185 and BLAST sequence identity of 66.2
  misc_feature: SWISSPROT Homolog: C78A4_PINRA Cytochrome P450 78A4 (EC 1.14.-.-) with e-value of 3.5e-144 and BLAST sequence identity of 54.9
  misc_feature: SWISSPROT Homolog: C78AB_ORYSA Cytochrome P450 78A11 (EC 1.14.-.-) (PLASTOCHRON1 protein) with e-value of 3.0e-129 and BLAST sequence identity of 48.8
  misc_feature: SWISSPROT Homolog: C78A1_MAIZE Cytochrome P450 78A1 (EC 1.14.-.-) (CYPLXXVIII) with e-value of 2.3e-122 and BLAST sequence identity of 47.3
  misc_feature: SWISSPROT Homolog: F3PH_ARATH Flavonoid 3'-monooxygenase EC 1.14.13.21(Flavonoid 3'-hydroxylase) (AtF3'H) (Cytochrome P450 75B1) (TRANSPARENT TESTA 7 protein) with e-value of 2.0e-70 and BLAST sequence identity of 35.4
  misc_feature 436851:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: INFLORESCENCE - Short Useful for modulating plant height
  misc_feature: Phenotype: ROSETTE LEAVES - Glossy Useful for making plants with enhanced abiotic stress tolerance
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(532): Functional Homolog of  Ceres CDNA ID no. 36512904 at SEQ ID NO. 3943 with e-value of 2.39E-190 and BLAST sequence identity of 69.1

SEQ ID NO: 3903 - DNA, 1596 bp, Populus balsamifera subsp. trichocarpa; identical to SEQ ID NO: 3688
  misc_feature (1)..(1596): Ceres ANNOT ID no. 1447690
  misc_feature 437049:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: INFLORESCENCE - Short Useful for modulating plant height
  misc_feature: Phenotype: ROSETTE LEAVES - Glossy Useful for making plants with enhanced abiotic stress tolerance
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage

SEQ ID NO: 3904 - protein, 531 aa, Populus balsamifera subsp. trichocarpa; identical to SEQ ID NO: 3689
  misc_feature (1)..(531): Ceres ANNOT ID no. 1447690
  misc_feature (68)..(526): Pfam Name: p450 Pfam Description: Cytochrome P450
  misc_feature: SWISSPROT Homolog: C78A3_SOYBN Cytochrome P450 78A3 (EC 1.14.-.-) with e-value of 1.6e-185 and BLAST sequence identity of 66.2
  misc_feature: SWISSPROT Homolog: C78A4_PINRA Cytochrome P450 78A4 (EC 1.14.-.-) with e-value of 3.5e-144 and BLAST sequence identity of 54.9
  misc_feature: SWISSPROT Homolog: C78AB_ORYSA Cytochrome P450 78A11 (EC 1.14.-.-) (PLASTOCHRON1 protein) with e-value of 3.0e-129 and BLAST sequence identity of 48.8
  misc_feature: SWISSPROT Homolog: C78A1_MAIZE Cytochrome P450 78A1 (EC 1.14.-.-) (CYPLXXVIII) with e-value of 2.3e-122 and BLAST sequence identity of 47.3
  misc_feature: SWISSPROT Homolog: F3PH_ARATH Flavonoid 3'-monooxygenase EC 1.14.13.21(Flavonoid 3'-hydroxylase) (AtF3'H) (Cytochrome P450 75B1) (TRANSPARENT TESTA 7 protein) with e-value of 2.0e-70 and BLAST sequence identity of 35.4
  misc_feature 437237:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: INFLORESCENCE - Strong Useful for making stronger plants
  misc_feature: Phenotype: INFLORESCENCE - Tall Useful for making taller plants and plants with longer inflorescences
  misc_feature: Phenotype: INFLORESCENCE - Short Useful for modulating plant height
  misc_feature: Phenotype: ROSETTE LEAVES - Glossy Useful for making plants with enhanced abiotic stress tolerance
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(531): Functional Homolog of  Ceres CDNA ID no. 36512904 at SEQ ID NO. 3943 with e-value of 1.70E-189 and BLAST sequence identity of 68.8

SEQ ID NO: 3905 - protein, 426 aa, Arabidopsis thaliana
  misc_feature (1)..(426): Ceres CDNA ID no. 36514446
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
MLQHQIVQSPARLGLTGPGSPSVQNPTPTRHGHPTSSSSSQSQHQQIQQQPNLLPSSTVAAASSASASAAVSSSALLSLLPPLPRAQALLQQMAVLTSKLFDVSPNRAIWLSAFRGSLPSFLSSHSLPPPPPLENPSPSSTKEILSQFNSLQTQLFEAVTELQEILDLQDAKQKVAREIKSKDSSLLAFANKLKDAERVLDMLVDDYSDYRKPKRSKIEEDDEDNDNESSSSSTTVSSQLKLKDILAYAHKISYTTFAPPEFGAGQAPLRGALPPAPQDEQMRASQLYTFADLDIGLPKTVENMEKKVEALIEPPPPPEAMDISAIHNLLPPNIAVPSGWKPGMPVELPRDLPLPPPGWKPGDPVVLPPLESIAAPRAEDHQHMRPSQGLHRPPDVIQVRAVQLDILEDDDSSDYSSDDASSDDED

SEQ ID NO: 3906 - DNA, 1194 bp, Populus balsamifera subsp. trichocarpa
  misc_feature (1)..(1194): Ceres ANNOT ID no. 1475322
  misc_feature 437552:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
atgcatcagcaccaaattgtacaatcgccggccagattaggcctaacaaacccaacttctccttctctcccagtccaaaccccaaatcctcctcctcccaaatttcccaaccctcaacccccgcagcaccaccacccgtccaccaccaccaccaccaccaccacctcctcagctctcctctctcttctcccacctctccccagagcccaatctctcctcctccaaatggcttctttagccaccaaactcttcgaactctcccctaaccgtccccactggctttccgcctatcgcggaacactcccaacttttcttccgtcacaatcccaatcactggacgaacccactcctacttctaccaaagaaattatctccctctttacttcccttcaaacccaactctttgaatccgtcgccgaacttcaggaaatccttgatctccaagattccaagcaaaggatttcccaggaaatcaaatctaaagactctgcgcttcttaattttgctaataaattgaaagaagctgagagagttcttgatattttagttgatgattatgctgattatcgccgccgccgccctatccctcctaatgaagaagaagaaaatgctactaacaccactactgttgcttctcaattgaagttatctgatattttgtcatatgcgcatcgtattagttatactacatttgctccgccggaatttggtgctggacaggcaccattgcgtggggcgctacctcctgctcctcaggaagagcaaatgagagcttcccagttgtataattttgctcatcttgatgttgggttgcctaaagatgttgaaactaaggagaagacaattgaggcaattattgagccacaacacgaagctaatccgcttgagaatttggcaggcctgtttcctccaaatatttctgttccggcagggtggaaacctgggatgcctgtggttttgccaacagatttaccagtgccgccacctggatggaagcctggggatccagtgtcattggactctattccattgcctagagctgtggaacagaagttgccacctattgctcctcaaggattgcataagccaccagagactatacaggttcggcacgtggagctggatattccggatcaggatgatgatagtagtgattatagtagtgatgtggaaagctctgatgatgaggattga

SEQ ID NO: 3907 - protein, 397 aa, Populus balsamifera subsp. trichocarpa
  misc_feature (1)..(397): Ceres ANNOT ID no. 1475322
  misc_feature 437631:<222: Transcription Factor
  misc_feature: Phenotype: WHOLE PLANT - Dark Green Useful for increasing chlorophyll and photosynthetic capacity
  misc_feature: Phenotype: WHOLE PLANT - Small Useful for modulating plant size
  misc_feature: Phenotype: ROSETTE LEAVES - Lanceolate Shaped Useful for making plants with increased biomass and foliage
  misc_feature (1)..(397): Functional Homolog of  Ceres CDNA ID no. 36514446 at SEQ ID NO. 3952 with e-value of 1.79E-128 and BLAST sequence identity of 69.1
MHQHQIVQSPARLGLTNPTSPSLPVQTPNPPPPKFPNPQPPQHHHPSTTTTTTTTSSALLSLLPPLPRAQSLLLQMASLATKLFELSPNRPHWLSAYRGTLPTFLPSQSQSLDEPTPTSTKEIISLFTSLQTQLFESVAELQEILDLQDSKQRISQEIKSKDSALLNFANKLKEAERVLDILVDDYADYRRRRPIPPNEEEENATNTTTVASQLKLSDILSYAHRISYTTFAPPEFGAGQAPLRGALPPAPQEEQMRASQLYNFAHLDVGLPKDVETKEKTIEAIIEPQHEANPLENLAGLFPPNISVPAGWKPGMPVVLPTDLPVPPPGWKPGDPVSLDSIPLPRAVEQKLPPIAPQGLHKPPETIQVRHVELDIPDQDDDSSDYSSDVESSDDED

SEQ ID NO: 3908 - protein, 481 aa, Arabidopsis thaliana
  misc_feature (1)..(481): Ceres CDNA ID no. 36521407
  misc_feature (158)..(183): Pfam Name: zf-CCCH Pfam Description: Zinc finger C-x8-C-x5-C-x3-H type (and similar)
  misc_feature (230)..(296): Pfam Name: RRM_1 Pfam Description: RNA recognition motif. (a.k.a. RRM RBD, or RNP domain)
  misc_feature: Phenotype: INFLORESCENCE - Short Useful for modulating plant height
  misc_feature: Phenotype: INFLORESCENCE - Other Useful for making ornamental plants with modified flowers
MAHRILRDHEADGWERSDFPIICESCLGDNPYVRMTKANYDKECKICTRPFTVFRWRPGRDARYKKTEICQTCCKLKNVCQVCLLDLEYGLPVQVRDTALNISTHDSIPKSDVNREYFAEEHDRKARAGLDYESSFGKMRPNDTILKLQRTTPYYKRNRAHVCSFFIRGECTRGAECPYRHEMPETGELSQQNIKDRYYGVNDPVAMKLLGKAGEMGTLESPDDESIKTLYVGGLNSRILEQDIRDQFYAHGEIESIRILADKACAFVTYTSREGAEKAAQELSNRLVINGQRLKLTWGRPKPDQDGANQQGGVAHSGLLPRAVISQQHNQPPPMQQYYMHPPPANQDKPYYPSMDPQRMGAVISTQEAGGSSTENNGASSSSYMMPPHQSYPPPPYGYMPSPYQQQYPPNHHHQPSPMQHYAPPPAAYPYPQQPGPGSRPAPSPTAVSAISPDSAPAGSGAPSGSSQQAPDVSTATGSSQ

SEQ ID NO: 3909 - DNA, 1596 bp, Populus balsamifera subsp. trichocarpa
  misc_feature (1)..(1596): Ceres ANNOT ID no. 1514988
  misc_feature 437888:<222: Transcription Factor
  misc_feature: Phenotype: INFLORESCENCE - Short Useful for modulating plant height
  misc_feature: Phenotype: INFLORESCENCE - Other Useful for making ornamental plants with modified flowers
atggcgcacaggttgttaaaagacccggaggctgacggatgggaacggtctgactttcctatcatttgcgagtcttgcttaggtgacaatccctatgtcagaatgaccagagctgacttcgataaggaatgcaagatatgtactcgaccatttacagtgtttaggtggaggcctggcagggatgcgagatttaaaaagactgaagtttgccagacttgcagtaagttgaaaaatgtttgtcaagtctgtcttttggatctagagtatggtttgcctgttcaagttcgtgatactgctctcagtataaattccaacgatgctattccaaagagtgatgtgaatagagagtattttgccgaggagcatgaccgaagggctagggcgggaattgattatgaatcttcatatggaaaggcacaagcaaatgatactattctgaagcttcaaagaacaacaccatactacaaaagaaatcgagcacatgtttgtagcttctttgcacgtggtgaatgcacacgaggtgccgagtgcccctataggcatgagatgcccataactggggagttgtcacaacaaaatattaaagatcgttactatggagtgaatgatcctgtggcaatgaagctactcaacaaggctggagacatgccgtcattagaaccaccagaggatgaaagcattaaaacgctctatgtaggtgggcttgatgcgaggatcaatgagcaggacctaagggatcagttttatgctcatggcgaaattgaatccataaaaatggtgcctcaaagagcaattgcttttgtaacctacacaaccagagaaggagcagaaaaggccgcagcggagctctctaacaggctagtcatcaagggtctgcgtctgaaattgatgtggggtagaccgcaagcaccaaaacctgagtcggaaagttctgatgaagcaaggcagcaggcagcaatggcccatagtgggatgttgccccgtgcagttgtatctcagcaacacaaccacttaaatccaccaggcacccaggaccaacatcctccaatgcactacttcaatattcccccaccacctcagcaagaacgagcattttacccgtcaatggatcctcaaagaatgggtgcccttgttggatcccaagacggtactcctaatgggcctgcaggatcaggtgagaataaatctggattggagaagcagctcgggcagcactatccatatcaaagtatgccaccacctcacgtgcaataccaacaacaataccaacaacaacattatccagcatatggttatatgccgccagtgccaccgtatcagcagtatcctctgccatatcacactcctgtgcctcccccacaggtggtgcaatccacacagcagtatcagcatcgtgtgccaccgccaatgtctgcacctgcagagtccatgacctcattgcccccacctcagggatcccgagcacctgcagggtccatgccctctggacccccacctcagggatctgaagcacctgctgggtctaaaccctccggcccaccatctcctagacctggagaacctgaagaatctaaaccctcagggcccccaccttaa

SEQ ID NO: 3910 - protein, 531 aa, Populus balsamifera subsp. trichocarpa
  misc_feature (1)..(531): Ceres ANNOT ID no. 1514988
  misc_feature (158)..(183): Pfam Name: zf-CCCH Pfam Description: Zinc finger C-x8-C-x5-C-x3-H type (and similar)
  misc_feature (230)..(296): Pfam Name: RRM_1 Pfam Description: RNA recognition motif. (a.k.a. RRM RBD, or RNP domain)
  misc_feature: SWISSPROT Homolog: SLT11_CRYNE Pre-mRNA-splicing factor SLT11 with e-value of 1.6e-75 and BLAST sequence identity of 47.9
  misc_feature: SWISSPROT Homolog: SLT11_USTMA Pre-mRNA-splicing factor SLT11 with e-value of 1.3e-55 and BLAST sequence identity of 40.1
  misc_feature: SWISSPROT Homolog: SLT11_NEUCR Pre-mRNA-splicing factor slt-11 with e-value of 5.1e-53 and BLAST sequence identity of 47.0
  misc_feature: SWISSPROT Homolog: SLT11_ASPFU Pre-mRNA-splicing factor slt11 with e-value of 4.2e-52 and BLAST sequence identity of 34.7
  misc_feature: SWISSPROT Homolog: SLT11_EMENI Pre-mRNA-splicing factor slt11 with e-value of 1.7e-48 and BLAST sequence identity of 36.2
  misc_feature 438022:<222: Transcription Factor
  misc_feature: Phenotype: INFLORESCENCE - Short Useful for modulating plant height
  misc_feature: Phenotype: INFLORESCENCE - Other Useful for making ornamental plants with modified flowers
  misc_feature (1)..(531): Functional Homolog of  Ceres CDNA ID no. 36521407 at SEQ ID NO. 3955 with e-value of 2.09E-175 and BLAST sequence identity of 71.6
MAHRLLKDPEADGWERSDFPIICESCLGDNPYVRMTRADFDKECKICTRPFTVFRWRPGRDARFKKTEVCQTCSKLKNVCQVCLLDLEYGLPVQVRDTALSINSNDAIPKSDVNREYFAEEHDRRARAGIDYESSYGKAQANDTILKLQRTTPYYKRNRAHVCSFFARGECTRGAECPYRHEMPITGELSQQNIKDRYYGVNDPVAMKLLNKAGDMPSLEPPEDESIKTLYVGGLDARINEQDLRDQFYAHGEIESIKMVPQRAIAFVTYTTREGAEKAAAELSNRLVIKGLRLKLMWGRPQAPKPESESSDEARQQAAMAHSGMLPRAVVSQQHNHLNPPGTQDQHPPMHYFNIPPPPQQERAFYPSMDPQRMGALVGSQDGTPNGPAGSGENKSGLEKQLGQHYPYQSMPPPHVQYQQQYQQQHYPAYGYMPPVPPYQQYPLPYHTPVPPPQVVQSTQQYQHRVPPPMSAPAESMTSLPPPQGSRAPAGSMPSGPPPQGSEAPAGSKPSGPPSPRPGEPEESKPSGPPP

SEQ ID NO: 3911 - protein, 265 aa, Arabidopsis thaliana
  misc_feature (1)..(265): Ceres CDNA ID no. 36521975
  misc_feature (84)..(227): Pfam Name: GUN4 Pfam Description: GUN4-like
  misc_feature: Phenotype: WHOLE PLANT - Yellow-Green Viable 3 Useful for making lethal plants for genetic confinement systems
MATTNSLHHHHHSSPSYTHHRNNLHCQSHFGPTSLSLKQPTSAATFSLICSASSTSSSTTAVSAVSTTNASATTAETATIFDVLENHLVNQNFRQADEETRRLLIQISGEAAVKRGYVFFSEVKTISPEDLQAIDNLWIKHSDGRFGYSVQRKIWLKVKKDFTRFFVKVEWMKLLDTEVVQYNYRAFPDEFKWELNDETPLGHLPLTNALRGTQLLKCVLSHPAFATADDNSGETEDELNRGVAVAKEQAGVGADKRVFKTNYSF

SEQ ID NO: 3912 - DNA, 786 bp, Populus balsamifera subsp. trichocarpa
  misc_feature (1)..(786): Ceres ANNOT ID no. 1455981
  misc_feature 438243:<222: Transcription Factor
  misc_feature: Phenotype: WHOLE PLANT - Yellow-Green Viable 3 Useful for making lethal plants for genetic confinement systems
atggcggccaccaactctctacagtccctccatcaccatcactccctcctcaagttcctcccctcggacacctccccgccctcctccctcttcctcaagcccaccacctccatctccactgccactaacatttctctctccctctctatttcaacaaccaccactgcctactccatctcccccgccacctccactgctccctccacttccaagaccttctccctcaacctcctccagcaacacctctccaaccaaaacttccgcgaagccgatgaggaaacccgcaggctgctcatagttctagctggtgaggcagcacagaaacgtggctatgtcttcttctctgaagtccagttcataccagaacaagaccttaaagacattgatgaactgtggaaaaagtacagcaacaacaaatttggatacagtgttcaaaagagaatatggcgacaaaagggtaacaaggacttcaccaaatttttcatcaaagttgggtggatgaagaagcttgataccgaggttgagcaatacaactataggtcttttcctaatgagttcatttgggagcttaatgatgatactcctgaaggtcacttgcctctgacaaatgcacttagaggcatacagttgctcaaaaacattcttagccatcctgcttttgaggtagatggagaagtggaggaagataaggttgaaggcaatgaaaatggagggctaaagggactgagggatagctcaaagcctccattaagcaacagagtatttaaaacagattacagcttctga

SEQ ID NO: 3913 - protein, 261 aa, Populus balsamifera subsp. trichocarpa
  misc_feature (1)..(261): Ceres ANNOT ID no. 1455981
  misc_feature (78)..(222): Pfam Name: GUN4 Pfam Description: GUN4-like
  misc_feature: SWISSPROT Homolog: GUN4_ARATH Tetrapyrrole-binding protein, chloroplast precursor (Genomes uncoupled 4) with e-value of 1.2e-141 and BLAST sequence identity of 100.0
  misc_feature: SWISSPROT Homolog: YCF53_PORPU Hypothetical 28.1 kDa protein ycf53 (ORF238) with e-value of 4.4e-25 and BLAST sequence identity of 42.0
  misc_feature: SWISSPROT Homolog: YC53L_SYNY3 Ycf53-like protein with e-value of 3.2e-22 and BLAST sequence identity of 37.8
  misc_feature: SWISSPROT Homolog: YCF53_CYACA Hypothetical 28.1 kDa protein ycf53 with e-value of 4.1e-22 and BLAST sequence identity of 32.4
  misc_feature 438332:<222: Transcription Factor
  misc_feature: Phenotype: WHOLE PLANT - Yellow-Green Viable 3 Useful for making lethal plants for genetic confinement systems
  misc_feature (1)..(261): Functional Homolog of  Ceres CDNA ID no. 36521975 at SEQ ID NO. 3958 with e-value of 2.89E-66 and BLAST sequence identity of 55.6
MAATNSLQSLHHHHSLLKFLPSDTSPPSSLFLKPTTSISTATNISLSLSISTTTTAYSISPATSTAPSTSKTFSLNLLQQHLSNQNFREADEETRRLLIVLAGEAAQKRGYVFFSEVQFIPEQDLKDIDELWKKYSNNKFGYSVQKRIWRQKGNKDFTKFFIKVGWMKKLDTEVEQYNYRSFPNEFIWELNDDTPEGHLPLTNALRGIQLLKNILSHPAFEVDGEVEEDKVEGNENGGLKGLRDSSKPPLSNRVFKTDYSF

SEQ ID NO: 3914 - DNA, 792 bp, Populus balsamifera subsp. trichocarpa
  misc_feature (1)..(792): Ceres ANNOT ID no. 1541512
  misc_feature 438416:<222: Transcription Factor
  misc_feature: Phenotype: WHOLE PLANT - Yellow-Green Viable 3 Useful for making lethal plants for genetic confinement systems
atggctaccagctctttacggtccctcaaccaccatcactccctcctcaagttccatccctcagacaccacccctccctcctcactcttcctcaagcctaccacctccatctccgtcaacaccgacacttctctctccctctctatctcctccccaacaatcaccaccgcttactccgtctcccccacgacctccactactccctccacttccaaaaccgactcccttgacctcctccagcaacatctctcgaaccaaaacttccgcgaagccgatgaagaaacccgcagacttctcattgttctagctggtgaagcagcacaaacgcgtggctatgtcttcttctctgaggtccagtttatctcagaggaagaccttaaagacattgacgaactatggaaaaatcacagcaacaacaagtttggatacagtgttcagaaaagaatatggcaactgaaggctaacaaagacttcaccaagttcttcatcaaagttgggtggatgaagaagcttgacactgaggttcagcaatacaactatagggcttttcctaatgagttcgtttgggatcttaatgatggtactcctgaaggtcacttgcctttgacaaatgcactcagagggacacaattgctcaaaaacatccttaaccatcctgcttttgaggtagatattgcagaaggggagggagataaagttgaaggtaatgaaaatggtgggctaaagggattaagggatagctcaaagcttccattaagcaagagagtattgaagacagattacagcttttga

SEQ ID NO: 3915 - protein, 263 aa, Populus balsamifera subsp. trichocarpa
  misc_feature (1)..(263): Ceres ANNOT ID no. 1541512
  misc_feature (79)..(223): Pfam Name: GUN4 Pfam Description: GUN4-like
  misc_feature: SWISSPROT Homolog: GUN4_ARATH Tetrapyrrole-binding protein, chloroplast precursor (Genomes uncoupled 4) with e-value of 1.2e-141 and BLAST sequence identity of 100.0
  misc_feature: SWISSPROT Homolog: YCF53_PORPU Hypothetical 28.1 kDa protein ycf53 (ORF238) with e-value of 4.4e-25 and BLAST sequence identity of 42.0
  misc_feature: SWISSPROT Homolog: YC53L_SYNY3 Ycf53-like protein with e-value of 3.2e-22 and BLAST sequence identity of 37.8
  misc_feature: SWISSPROT Homolog: YCF53_CYACA Hypothetical 28.1 kDa protein ycf53 with e-value of 4.1e-22 and BLAST sequence identity of 32.4
  misc_feature 438505:<222: Transcription Factor
  misc_feature: Phenotype: WHOLE PLANT - Yellow-Green Viable 3 Useful for making lethal plants for genetic confinement systems
  misc_feature (1)..(263): Functional Homolog of  Ceres CDNA ID no. 36521975 at SEQ ID NO. 3958 with e-value of 6.09E-66 and BLAST sequence identity of 57.2
MATSSLRSLNHHHSLLKFHPSDTTPPSSLFLKPTTSISVNTDTSLSLSISSPTITTAYSVSPTTSTTPSTSKTDSLDLLQQHLSNQNFREADEETRRLLIVLAGEAAQTRGYVFFSEVQFISEEDLKDIDELWKNHSNNKFGYSVQKRIWQLKANKDFTKFFIKVGWMKKLDTEVQQYNYRAFPNEFVWDLNDGTPEGHLPLTNALRGTQLLKNILNHPAFEVDIAEGEGDKVEGNENGGLKGLRDSSKLPLSKRVLKTDYSF

SEQ ID NO: 3916 - protein, 418 aa, Arabidopsis thaliana
  misc_feature (1)..(418): Ceres CDNA ID no. 36527002
  misc_feature (26)..(66): Pfam Name: F-box Pfam Description: F-box domain
  misc_feature: Phenotype: WHOLE PLANT - Large Useful for making bigger plants
MSCSARLKTNLGMTSALSTHEVLNSNDTMCEILILLPPETIYKLILVSKRWLEIIASPCFRHTYLAKWKPNFELIGFFVCSSMYLGRRIDGTRRPRAEPSLPLLSTSSIGDEIESSGILKKLGYYIDSADGLLLCGRHPKAYYLWDPSTQKQQQLPRPRVHFEELCMSLISEDSPDQGFSYKVVRAECVAFPVNSTKVKVETFSSKTSTWSYSELICLEPLSLSPWTPGRVIKGVVYWHARGGKIAIYDSNSEEKRIDVIKLPKTYDYDEQVLGETDDGSLQYGWSNKSVMEVWKLEKVGNVLEWNLLFKVNFKAMWKMNQAVATRFSTWTKETQLLALFNQKSDLVYIRCDTQIFIYHTETKRVEVVQYQGRKSTLVWDFNKVVPYFRRTWPCSPLFENNAMMIDTPQCNASSAGSN

SEQ ID NO: 3917 - DNA, 1224 bp, Populus balsamifera subsp. trichocarpa
  misc_feature (1)..(1224): Ceres ANNOT ID no. 1483397
  misc_feature 438698:<222: Transcription Factor
  misc_feature: Phenotype: WHOLE PLANT - Large Useful for making bigger plants
atgaggagtggtattgatggtgtaaatgctgccttgagctctgatgacatcctatgtgagatcctccttcgggtgccaccagaaactgtttttagtttaatcatagtatcgaagaggtggcttcatgttatctgcagctctgttttttgtcaacattatctgagacgatggccactggcttatcgcatgttgggcttctttgtgtgcaataatttgtaccttgggagaggtcaaaatggtgtgcgccgaccacgaacagaacctgctatgccattattgtcaacttgtaaagagggtgatgacttgaagttctctaagaccctcaagcagtatggctacttcattgactcttccaatggccttcttctttgcggtcgccacccaaagagatattttgtttggaatcccattaccaaacaacactacaaaattcctaagcctcgggtatactttgaagacttgtgcatggcattccttgccgaggaccatcctagtgtcgatatgtgctacaaggtcattcgtgcaaaatgtgatttcagtcttgatgaagacatgaaaactgtccccatcgagactttcaactccaagactagtacatggaatttttccacgttgacctgtgttccatctttgtcactatgtccttggtcagtagccactgtggtgaaaggtgttgttcactggtatgcagcacagagaaacttagcaatctatgatcctcataatggtgagaggcgcttatcttcgattaaactaccaggctcaattgattttgaggagcgtgttctgggggagtcctttgacgggcggttgcagtatggttggagctgtaagtcagggttagagatatgggttcttgaaaaggaagaagctggccatgcaacgactccctcagatgatggatatccaaacaaaggctggaacttgagatatagattgaacttcaaaacaatgtggaagaagaatcccacattcatgacaaaatcttgcttgcgagacaaagaaactcagatattgtcatttcttcaccgaaactccaaatctgtctgcatcagatctggtccagacatatttctcttgcaccttgtgaaccagaaggttgaagctgttctttataatggtcgtggctcttccatttcatgggatttcagcagagtggcaccatactttcggccagattggcctcattcttccttatgcctccctggaaagagcatgacatga

SEQ ID NO: 3918 - protein, 407 aa, Populus balsamifera subsp. trichocarpa
  misc_feature (1)..(407): Ceres ANNOT ID no. 1483397
  misc_feature (15)..(55): Pfam Name: F-box Pfam Description: F-box domain
  misc_feature 438771:<222: Transcription Factor
  misc_feature: Phenotype: WHOLE PLANT - Large Useful for making bigger plants
  misc_feature (1)..(407): Functional Homolog of  Ceres CDNA ID no. 36527002 at SEQ ID NO. 3963 with e-value of 3.09E-103 and BLAST sequence identity of 49.0
MRSGIDGVNAALSSDDILCEILLRVPPETVFSLIIVSKRWLHVICSSVFCQHYLRRWPLAYRMLGFFVCNNLYLGRGQNGVRRPRTEPAMPLLSTCKEGDDLKFSKTLKQYGYFIDSSNGLLLCGRHPKRYFVWNPITKQHYKIPKPRVYFEDLCMAFLAEDHPSVDMCYKVIRAKCDFSLDEDMKTVPIETFNSKTSTWNFSTLTCVPSLSLCPWSVATVVKGVVHWYAAQRNLAIYDPHNGERRLSSIKLPGSIDFEERVLGESFDGRLQYGWSCKSGLEIWVLEKEEAGHATTPSDDGYPNKGWNLRYRLNFKTMWKKNPTFMTKSCLRDKETQILSFLHRNSKSVCIRSGPDIFLLHLVNQKVEAVLYNGRGSSISWDFSRVAPYFRPDWPHSSLCLPGKSMT

SEQ ID NO: 3919 - protein, 143 aa, Arabidopsis thaliana
  misc_feature (1)..(143): Ceres CDNA ID no. 36529494
  misc_feature: Utility: Low Nitrate Useful for making plants tolerant to low nitrogen
  misc_feature: Phenotype: WHOLE PLANT - Low Nitrate Useful for making plants tolerant to low nitrogen
MRKKREAKDENEEEEEEKKKRLELMKAAAQAWLSHSQTSKHTVLEFDAQRKHAFVKGKASRFKTEALSAKHHPSFLDWEFGQSLWDPYEILSVSKKLERELTLEEQTFSSSDNDGLKKMKKKKTRDSRNSLRSLFTRSSSKRF

SEQ ID NO: 3920 - protein, 75 aa, Arabidopsis thaliana [sequence omitted]

SEQ ID NO: 3921 - DNA, 228 bp, Populus balsamifera subsp. trichocarpa
  misc_feature (1)..(228): Ceres ANNOT ID no. 1440346
  misc_feature 438981:<222: Transcription Factor
  misc_feature: Phenotype: WHOLE PLANT - Large Useful for making bigger plants
  misc_feature: Phenotype: INFLORESCENCE - Late Flowering Useful for modulating flowering time
atggcatttggagttcgcttgtgtttgtgtctcctgcttgtctttgctgtaacatcttcagctcgaaacaccatttcattctcagataacgaaatggccttggctataaaggggaggtccttgaagattacactgaacgattacggtgacccaatagcaaaccgtgggcacgatccttcacaaagaaacaagaattggggtggcagcggcggtggccgtaaaggctga

SEQ ID NO: 3922 - protein, 75 aa, Populus balsamifera subsp. trichocarpa
  misc_feature (1)..(75): Ceres ANNOT ID no. 1440346
  misc_feature 439021:<222: Transcription Factor
  misc_feature: Phenotype: WHOLE PLANT - Large Useful for making bigger plants
  misc_feature: Phenotype: INFLORESCENCE - Late Flowering Useful for modulating flowering time
  misc_feature (1)..(75): Functional Homolog of  Ceres CDNA ID no. 36529808 at SEQ ID NO. 3967 with e-value of 3.49E-8 and BLAST sequence identity of 47.4
MAFGVRLCLCLLLVFAVTSSARNTISFSDNEMALAIKGRSLKITLNDYGDPIANRGHDPSQRNKNWGGSGGGRKG

SEQ ID NO: 3923 - protein, 516 aa, Arabidopsis thaliana
  misc_feature (1)..(516): Ceres CDNA ID no. 36531424
  misc_feature (32)..(509): Pfam Name: p450 Pfam Description: Cytochrome P450
  misc_feature: Phenotype: SILIQUES - Short Useful for increasing seed/fruit yield or modifying fruit content
MALITLLEVSISLLFFSFLYGYFLISKKPHRSFLTNWPFLGMLPGLLVEIPRVYDFVTELLEASNLTYPFKGPCFGGLDMLITVDPANIHHIMSSNFANYPKGTEFKKIFDVLGDGIFNADSELWKDLRKSAQSMMTHQDFQRFTLRTIMSKLEKGLVPLLDYVAEKKQVVDLQDVFQRFTFDTSFVLATGVDPGCLSTEMPQIEFARALDEAEEAIFFRHVKPEIVWKMQRFIGFGDELKMKKAHSTFDRVCSKCIASKRDEITNGVINIDSSSKDLLMCYMNVDTICHTTKYKLLNPSDDKFLRDMILSFMLAGRDTTSSALTWFFWLLSKNPKAITKIRQEINTQLSPRTNDFDSFNAQELNKLVYVHGALCEALRLYPPVPFQHKSPTKSDVLPSGHRVDASSKIVFCLYSLGRMKSVWGEDASEFKPERWISESGRLIHVPSFKFLSFNAGPRTCLGKEVAMTQMKTVAVKIIQNYEIKVVEGHKIEPVPSIILHMKHGLKVTVTKRSNLL

SEQ ID NO: 3924 - DNA, 2174 bp, Populus balsamifera subsp. trichocarpa
  misc_feature (1)..(2174): Ceres ANNOT ID no. 1474253
  misc_feature 439203:<222: Transcription Factor
  misc_feature: Phenotype: SILIQUES - Short Useful for increasing seed/fruit yield or modifying fruit content
atggcttcagtagtcctctttgaaatcttctttgctttcatttgctttctcagcctgatcttttgcttaagaaaaaataatggccttccaaagaactggccactcattggcatgctgcctggcctcctcttccaagtccaccggtttcatgactgggtcacagatgttttagagcaaagcaagtgtactttccaattcaaaggcccttggtttggtgacatggacattttggtcacggctgatccagccaacatacactacataacgagctcaaatttttccaattttgaaaaagggtcggatttcaataaaagattcgatattctgggagatgggataatcaatgcagacagggatttgtggaaaagccagaggaaagttgctcaagcattggtcaatcatcggttgttctaccaacgcttggttaagactatccaagataaggtggaaaggggcctaattccagtccttgagcacgtgtataaacaaagcctagtgctggacttgcaggatttgttccaaagattcacctttgatgctacatgcgtgattgtgaccggcttcgaccccggatgcctctctattgatttaccagaagttgctttctcgaaagctatggataatgctatggaagcaatattttatcgacatgttttgccagagagcacttggaggttgcaaagatggctaggaattggaaaagagaagaaacttaagaaagctcgggaaacacttgatcgcataatagccgaaattatatcgatgaagagagaagaattgagcaaaggaaacagattaatggaagaggatggagaaggtattgatttgttaacttcatacatgagtgaagattataatatgggatttaaatcagatgatgagtttctaagagacaccattgtaactttcatgcttgctggacgagacactgtaagttcatgtctgtcttggtttttctggcttgtctcaaagaatccagcagcaggcgccaagattagagaagagctgaaaacaactctaccggaaaaagaagctgaaaaacggaggctatttgacatagaagagataaaaaagctggtttatctacatggggcgttgtgtgaatctttaaggctctacccaccgattcattctgaattcaagtcccctgtaagacaagacatccttccaagcggtcaccgagtcaatccaaaggcgaaaatcgtgttttctttatatgcaatgggaaggatgagttcagtatggggagacgattgcttcgaatttaagcctgaaaggtggattacagacagaggagggatgaaacatgagccatcttacaagtttttttctttcaatgcaggacctaggacttgtcttggaaaggatgtggctttcactcaaatgaaggcagttgtagctgctataatctacaattatcaggttcaagtagtagatgaacatactgtaacccctagccagtccgttattcttcacatgaagcatggcatgaaaagcatgctaatgaagaatttcttacgatcaaaggagtattggcaggtggtcgattctgggatagcagaatcagaaactggaatcattttaacagaagctcaactgattgagctgagcagcctgaaattaaaagatttgaaggcaaagaactatttatttcaggccattgatcgttcaatcttggaaacaattcttagcaaagatacttccaagcaaatatgggattctatgaagaagaaatatcaaggctcttcaagagtaaaacgttcacaactccaggccctcagaagagattttgagactttacaaatgaaggatggagaatcagtcactgaatattgtgcaaagaccatggggatatcaaacaaaatgcggtttcatggtgaaaaaatgaatgatacggtaattgttgaaaagattttacgttccttatcatcaaagtttgattatgttgcttgctcaatcgaagaatctaaagatatagaagctctttctcttgatgaacttcaaagctcattattagtacatgagcataagatgaaacgaagcacaatcacagaggagcatgctttgaaagcttctatatttactgaatcctcacacataagaggaagaggtagaggcagaagtcggggcagaggatatcgtgacaacaaagatgaggcagaggaagaggactg

SEQ ID NO: 3925 - protein, 724 aa, Populus balsamifera subsp. trichocarpa
  misc_feature (1)..(724): Ceres ANNOT ID no. 1474253
  misc_feature (109)..(500): Pfam Name: p450 Pfam Description: Cytochrome P450
  misc_feature: SWISSPROT Homolog: C94A1_VICSA Cytochrome P450 94A1 (EC 1.14.-.-) (P450-dependent fatty acid omega-hydroxylase) with e-value of 8.8e-86 and BLAST sequence identity of 42.2
  misc_feature: SWISSPROT Homolog: C86A2_ARATH Cytochrome P450 86A2 (EC 1.14.-.-) with e-value of 1.2e-84 and BLAST sequence identity of 37.4
  misc_feature: SWISSPROT Homolog: C86A1_ARATH Cytochrome P450 86A1 (EC 1.14.-.-) (CYPLXXXVI) (P450-dependent fatty acid omega-hydroxylase) with e-value of 2.3e-67 and BLAST sequence identity of 32.4
  misc_feature: SWISSPROT Homolog: C94A2_VICSA Cytochrome P450 94A2 (EC 1.14.-.-) (P450-dependent fatty acid omega-hydroxylase) with e-value of 9.6e-46 and BLAST sequence identity of 34.9
  misc_feature: SWISSPROT Homolog: CP52E_CANMA Cytochrome P450 52A5 (EC 1.14.14.-) (CYPLIIA5) (Alkane-inducible P450-ALK2-A) (CYP52A3-B) with e-value of 3.6e-39 and BLAST sequence identity of 27.9
  misc_feature 439348:<222: Transcription Factor
  misc_feature: Phenotype: SILIQUES - Short Useful for increasing seed/fruit yield or modifying fruit content
  misc_feature (1)..(724): Functional Homolog of  Ceres CDNA ID no. 36531424 at SEQ ID NO. 3970 with e-value of 6.50E-149 and BLAST sequence identity of 54.0
MASVVLFEIFFAFICFLSLIFCLRKNNGLPKNWPLIGMLPGLLFQVHRFHDWVTDVLEQSKCTFQFKGPWFGDMDILVTADPANIHYITSSNFSNFEKGSDFNKRFDILGDGIINADRDLWKSQRKVAQALVNHRLFYQRLVKTIQDKVERGLIPVLEHVYKQSLVLDLQDLFQRFTFDATCVIVTGFDPGCLSIDLPEVAFSKAMDNAMEAIFYRHVLPESTWRLQRWLGIGKEKKLKKARETLDRIIAEIISMKREELSKGNRLMEEDGEGIDLLTSYMSEDYNMGFKSDDEFLRDTIVTFMLAGRDTVSSCLSWFFWLVSKNPAAGAKIREELKTTLPEKEAEKRRLFDIEEIKKLVYLHGALCESLRLYPPIHSEFKSPVRQDILPSGHRVNPKAKIVFSLYAMGRMSSVWGDDCFEFKPERWITDRGGMKHEPSYKFFSFNAGPRTCLGKDVAFTQMKAVVAAIIYNYQVQVVDEHTVTPSQSVILHMKHGMKSMLMKNFLRSKEYWQVVDSGIAESETGIILTEAQLIELSSLKLKDLKAKNYLFQAIDRSILETILSKDTSKQIWDSMKKKYQGSSRVKRSQLQALRRDFETLQMKDGESVTEYCAKTMGISNKMRFHGEKMNDTVIVEKILRSLSSKFDYVACSIEESKDIEALSLDELQSSLLVHEHKMKRSTITEEHALKASIFTESSHIRGRGRGRSRGRGYRDNKDEAEEED

SEQ ID NO: 3926 - DNA, 1527 bp, Populus balsamifera subsp. trichocarpa
  misc_feature (1)..(1527): Ceres ANNOT ID no. 1473720
  misc_feature 439519:<222: Transcription Factor
  misc_feature: Phenotype: SILIQUES - Short Useful for increasing seed/fruit yield or modifying fruit content
atgctactactggcttttctatgcatcatctttctttggctttcctttcggtggtggaggaatagaagctctgtgattatcaattggcccgtggttggaatgttgccggggctgtttcgcaattcatctcgagtccacgagtttgtaacctatgtgcttcgacagtgtggcggcacatttgttttcaaagggccttggtttggtggtcttgactttctggtgaccagtaatccggcgaatgttcaccacattttaagaaaaaaggccttcaattatcacaagggccttgagtttaaggagatttttgctgaaagttttggtaatggaattttttgtgctgatggagatcggtggaaaacccaaaggagaacaattcactcttttataaaaaatagcaagtttgaggaagctgcagagagaaacattcaacgaaaagtcttgcatggaatatttgtaattcttgagcatttctcagaacaaagaaaagaagtagacatgcaagatgtgttgaagcgattcatgtttgactatagctgcctattgttgttgggatttgatccgaattctctttcaattgaattccgtcaagttccatacaagcaagcttattatgatatggaggaggttatacttcaacgacatcttaagccacaaaggttttggaagctacaaaactggcttcaatttggggaagagaggaagatgaaaaagggttcggagatcttcgatcgtttactgtaccagtgcatttcaagaaaaaaagatttattaaacagaagcaaaatccaaatggacagagaggatttcgacctcttaacattcatgttagttgaagataatgatcaagaagaaagggaaatgagtgccttcaaaaaatcggacaaatatgcaagagacatggcgtttaacctcttatctgctggaagcgaggccgtaagttccagtcttacttggtttctttggcttgtggcaactcacccactggtagaaaagagtattttagaagagatgaaaacaaatttaaatgcaaaaggagatgagaaggggaggtatttcagttttggagagctatctaagctaaattatctccaagcagctatatgcgagtccctccgactctatccacccgtacctttcgagcacacagtttcgattgactcggacactcttccaagcgggcatcgaatcggcaaaaatacaagggttatttattgtccttactcaatgggaaggatggaagagatatggggtgcagattgcctggaattcaagccagagaggtggatttcaaacaatggagaaatcatacatatttcgccttacaagttcatagcatttaatgcagggccgagaacttgtataggcaaggacttggccatggtggaaatgaaagctgttggcgccgccgtgatatggaattatagcttgcaagtggttgaagatcatcctattttaccagctaattctatagtccttcatatgaaacatggcttgatggttagagcattgaagagatgtctttcctag

SEQ ID NO: 3927 - protein, 508 aa, Populus balsamifera subsp. trichocarpa
  misc_feature (1)..(508): Ceres ANNOT ID no. 1473720
  misc_feature (66)..(126): Pfam Name: p450 Pfam Description: Cytochrome P450
  misc_feature: SWISSPROT Homolog: C94A1_VICSA Cytochrome P450 94A1 (EC 1.14.-.-) (P450-dependent fatty acid omega-hydroxylase) with e-value of 8.8e-86 and BLAST sequence identity of 42.2
  misc_feature: SWISSPROT Homolog: C86A2_ARATH Cytochrome P450 86A2 (EC 1.14.-.-) with e-value of 1.2e-84 and BLAST sequence identity of 37.4
  misc_feature: SWISSPROT Homolog: C86A1_ARATH Cytochrome P450 86A1 (EC 1.14.-.-) (CYPLXXXVI) (P450-dependent fatty acid omega-hydroxylase) with e-value of 2.3e-67 and BLAST sequence identity of 32.4
  misc_feature: SWISSPROT Homolog: C94A2_VICSA Cytochrome P450 94A2 (EC 1.14.-.-) (P450-dependent fatty acid omega-hydroxylase) with e-value of 9.6e-46 and BLAST sequence identity of 34.9
  misc_feature: SWISSPROT Homolog: CP52E_CANMA Cytochrome P450 52A5 (EC 1.14.14.-) (CYPLIIA5) (Alkane-inducible P450-ALK2-A) (CYP52A3-B) with e-value of 3.6e-39 and BLAST sequence identity of 27.9
  misc_feature 439642:<222: Transcription Factor
  misc_feature: Phenotype: SILIQUES - Short Useful for increasing seed/fruit yield or modifying fruit content
  misc_feature (1)..(508): Functional Homolog of  Ceres CDNA ID no. 36531424 at SEQ ID NO. 3970 with e-value of 5.10E-117 and BLAST sequence identity of 44.6
MLLLAFLCIIFLWLSFRWWRNRSSVIINWPVVGMLPGLFRNSSRVHEFVTYVLRQCGGTFVFKGPWFGGLDFLVTSNPANVHHILRKKAFNYHKGLEFKEIFAESFGNGIFCADGDRWKTQRRTIHSFIKNSKFEEAAERNIQRKVLHGIFVILEHFSEQRKEVDMQDVLKRFMFDYSCLLLLGFDPNSLSIEFRQVPYKQAYYDMEEVILQRHLKPQRFWKLQNWLQFGEERKMKKGSEIFDRLLYQCISRKKDLLNRSKIQMDREDFDLLTFMLVEDNDQEEREMSAFKKSDKYARDMAFNLLSAGSEAVSSSLTWFLWLVATHPLVEKSILEEMKTNLNAKGDEKGRYFSFGELSKLNYLQAAICESLRLYPPVPFEHTVSIDSDTLPSGHRIGKNTRVIYCPYSMGRMEEIWGADCLEFKPERWISNNGEIIHISPYKFIAFNAGPRTCIGKDLAMVEMKAVGAAVIWNYSLQVVEDHPILPANSIVLHMKHGLMVRALKRCLS

SEQ ID NO: 3928 - protein, 209 aa, Arabidopsis thaliana
  misc_feature (1)..(209): Ceres CDNA ID no. 36532976
  misc_feature: Phenotype: INFLORESCENCE - Reduced Apical Dominance Useful for modifying plant structure, ie increased branching
  misc_feature: Phenotype: INFLORESCENCE - Other Useful for making ornamental plants with modified flowers
MTESDDASRETPASRGGEASSNQDLSKPESNHVSLDLKLNDTFNDDTKSTKCEANPRVFSCNYCRRKFYSSQALGGHQNAHKRERTMAKRAMHMGRMFGHHHRPYTYTSSSLGMQAHSGLLHHTLSQPQPLVSRFHHQGYFGNTVPLFFDYDDGGSDFFWPGSFRQVVEEAEAPVVVVASTESGLDLNSVAANGGVDNNSSKPDLTLRL

SEQ ID NO: 3929 - DNA, 777 bp, Populus balsamifera subsp. trichocarpa
  misc_feature (1)..(777): Ceres ANNOT ID no. 1445379
  misc_feature 439842:<222: Transcription Factor
  misc_feature: Phenotype: INFLORESCENCE - Reduced Apical Dominance Useful for modifying plant structure, ie increased branching
  misc_feature: Phenotype: INFLORESCENCE - Other Useful for making ornamental plants with modified flowers
atgaaacctattattgatcttgaagttgaggcatcatcagaaaatgtttctgatgttagcagccaagtggcttccaacttatcaaaccaagaaacttctgcaggtccctccaatgaaagcctcactaactcttcttatctcaaaaatgccatagcaactcaatccggttcagaaacggtttctcttgacttaaaactttgcttcaatgatgatgagttagggggaagggactcgatgggactctcattgtcaagcacaagcgaaagtagcaacgatcctgcatcgcgcactacagctgaagcaataccacgagttttttcttgcaattactgtcagcgcaaattcttcagctctcaggcacttggtggacaccaaaatgctcacaagagagaaaggacattagcaaagcgtgcaataagaatgggtattttctcggaaaggtatgccagcctagcatctttgcctctgcatggatcctcatttcgatctctgggaatcaaggcacattcttcagttcaccaaagttttgcacaaccagtaaggccacaagacataagtagcagtgcaagatttgatcatggatacgtgggtctgccaatatttatggaggatgaagaggcagagttggtatggccaggtagttttcgacaggtagctgtggcagatgacgctcatcaaagttttgtacttgcacgaagctcaaacatgaattttttgggggcaactccatcggtgaactcggacgattctgccccagatctcactctaaaactttaa

SEQ ID NO: 3930 - protein, 258 aa, Populus balsamifera subsp. trichocarpa
  misc_feature (1)..(258): Ceres ANNOT ID no. 1445379
  misc_feature: SWISSPROT Homolog: ZFP7_ARATH Zinc finger protein 7 with e-value of 1.9e-113 and BLAST sequence identity of 100.0
  misc_feature: SWISSPROT Homolog: ZFP4_ARATH Zinc finger protein 4 with e-value of 5.1e-30 and BLAST sequence identity of 56.4
  misc_feature: SWISSPROT Homolog: ZFP1_ARATH Zinc finger protein 1 with e-value of 6.0e-19 and BLAST sequence identity of 61.2
  misc_feature: SWISSPROT Homolog: ZFP3_ARATH Zinc finger protein 3 with e-value of 1.5e-17 and BLAST sequence identity of 45.9
  misc_feature: SWISSPROT Homolog: ZFP2_ARATH Zinc finger protein 2 with e-value of 1.0e-16 and BLAST sequence identity of 44.9
  misc_feature 439935:<222: Transcription Factor
  misc_feature: Phenotype: INFLORESCENCE - Reduced Apical Dominance Useful for modifying plant structure, ie increased branching
  misc_feature: Phenotype: INFLORESCENCE - Other Useful for making ornamental plants with modified flowers
  misc_feature (1)..(258): Functional Homolog of  Ceres CDNA ID no. 36532976 at SEQ ID NO. 3975 with e-value of 2.39E-32 and BLAST sequence identity of 49.1
MKPIIDLEVEASSENVSDVSSQVASNLSNQETSAGPSNESLTNSSYLKNAIATQSGSETVSLDLKLCFNDDELGGRDSMGLSLSSTSESSNDPASRTTAEAIPRVFSCNYCQRKFFSSQALGGHQNAHKRERTLAKRAIRMGIFSERYASLASLPLHGSSFRSLGIKAHSSVHQSFAQPVRPQDISSSARFDHGYVGLPIFMEDEEAELVWPGSFRQVAVADDAHQSFVLARSSNMNFLGATPSVNSDDSAPDLTLKL

SEQ ID NO: 3931 - DNA, 777 bp, Populus balsamifera subsp. trichocarpa
  misc_feature (1)..(777): Ceres ANNOT ID no. 1449468
  misc_feature 440026:<222: Transcription Factor
  misc_feature: Phenotype: INFLORESCENCE - Reduced Apical Dominance Useful for modifying plant structure, ie increased branching
  misc_feature: Phenotype: INFLORESCENCE - Other Useful for making ornamental plants with modified flowers
atgaaaccaattattgatcttgaagttgaagccacctcagaaaatgtttctgaagttagcagccaagtagcttccaacttatcaaaccaagaaacttctgcagccccctccaatgacagcctcactaactattcctatctcacaaatgccatagcaactcaatctggttcggaaatggtttcccttgacttaaccctttgcttcaataatgatgagttaggtggaagggacccagtgggactctcattgtcaagcacaagtgagagtagcaatgaacctgcatcacgtactacagctgaagcaataccacgagtattttcttgcaattactgtcagcgcaaattcttcagctctcaggcacttggtggacaccaaaacgctcataagagagagagaacattagctaagcgtgcaataagaatgggtattttctcggaaaggtatgccagcctagcatcgttgcctctacatggatcctcattccgatccctagggatagaggcacattcttcagtgcaccaaaactttgcaccaccagtaaggtcactagaaataagcagcagtgcaagatttgatcaaggttatgcaggtctgccagtattcatggaggatgatgaggcagagttgttatggccaggtagttttcgacaggtagctgtggcagacgatgctcatcaaagttttgtagtcgcaggaagttcaaacatgatttttttgggggcaactccaccagtgaacttagatgattctgcgccagatctcacactaaaactttga

SEQ ID NO: 3932 - protein, 258 aa, Populus balsamifera subsp. trichocarpa
  misc_feature (1)..(258): Ceres ANNOT ID no. 1449468
  misc_feature: SWISSPROT Homolog: ZFP7_ARATH Zinc finger protein 7 with e-value of 1.9e-113 and BLAST sequence identity of 100.0
  misc_feature: SWISSPROT Homolog: ZFP4_ARATH Zinc finger protein 4 with e-value of 5.1e-30 and BLAST sequence identity of 56.4
  misc_feature: SWISSPROT Homolog: ZFP1_ARATH Zinc finger protein 1 with e-value of 6.0e-19 and BLAST sequence identity of 61.2
  misc_feature: SWISSPROT Homolog: ZFP3_ARATH Zinc finger protein 3 with e-value of 1.5e-17 and BLAST sequence identity of 45.9
  misc_feature: SWISSPROT Homolog: ZFP2_ARATH Zinc finger protein 2 with e-value of 1.0e-16 and BLAST sequence identity of 44.9
  misc_feature 440119:<222: Transcription Factor
  misc_feature: Phenotype: INFLORESCENCE - Reduced Apical Dominance Useful for modifying plant structure, ie increased branching
  misc_feature: Phenotype: INFLORESCENCE - Other Useful for making ornamental plants with modified flowers
  misc_feature (1)..(258): Functional Homolog of  Ceres CDNA ID no. 36532976 at SEQ ID NO. 3975 with e-value of 2.79E-29 and BLAST sequence identity of 48.5
MKPIIDLEVEATSENVSEVSSQVASNLSNQETSAAPSNDSLTNYSYLTNAIATQSGSEMVSLDLTLCFNNDELGGRDPVGLSLSSTSESSNEPASRTTAEAIPRVFSCNYCQRKFFSSQALGGHQNAHKRERTLAKRAIRMGIFSERYASLASLPLHGSSFRSLGIEAHSSVHQNFAPPVRSLEISSSARFDQGYAGLPVFMEDDEAELLWPGSFRQVAVADDAHQSFVVAGSSNMIFLGATPPVNLDDSAPDLTLKL

SEQ ID NO: 3933 - protein, 503 aa, Arabidopsis thaliana
  misc_feature (1)..(503): Ceres CDNA ID no. 36533703
  misc_feature (40)..(498): Pfam Name: p450 Pfam Description: Cytochrome P450
MSNIQEMEMILMVSLCLTTLITLFLLKQFLKRTANKVNLPPSPWRLPLIGNLHQLSLHPHRSLHSLSLRYGPLMLLHFGRVPILVVSSGEAAQEVLKTHDLKFANRPRSKAVHGLMNGGRDVVFGPYGEYWRQMKSVCILNLLTNKMVASFEKIREEELNEMIKKLEKASSSSSSENLSELFVTLPSDVTSRIALGRKHSEDETARDLKKRVRQIMELLGEFPIGDYVPALAWIDRINGFNARIKEVSQGFSDLMDKVVQEHLEAGNHKEDFVDILLSIESEKSIGFQAQRDDIKFMILDMFIGGTSTSSTLLEWIMTELIRNPNVMKKLQDEIRSTIRPHGSYIKEKDVENMKYLKAVIKEVFRVHPPLPLILPRLLSEDVKVKGYNIAAGTEVIINAWAIQRDPAIWGPDAEEFKPERHLDSTLDYHGKDLNFIPFGSGRRICPGINLALGLVEVTVANLVGRFDWRAEAGPNGDQPDLTEAFGLDVCRKFPLIAFPSSVI

SEQ ID NO: 3934 - DNA, 1494 bp, Populus balsamifera subsp. trichocarpa
  misc_feature (1)..(1494): Ceres ANNOT ID no. 1473710
  misc_feature 440327:<222: Transcription Factor
atgatattgcatccatactctcttgcctgccttctttttatttttgttaccaaatggttcttcttcaattctgcacggaataaaaacttaccaccttcaccattaaagattcctgttgtgggcaatctccttcagttaggcttgtatccccatcgctctctgcaatctttggctaaacgccatggtccactcatgctcttgcaccttggcaacgctcctacacttgtggtctcgtctgctgatggagctcatgagatcttgagaactcatgacgtcatattttcaaataggcctgattcaagcattgcaagaagacttttgtatgactacaaggacctgtccttggccctttatggcgagtattggaggcaaataagaagcatatgtgtcgcgcagctacttagctctaaaagggttaagttattccactccataagagaagaggaaacagctttgctagtccaaaacgtcgagctgttttcttcaagatcattacaagttgatctaagtgaactgttttctgaattaacaaatgatgtggtgtgtagggttagttttggcaagaagtacagagaggggggtagtgggagaaaatttaagaaactattggaagagtttggtgcggtattaggcgttttcaatgttcgagatttcattccctggcttggttggataaattatctgacaggtttaaatgttagagtggaatgggtttttaaagaatttgatcgctttcttgatgaagttattgaagaatttaaggcaaatagggtaggtgtgaatgaggataaaatgaactttgtggatgttctgcttgaaatccaaaaaaatagcacagatggtgcttcgataggcagcgatagcataaaagccatcattttggatatgtttgcagcaggaactgatacaacacataccgccttggaatggacaatgacggagttgctaaaacaccccgaagttatgaagaaagcacaggatgagattagaaggatcaccggaagcaaaattagtgtaacccaggatgatgtagagaaaacgctatacttgaaagcagttatcaaggaatctcttcgtttacacccaccaattcccacgcttattccgcgagagtcaaccaaggatgtcaaggtacagggctatgatattctagccaaaaccagagtaatcatcaatgcttgggcaattgggagagatccttcatcgtgggaaaatccagatgaatttagaccagaaaggttcttagagagtgctatagatttcaagggaaatgacttccaattcattccttttggagctggaagaagaggttgcccaggaacaacatttgcttcttctgtgattgagattacgttggctagtcttttgcacaagttcaattgggcattgcctggtggagcaaaacctgaagacttggatataacagaagctccagggctagccatccataggaaattcccacttgttgttattgcaactcctcactctttctag

SEQ ID NO: 3935 - protein, 497 aa, Populus balsamifera subsp. trichocarpa
  misc_feature (1)..(497): Ceres ANNOT ID no. 1473710
  misc_feature (31)..(491): Pfam Name: p450 Pfam Description: Cytochrome P450
  misc_feature: SWISSPROT Homolog: C71AC_ARATH Cytochrome P450 71A12 (EC 1.14.-.-) with e-value of 1.8e-266 and BLAST sequence identity of 100.0
  misc_feature: SWISSPROT Homolog: C71AD_ARATH Cytochrome P450 71A13 (EC 1.14.-.-) with e-value of 1.0e-240 and BLAST sequence identity of 89.3
  misc_feature: SWISSPROT Homolog: C71AI_ARATH Cytochrome P450 71A18 (EC 1.14.-.-) with e-value of 8.6e-235 and BLAST sequence identity of 86.7
  misc_feature: SWISSPROT Homolog: C71AE_ARATH Cytochrome P450 71A14 (EC 1.14.-.-) with e-value of 1.8e-179 and BLAST sequence identity of 66.1
  misc_feature: SWISSPROT Homolog: C71AF_ARATH Cytochrome P450 71A15 (EC 1.14.-.-) with e-value of 4.7e-172 and BLAST sequence identity of 63.5
  misc_feature 440441:<222: Transcription Factor
  misc_feature (1)..(497): Functional Homolog of  Ceres CDNA ID no. 36533703 at SEQ ID NO. 3980 with e-value of 2.50E-117 and BLAST sequence identity of 48.75
MILHPYSLACLLFIFVTKWFFFNSARNKNLPPSPLKIPVVGNLLQLGLYPHRSLQSLAKRHGPLMLLHLGNAPTLVVSSADGAHEILRTHDVIFSNRPDSSIARRLLYDYKDLSLALYGEYWRQIRSICVAQLLSSKRVKLFHSIREEETALLVQNVELFSSRSLQVDLSELFSELTNDVVCRVSFGKKYREGGSGRKFKKLLEEFGAVLGVFNVRDFIPWLGWINYLTGLNVRVEWVFKEFDRFLDEVIEEFKANRVGVNEDKMNFVDVLLEIQKNSTDGASIGSDSIKAIILDMFAAGTDTTHTALEWTMTELLKHPEVMKKAQDEIRRITGSKISVTQDDVEKTLYLKAVIKESLRLHPPIPTLIPRESTKDVKVQGYDILAKTRVIINAWAIGRDPSSWENPDEFRPERFLESAIDFKGNDFQFIPFGAGRRGCPGTTFASSVIEITLASLLHKFNWALPGGAKPEDLDITEAPGLAIHRKFPLVVIATPHSF

SEQ ID NO: 3936 - DNA, 1647 bp, Populus balsamifera subsp. trichocarpa
  misc_feature (1)..(1647): Ceres ANNOT ID no. 1529632
  misc_feature 440563:<222: Transcription Factor
atggtcgttaacttcagggcccgtagaattagtcgagatgagccagatcgagcttccaagaaagttgctcggtattctagttcctgtgtagcggcagagatgactgagttgctatatttccagcaaacatggcaagaaatccgtccaaaaatagggttgaactactttgttttctttcttatttttctgtccttcattctcttcttgtttaagctcactacaagtcgcaaactcaatttacctccatcccccccaaagctgcctgtaatcggcaacattcaccatttcggcacactgccacatcgttctttacaagctctctcggaaaaatatggccctttaatgcttttgcacatggggcatgttccaactctcatcgtttcatctgccgaggcagctagtgaaattatgaagacccatgatattgttttcgcaaaccgaccccaaaccacagctgcaagcatcttttttcatggttgtgtagatgttggttttgctccttttggtgagtactggagaaaagtcaggaagattagtgttcaagaacttctgggcccgaaaacggtgcaatcatttcactacgtaagagaagaagaagctgcaggcttgattgataaaattcgttttgcttgtcatagtgggacttctgttaatctaagtgagatgctgatctctgtctcaaacgatatcgtttccagatgtgttgttggtcggaaggctgacaaggaaggcggcaacagcaagttcggagagttgacgaggacagttatggttcaattgacagcttttagttttggggatttattcccttacttgggatggatggacactctcacaggcttgatcccacggttgaaagcaacttcgaggacattagattcccttcttgatcaggtgattgaagagcataggagtttggaaagtgatggtgacaggtgtgctcagactgattttctgctggctctcctccaacttcagaagaatggcaagcttgatgtgcagctcacacgagacaatatcatagcagttgttttggacatgtttgtgggaggaactgatacaagctcaacaatgatggaatgggcgattgcagagcttgtaaggaatcaaactatcatgaggaaagcccaagaagaggtcaggagaatagtagggaagaaatcgaaggtagaagcaaatgatatagaagagatgggatatttgaaatgtatcatcaaagagactctcaggcttcatccccctgcccctctgctggttcctagagaaacatcagcaagtgttgaattgggaggctacttcattcctcccaagacaagagttattgtgaacgcatttgccattcaaagggaccctagcttctgggacagacctgatgagtttctcccagaaaggtttgagaacaacccagttgatttcaaaggccaggactttcaattcattccatttggtagcgggagaaggggttgccctggggccctatttggggtcactgcagttgaatttatgattgccaatctcctatattggttcgactggaggttgcctgatggcgcaactcaagaggaattggacatgagtgagatctgtggaatgactgcttacaagaagacccctcttcttcttgtaccttcattatactcgccctga

SEQ ID NO: 3937 - protein, 515 aa, Populus balsamifera subsp. trichocarpa
  misc_feature (1)..(515): Ceres ANNOT ID no. 1529632
  misc_feature (48)..(509): Pfam Name: p450 Pfam Description: Cytochrome P450
  misc_feature: SWISSPROT Homolog: C71AC_ARATH Cytochrome P450 71A12 (EC 1.14.-.-) with e-value of 1.8e-266 and BLAST sequence identity of 100.0
  misc_feature: SWISSPROT Homolog: C71AD_ARATH Cytochrome P450 71A13 (EC 1.14.-.-) with e-value of 1.0e-240 and BLAST sequence identity of 89.3
  misc_feature: SWISSPROT Homolog: C71AI_ARATH Cytochrome P450 71A18 (EC 1.14.-.-) with e-value of 8.6e-235 and BLAST sequence identity of 86.7
  misc_feature: SWISSPROT Homolog: C71AE_ARATH Cytochrome P450 71A14 (EC 1.14.-.-) with e-value of 1.8e-179 and BLAST sequence identity of 66.1
  misc_feature: SWISSPROT Homolog: C71AF_ARATH Cytochrome P450 71A15 (EC 1.14.-.-) with e-value of 4.7e-172 and BLAST sequence identity of 63.5
  misc_feature 440683:<222: Transcription Factor
  misc_feature (1)..(515): Functional Homolog of  Ceres CDNA ID no. 36533703 at SEQ ID NO. 3980 with e-value of 2.79E-109 and BLAST sequence identity of 44.6
MTELLYFQQTWQEIRPKIGLNYFVFFLIFLSFILFLFKLTTSRKLNLPPSPPKLPVIGNIHHFGTLPHRSLQALSEKYGPLMLLHMGHVPTLIVSSAEAASEIMKTHDIVFANRPQTTAASIFFHGCVDVGFAPFGEYWRKVRKISVQELLGPKTVQSFHYVREEEAAGLIDKIRFACHSGTSVNLSEMLISVSNDIVSRCVVGRKADKEGGNSKFGELTRTVMVQLTAFSFGDLFPYLGWMDTLTGLIPRLKATSRTLDSLLDQVIEEHRSLESDGDRCAQTDFLLALLQLQKNGKLDVQLTRDNIIAVVLDMFVGGTDTSSTMMEWAIAELVRNQTIMRKAQEEVRRIVGKKSKVEANDIEEMGYLKCIIKETLRLHPPAPLLVPRETSASVELGGYFIPPKTRVIVNAFAIQRDPSFWDRPDEFLPERFENNPVDFKGQDFQFIPFGSGRRGCPGALFGVTAVEFMIANLLYWFDWRLPDGATQEELDMSEICGMTAYKKTPLLLVPSLYSP

SEQ ID NO: 3938 - protein, 532 aa, Arabidopsis thaliana
  misc_feature (1)..(532): Ceres CDNA ID no. 36534269
  misc_feature (98)..(241): Pfam Name: p450 Pfam Description: Cytochrome P450
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
MENFMVEMAKTISWIVVIGVLGLGIRVYGKVMAEQWRMRRKLTMQGVKGPPPSLFRGNVPEMQKIQSQIMSNSKHYSGDNIIAHDYTSSLFPYLDHWRKQYGRVYTYSTGVKQHLYMNHPELVKELNQANTLNLGKVSYVTKRLKSILGRGVITSNGPHWAHQRRIIAPEFFLDKVKGMVGLVVESAMPMLSKWEEMMKREGEMVCDIIVDEDLRAASADVISRACFGSSFSKGKEIFSKLRCLQKAITHNNILFSLNGFTDVVFGTKKHGNGKIDELERHIESLIWETVKERERECVGDHKKDLMQLILEGARSSCDGNLEDKTQSYKSFVVDNCKSIYFAGHETSAVAVSWCLMLLALNPSWQTRIRDEVFLHCKNGIPDADSISNLKTVTMVIQETLRLYPPAAFVSREALEDTKLGNLVVPKGVCIWTLIPTLHRDPEIWGADANEFNPERFSEGVSKACKHPQSFVPFGLGTRLCLGKNFGMMELKVLVSLIVSRFSFTLSPTYQHSPVFRMLVEPQHGVVIRVLRQ

SEQ ID NO: 3939 - DNA, 1548 bp, Populus balsamifera subsp. trichocarpa
  misc_feature (1)..(1548): Ceres ANNOT ID no. 1457794
  misc_feature 440966:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atggagctgctgctgctgctgcccaaggtcacagttgccgttgctcttatcggccttgtcagcattgtcatacggatgtgtgatgctctaatattcaagccagaaaagcttcgttcgaagctacgaaagcaaggtatccgaggtccaccgcctgcatttttgcttggaaacatacgggacattaagaaggcacgatctaaggtctcaaaagcatcacgggaaggagaacaagtgataagtcataattcttccaacactcccttctcattcttcgagcaatggagcaagaaatatggttcaacattcatgttctcgcttgggaacatacagatattgcatatgaaccatcctgatgcggtgaaggaaatcagcatctgcacttccttagacttggggaagccttcttaccaagtaaaagagcgcggtcctctgcttggccaaggtattctgacctcaaatggtgctatatgggcacatcagagaaagatccttgctcctgaattttacatggagaatgtcaagaatttcatgagcatcatggtcgaatcctcgaatatagtagttgattcgtggactaaaaggattgaaagtgagggaggagttgtggacatcaacgttgatgaagacatgagaagcttctctggagatgtgatttcaaaagcatgttttgggagtaattatgccaaaggagaagagatattcctcaagcttagagctcttcaaggagccatgtcaaagaaagctttgtcttctgggattcccattttgagggctctaccaactaagagcaacagagaagtttggagattagagaaagaagtgcgtgctttaattttgaaggaagtgaaggaagaaaaggaacaaacatcgaaggacctgttagaaataatcctgaaaggagccaaggatagtgagaccagcaaagctgaaatggaccgtttcgttgttgacaattgcaagaacatatacttggctggctatgaaacaacttccgtcactgcaacatggacaatgatgcttttgggatcaaatcctgaatggcaagatagagttcgagccgaggtgcttgaggtctgtggggggcaaatgcctgatgctggcatggttcgcaggatgaaaacattgacgatggtgattcatgaatctctgcgcctctaccctccagtttgtgtgatatccagggaggcgttacaggacatgaaatttggagacatttttgtgcccaagggtgtcaacgtttggaccttgattgtaaccctacaccaagaccctgaaatatggggatctgacgctgacaagttcaatcctgagaggtttgccaatggggtcagtggcgcctgcaagcatcctcatgtttacatgccctttggtgttgggccacggacatgtctcggacagcattttgccatggcagaactcaaaatcctcatcgcaactatcgtttccaatttctccttcactatatcacccaaatacattcacgccccagctcttaggttggttatagaacctgaacatggagtgaatcttctcattaaaaagctgtga

SEQ ID NO: 3940 - protein, 515 aa, Populus balsamifera subsp. trichocarpa
  misc_feature (1)..(515): Ceres ANNOT ID no. 1457794
  misc_feature (46)..(510): Pfam Name: p450 Pfam Description: Cytochrome P450
  misc_feature: SWISSPROT Homolog: C72A1_CATRO Cytochrome P450 72A1 (EC 1.3.3.9) (CYPLXXII) Secologanin synthase (SLS) with e-value of 4.2e-68 and BLAST sequence identity of 31.8
  misc_feature: SWISSPROT Homolog: CP4X1_HUMAN Cytochrome P450 4X1 (EC 1.14.14.1) (CYPIVX1) with e-value of 6.5e-40 and BLAST sequence identity of 28.0
  misc_feature: SWISSPROT Homolog: CP3AB_MOUSE Cytochrome P450 3A11 (EC 1.14.14.1) (CYPIIIA11) (P-450IIIAM1) (P-450UT) with e-value of 1.6e-38 and BLAST sequence identity of 28.2
  misc_feature: SWISSPROT Homolog: CP4A5_RABIT Cytochrome P450 4A5 precursor (EC 1.14.15.3) (CYPIVA5) (Lauric acid omega-hydroxylase) with e-value of 2.5e-38 and BLAST sequence identity of 27.6
  misc_feature: SWISSPROT Homolog: CP4AB_HUMAN Cytochrome P450 4A11 precursor (EC 1.14.15.3) (CYPIVA11) with e-value of 2.5e-38 and BLAST sequence identity of 29.0
  misc_feature: SWISSPROT Homolog: CP4AB_HUMAN Fatty acid omega-hydroxylase (P-450 HK omega) Lauric acid omega-hydroxylase (CYP4AII) (P450-HL-omega)
  misc_feature 441124:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(515): Functional Homolog of  Ceres CDNA ID no. 36534269 at SEQ ID NO. 3985 with e-value of 4.90E-128 and BLAST sequence identity of 46.8
MELLLLLPKVTVAVALIGLVSIVIRMCDALIFKPEKLRSKLRKQGIRGPPPAFLLGNIRDIKKARSKVSKASREGEQVISHNSSNTPFSFFEQWSKKYGSTFMFSLGNIQILHMNHPDAVKEISICTSLDLGKPSYQVKERGPLLGQGILTSNGAIWAHQRKILAPEFYMENVKNFMSIMVESSNIVVDSWTKRIESEGGVVDINVDEDMRSFSGDVISKACFGSNYAKGEEIFLKLRALQGAMSKKALSSGIPILRALPTKSNREVWRLEKEVRALILKEVKEEKEQTSKDLLEIILKGAKDSETSKAEMDRFVVDNCKNIYLAGYETTSVTATWTMMLLGSNPEWQDRVRAEVLEVCGGQMPDAGMVRRMKTLTMVIHESLRLYPPVCVISREALQDMKFGDIFVPKGVNVWTLIVTLHQDPEIWGSDADKFNPERFANGVSGACKHPHVYMPFGVGPRTCLGQHFAMAELKILIATIVSNFSFTISPKYIHAPALRLVIEPEHGVNLLIKKL

SEQ ID NO: 3941 - DNA, 1539 bp, Populus balsamifera subsp. trichocarpa
  misc_feature (1)..(1539): Ceres ANNOT ID no. 1524172
  misc_feature 441284:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
atggaacttgtgttactcatttcacttgcagtagtgataacctttcttggattgctagagcttttgtattctgggctggtgctaaaaccagaaaggcttcgttctgtactaaggaagcaaggcattaggggaccaagtccatccctgctgcttggaaacataagcgagatcaggaagtctcaatccacaacagtaaaggcttctacaaatgaaccaccggttttccacaactgtgctgctaccctctttccattttttgagcaatggaggaagcaatatggtccagtatttgtattttcgttgggcaacacacaaatattatacgtgagccgggctgatgtggtgagagaaattagtacatgcacatcattagaatttgggaagccttcatatcagcagaaagaactcggttctttgcttggtcagggcattctgacttcaaatgggaaagtttgggcccatcagaggaaaatcatcgcccctgaattatacggtgacaaggttaagggaatgatgagcttgataattgaatccaccactgtgctgctaaactcatggaagagtagaattgataaagagggtggagtagcagagatcaaaattgacgagggtatgagaagcttctccggagatgtcatctcaagagcctgttttgggagcaattattccgaaggagcagaaattttctcgagactaagagatcttcaggaggctatgtccaagaaaagtctatccactggaattcctggcatgagatatattcccaccaagaacaatagagaagcatgggcgttagagaaatacgtccgcaatttgatactcgaaatagtcaaagagagaaaggaaactgcacatgagaaggatctcttgcaaatggtccttgagagtgccaaaactagcaacgtgggacaggatgcaatggaccggttcattgttgataactgcaagaatatatacttggcagggtatgagactacagcagtttctgccacatggtgcctcatgctgttggctgcaaatcaagaatggcaggatcgtgtccgtgcagaagttcttgaagtctgtggatcaggttgtcttccagacgcagatatgcttcgcaagatgaaacagctaaatatggtgattcatgaatcgttgcgactttatccaccagtggcggtggtgtcaagggaggcctttaaggagatgaaatttgggggcattaccgttcccaagggtgtgaatgtgtggacaatggtgctgacactgcatactgatcctgaagtgtggggaccggatgcatacaggttcaacccagatagatttgcaaaaggcataacaggtgcttgcaagctcccacacctatacatgccatttggtgttgggcctcggatgtgtcttggacagaacttggctattgctgaactcaagatactgatagctctcattctgtcacaattctctctctccctctcacccaaatacattcactcgcccgctcttaggttggtcatagagccagaacgtggagttgatctcttgataaagacgttgtga

SEQ ID NO: 3942 - protein, 512 aa, Populus balsamifera subsp. trichocarpa
  misc_feature (1)..(512): Ceres ANNOT ID no. 1524172
  misc_feature (72)..(509): Pfam Name: p450 Pfam Description: Cytochrome P450
  misc_feature: SWISSPROT Homolog: C72A1_CATRO Cytochrome P450 72A1 (EC 1.3.3.9) (CYPLXXII) Secologanin synthase (SLS) with e-value of 4.2e-68 and BLAST sequence identity of 31.8
  misc_feature: SWISSPROT Homolog: CP4X1_HUMAN Cytochrome P450 4X1 (EC 1.14.14.1) (CYPIVX1) with e-value of 6.5e-40 and BLAST sequence identity of 28.0
  misc_feature: SWISSPROT Homolog: CP3AB_MOUSE Cytochrome P450 3A11 (EC 1.14.14.1) (CYPIIIA11) (P-450IIIAM1) (P-450UT) with e-value of 1.6e-38 and BLAST sequence identity of 28.2
  misc_feature: SWISSPROT Homolog: CP4A5_RABIT Cytochrome P450 4A5 precursor (EC 1.14.15.3) (CYPIVA5) (Lauric acid omega-hydroxylase) with e-value of 2.5e-38 and BLAST sequence identity of 27.6
  misc_feature: SWISSPROT Homolog: CP4AB_HUMAN Cytochrome P450 4A11 precursor (EC 1.14.15.3) (CYPIVA11) with e-value of 2.5e-38 and BLAST sequence identity of 29.0
  misc_feature: SWISSPROT Homolog: CP4AB_HUMAN Fatty acid omega-hydroxylase (P-450 HK omega) Lauric acid omega-hydroxylase (CYP4AII) (P450-HL-omega)
  misc_feature 441442:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature: Phenotype: ROSETTE LEAVES - Serrate Margins Useful for making plants with increased biomass and foliage
  misc_feature (1)..(512): Functional Homolog of  Ceres CDNA ID no. 36534269 at SEQ ID NO. 3985 with e-value of 1.30E-127 and BLAST sequence identity of 48.4
MELVLLISLAVVITFLGLLELLYSGLVLKPERLRSVLRKQGIRGPSPSLLLGNISEIRKSQSTTVKASTNEPPVFHNCAATLFPFFEQWRKQYGPVFVFSLGNTQILYVSRADVVREISTCTSLEFGKPSYQQKELGSLLGQGILTSNGKVWAHQRKIIAPELYGDKVKGMMSLIIESTTVLLNSWKSRIDKEGGVAEIKIDEGMRSFSGDVISRACFGSNYSEGAEIFSRLRDLQEAMSKKSLSTGIPGMRYIPTKNNREAWALEKYVRNLILEIVKERKETAHEKDLLQMVLESAKTSNVGQDAMDRFIVDNCKNIYLAGYETTAVSATWCLMLLAANQEWQDRVRAEVLEVCGSGCLPDADMLRKMKQLNMVIHESLRLYPPVAVVSREAFKEMKFGGITVPKGVNVWTMVLTLHTDPEVWGPDAYRFNPDRFAKGITGACKLPHLYMPFGVGPRMCLGQNLAIAELKILIALILSQFSLSLSPKYIHSPALRLVIEPERGVDLLIKTL

SEQ ID NO: 3943 - protein, 172 aa, Arabidopsis thaliana; identical to SEQ ID NO: 3541
  misc_feature (1)..(172): Ceres CDNA ID no. 36534713
  misc_feature (2)..(47): Pfam Name: zf-B_box Pfam Description: B-box zinc finger
  misc_feature: Phenotype: INFLORESCENCE - Late Flowering Useful for modulating flowering time

SEQ ID NO: 3944 - DNA, 705 bp, Populus balsamifera subsp. trichocarpa; identical to SEQ ID NO: 3542
  misc_feature (1)..(705): Ceres ANNOT ID no. 1514007
  misc_feature 441661:<222: Transcription Factor
  misc_feature: Phenotype: INFLORESCENCE - Late Flowering Useful for modulating flowering time

SEQ ID NO: 3945 - protein, 234 aa, Populus balsamifera subsp. trichocarpa; identical to SEQ ID NO: 3543
  misc_feature (1)..(234): Ceres ANNOT ID no. 1514007
  misc_feature (53)..(96): Pfam Name: zf-B_box Pfam Description: B-box zinc finger
  misc_feature: SWISSPROT Homolog: STHY_ARATH Putative salt tolerance-like protein At1g78600 with e-value of 6.5e-24 and BLAST sequence identity of 51.5
  misc_feature: SWISSPROT Homolog: STHX_ARATH Putative salt tolerance-like protein At1g75540 with e-value of 3.2e-22 and BLAST sequence identity of 48.0
  misc_feature: SWISSPROT Homolog: STO_ARATH Salt-tolerance protein with e-value of 5.3e-22 and BLAST sequence identity of 38.9
  misc_feature: SWISSPROT Homolog: STH_ARATH Salt tolerance-like protein with e-value of 1.6e-20 and BLAST sequence identity of 47.1
  misc_feature: SWISSPROT Homolog: COL1_ARATH Zinc finger protein CONSTANS-LIKE 1 with e-value of 1.2e-18 and BLAST sequence identity of 42.7
  misc_feature 441751:<222: Transcription Factor
  misc_feature: Phenotype: INFLORESCENCE - Late Flowering Useful for modulating flowering time
  misc_feature (1)..(234): Functional Homolog of  Ceres CDNA ID no. 36534713 at SEQ ID NO. 3990 with e-value of 1.29E-54 and BLAST sequence identity of 73.4

SEQ ID NO: 3946 - DNA, 666 bp, Populus balsamifera subsp. trichocarpa; identical to SEQ ID NO: 3544
  misc_feature (1)..(666): Ceres ANNOT ID no. 1460742
  misc_feature 441829:<222: Transcription Factor
  misc_feature: Phenotype: INFLORESCENCE - Late Flowering Useful for modulating flowering time

SEQ ID NO: 3947 - protein, 221 aa, Populus balsamifera subsp. trichocarpa; identical to SEQ ID NO: 3545
  misc_feature (1)..(221): Ceres ANNOT ID no. 1460742
  misc_feature (53)..(96): Pfam Name: zf-B_box Pfam Description: B-box zinc finger
  misc_feature: SWISSPROT Homolog: STHY_ARATH Putative salt tolerance-like protein At1g78600 with e-value of 6.5e-24 and BLAST sequence identity of 51.5
  misc_feature: SWISSPROT Homolog: STHX_ARATH Putative salt tolerance-like protein At1g75540 with e-value of 3.2e-22 and BLAST sequence identity of 48.0
  misc_feature: SWISSPROT Homolog: STO_ARATH Salt-tolerance protein with e-value of 5.3e-22 and BLAST sequence identity of 38.9
  misc_feature: SWISSPROT Homolog: STH_ARATH Salt tolerance-like protein with e-value of 1.6e-20 and BLAST sequence identity of 47.1
  misc_feature: SWISSPROT Homolog: COL1_ARATH Zinc finger protein CONSTANS-LIKE 1 with e-value of 1.2e-18 and BLAST sequence identity of 42.7
  misc_feature 441919:<222: Transcription Factor
  misc_feature: Phenotype: INFLORESCENCE - Late Flowering Useful for modulating flowering time
  misc_feature (1)..(221): Functional Homolog of  Ceres CDNA ID no. 36534713 at SEQ ID NO. 3990 with e-value of 1.29E-54 and BLAST sequence identity of 73.4

SEQ ID NO: 3948 - protein, 361 aa, Arabidopsis thaliana
  misc_feature (1)..(361): Ceres CDNA ID no. 36535419
  misc_feature: Phenotype: FLOWER - Reduced fertility Useful for sterility, genetic confinement systems
  misc_feature: Phenotype: INFLORESCENCE - Short Useful for modulating plant height
MLQLVVVAWLLIFTAETVVPHQESGEWSCESDSEIQVLADFRPGIITLDGHNDDWKDIDGSEFPLRPALDPDSDHEYDAGKMTVKALHDGRDIYFLLEIDGNYAYDKGENNKCPSVALMFQIGDQATYHNMGGCKEGTDSCTSKACRGFEVDIMHFSIGNAIPGRLYGGNPIDNGEGNGGDRFGHLVDIYAWNPHCRYLDGLGPSGNDSSAQNDWHGAWWHSSFTTLSGYVEEDSPYTPDGKKGTYYFEFSRPLRTMDRLQQDVQFTLGSPAKMSVAFWYPVDSKPWHGSGHYTINCDWTPLDISSGSSSGLTASTVKGSSDGASITAILLSMISLVFSGFIAYRLFSPRNVPFTPMENNL

SEQ ID NO: 3949 - DNA, 1089 bp, Populus balsamifera subsp. trichocarpa
  misc_feature (1)..(1089): Ceres ANNOT ID no. 1524972
  misc_feature 442092:<222: Transcription Factor
  misc_feature: Phenotype: FLOWER - Reduced fertility Useful for sterility, genetic confinement systems
  misc_feature: Phenotype: INFLORESCENCE - Short Useful for modulating plant height
atgcttcttcgacttctcttgctactatcggttcttggctcgtcctggatcggatgggtcaattcacatcaggaatcaggtgagtggagctgcgagtccgacgaagagatcagaatagaagccgagttcaagcctggattcatcaccctcgatggccacgccgatgattggaaagacattgatggcttggactcctcactgcttcctgctctcgaccccgatgacgataaaaaatacacaggaggaaaaatgaccgtcaaggccttgcatgatggtaacgatatgtttttcttgttgcaagttgatgggaactatgcttatacaaaaggtgataacaagaaatgcccatcagttgctctcatgtttccgattggcgatgaagcaacctatcacaatatgggtggctgcaaggagggaactggtacttgcaataggaagacttgcaaaggtcatgaagttgatattatgcacttctcaattggaaatgctatcccaggaagactctatggtgggaatccattagacaacggagaaggaaatggaggtgacaggtttggtcatttggttgatctctattcttggaatccacactgtagataccttgatggcactggtccttcaggaaatgattctagtggccagaataactggaagggggcatggtggcacagtagcttcaatgtccactcaggttttgtagaggaagacagtccttatacatcagatagtcagaagggaacgtatttctttgaattctctcggcctttaagaaccatggatcgtctccaacaggatgctcagtttacaattggtggatctagcaagatggctgtcgcattctggtatccagttgacgggaattcatggcatggatctggtcactattctgtcaactgtgattggatacccctggacatctctccaggcagttctatgttgaaggcatctacaacaggcagctcaggagatgttgccagtgcctttgcccttctattttcagttgtctccatatgtgtctctgtttttgtgggatatagagcagcaactagatccaggaatgaaccctatgaaacagtgggaaatctttag

SEQ ID NO: 3950 - protein, 362 aa, Populus balsamifera subsp. trichocarpa
  misc_feature (1)..(362): Ceres ANNOT ID no. 1524972
  misc_feature 442162:<222: Transcription Factor
  misc_feature: Phenotype: FLOWER - Reduced fertility Useful for sterility, genetic confinement systems
  misc_feature: Phenotype: INFLORESCENCE - Short Useful for modulating plant height
  misc_feature (1)..(362): Functional Homolog of  Ceres CDNA ID no. 36535419 at SEQ ID NO. 3995 with e-value of 9.99E-144 and BLAST sequence identity of 72.7
MLLRLLLLLSVLGSSWIGWVNSHQESGEWSCESDEEIRIEAEFKPGFITLDGHADDWKDIDGLDSSLLPALDPDDDKKYTGGKMTVKALHDGNDMFFLLQVDGNYAYTKGDNKKCPSVALMFPIGDEATYHNMGGCKEGTGTCNRKTCKGHEVDIMHFSIGNAIPGRLYGGNPLDNGEGNGGDRFGHLVDLYSWNPHCRYLDGTGPSGNDSSGQNNWKGAWWHSSFNVHSGFVEEDSPYTSDSQKGTYFFEFSRPLRTMDRLQQDAQFTIGGSSKMAVAFWYPVDGNSWHGSGHYSVNCDWIPLDISPGSSMLKASTTGSSGDVASAFALLFSVVSICVSVFVGYRAATRSRNEPYETVGNL

SEQ ID NO: 3951 - protein, 202 aa, Arabidopsis thaliana; identical to SEQ ID NO: 3661
  misc_feature (1)..(202): Ceres CDNA ID no. 36535618
  misc_feature (1)..(50): Pfam Name: HLH Pfam Description: Helix-loop-helix DNA-binding domain
  misc_feature: Phenotype: ROSETTE LEAVES - Curled 3 Useful for making ornamental plants with altered leaf shape
  misc_feature: Phenotype: WHOLE PLANT - Small Useful for modulating plant size
  misc_feature: Phenotype: ROSETTE LEAVES - Oval Shaped Useful for making plants with increased biomass and foliage

SEQ ID NO: 3952 - DNA, 621 bp, Populus balsamifera subsp. trichocarpa; identical to SEQ ID NO: 3190
  misc_feature (1)..(621): Ceres ANNOT ID no. 1459998
  misc_feature 442352:<222: Transcription Factor
  misc_feature: Phenotype: ROSETTE LEAVES - Curled 3 Useful for making ornamental plants with altered leaf shape
  misc_feature: Phenotype: WHOLE PLANT - Small Useful for modulating plant size
  misc_feature: Phenotype: ROSETTE LEAVES - Oval Shaped Useful for making plants with increased biomass and foliage

SEQ ID NO: 3953 - protein, 206 aa, Populus balsamifera subsp. trichocarpa; identical to SEQ ID NO: 3191
  misc_feature (1)..(206): Ceres ANNOT ID no. 1459998
  misc_feature (1)..(50): Pfam Name: HLH Pfam Description: Helix-loop-helix DNA-binding domain
  misc_feature: SWISSPROT Homolog: RAP1_ARATH Transcription factor AtMYC2 (R-homologous Arabidopsis protein 1) with e-value of 1.0e-06 and BLAST sequence identity of 35.0
  misc_feature: SWISSPROT Homolog: RAP1_ARATH RAP-1 (Basic helix-loop-helix protein 6) bHLH6 (AtbHLH006) (rd22BP1)
  misc_feature 442434:<222: Transcription Factor
  misc_feature: Phenotype: ROSETTE LEAVES - Curled 3 Useful for making ornamental plants with altered leaf shape
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature (1)..(206): Functional Homolog of  Ceres CDNA ID no. 36535618 at SEQ ID NO. 3998 with e-value of 4.59E-61 and BLAST sequence identity of 71.2

SEQ ID NO: 3954 - DNA, 603 bp, Populus balsamifera subsp. trichocarpa; identical to SEQ ID NO: 3192
  misc_feature (1)..(603): Ceres ANNOT ID no. 1513263
  misc_feature 442520:<222: Transcription Factor
  misc_feature: Phenotype: ROSETTE LEAVES - Curled 3 Useful for making ornamental plants with altered leaf shape
  misc_feature: Phenotype: WHOLE PLANT - Small Useful for modulating plant size
  misc_feature: Phenotype: ROSETTE LEAVES - Oval Shaped Useful for making plants with increased biomass and foliage

SEQ ID NO: 3955 - protein, 200 aa, Populus balsamifera subsp. trichocarpa; identical to SEQ ID NO: 3193
  misc_feature (1)..(200): Ceres ANNOT ID no. 1513263
  misc_feature (1)..(50): Pfam Name: HLH Pfam Description: Helix-loop-helix DNA-binding domain
  misc_feature: SWISSPROT Homolog: RAP1_ARATH Transcription factor AtMYC2 (R-homologous Arabidopsis protein 1) with e-value of 1.0e-06 and BLAST sequence identity of 35.0
  misc_feature: SWISSPROT Homolog: RAP1_ARATH RAP-1 (Basic helix-loop-helix protein 6) bHLH6 (AtbHLH006) (rd22BP1)
  misc_feature 442602:<222: Transcription Factor
  misc_feature: Phenotype: ROSETTE LEAVES - Curled 3 Useful for making ornamental plants with altered leaf shape
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature (1)..(200): Functional Homolog of  Ceres CDNA ID no. 36535618 at SEQ ID NO. 3998 with e-value of 2.70E-56 and BLAST sequence identity of 70.8

SEQ ID NO: 3956 - protein, 147 aa, Arabidopsis thaliana
  misc_feature (1)..(147): Ceres CDNA ID no. 36535718
  misc_feature (14)..(118): Pfam Name: Auxin_inducible Pfam Description: Auxin responsive protein
  misc_feature: Phenotype: INFLORESCENCE - Late Flowering Useful for modulating flowering time
  misc_feature: Phenotype: ROSETTE LEAVES - Lanceolate Shaped Useful for making plants with increased biomass and foliage
MKHLIRRLSRVADSSSEFSIRRSTSSFRNRRGHHRLHAPPPPWSICPARRVNTVPAGHVPVYVGEEMERFVVSAELMNHPIFVGLLNRSAQEYGYAQKGVLHIPCHVIVFERVVETLRLGGFEGSGDLENLVASLLSGDELIPETTE

SEQ ID NO: 3957 - DNA, 411 bp, Populus balsamifera subsp. trichocarpa
  misc_feature (1)..(411): Ceres ANNOT ID no. 1451133
  misc_feature 442753:<222: Transcription Factor
  misc_feature: Phenotype: INFLORESCENCE - Late Flowering Useful for modulating flowering time
  misc_feature: Phenotype: ROSETTE LEAVES - Lanceolate Shaped Useful for making plants with increased biomass and foliage
atgaagcagctaattcgccgtctctcacgggtggcagactcttctcaatacagtcttctgcgctcgaactctcaatccaccacgactgcttctcgacggagatccggcgggtcgaggtcggcgcgccggcgaggatccgacaagccggtgccggagggtcatgtgccggtgtatgtcggcgatgagatggagcggtttacggtgagtgctgagctcttgaaccatccggtttttatatggcttctgaacaagtcggctcaagaatacgggtacgagcagaaaggagtgctgagaattccttgtcacgtgctggtttttgaacgagttatggaatctctgagactcggtcttgagtcaagtgaccttgaggatgtacttggctctttgttcacttctgaggattgtttgtga

SEQ ID NO: 3958 - protein, 136 aa, Populus balsamifera subsp. trichocarpa
  misc_feature (1)..(136): Ceres ANNOT ID no. 1451133
  misc_feature (4)..(114): Pfam Name: Auxin_inducible Pfam Description: Auxin responsive protein
  misc_feature: SWISSPROT Homolog: AXX15_SOYBN Auxin-induced protein X15 with e-value of 5.0e-10 and BLAST sequence identity of 46.7
  misc_feature: SWISSPROT Homolog: ARG7_PHAAU Indole-3-acetic acid-induced protein ARG7 with e-value of 1.3e-09 and BLAST sequence identity of 39.1
  misc_feature: SWISSPROT Homolog: AX15A_SOYBN Auxin-induced protein 15A with e-value of 3.5e-09 and BLAST sequence identity of 38.0
  misc_feature: SWISSPROT Homolog: AX6B_SOYBN Auxin-induced protein 6B with e-value of 5.7e-09 and BLAST sequence identity of 41.5
  misc_feature: SWISSPROT Homolog: AX10A_SOYBN Auxin-induced protein X10A with e-value of 1.9e-08 and BLAST sequence identity of 45.3
  misc_feature 442840:<222: Transcription Factor
  misc_feature: Phenotype: INFLORESCENCE - Late Flowering Useful for modulating flowering time
  misc_feature: Phenotype: ROSETTE LEAVES - Lanceolate Shaped Useful for making plants with increased biomass and foliage
  misc_feature (1)..(136): Functional Homolog of  Ceres CDNA ID no. 36535718 at SEQ ID NO. 4003 with e-value of 1.80E-34 and BLAST sequence identity of 61.9
MKQLIRRLSRVADSSQYSLLRSNSQSTTTASRRRSGGSRSARRRGSDKPVPEGHVPVYVGDEMERFTVSAELLNHPVFIWLLNKSAQEYGYEQKGVLRIPCHVLVFERVMESLRLGLESSDLEDVLGSLFTSEDCL

SEQ ID NO: 3959 - DNA, 417 bp, Populus balsamifera subsp. trichocarpa
  misc_feature (1)..(417): Ceres ANNOT ID no. 1456774
  misc_feature 442907:<222: Transcription Factor
  misc_feature: Phenotype: INFLORESCENCE - Late Flowering Useful for modulating flowering time
  misc_feature: Phenotype: ROSETTE LEAVES - Lanceolate Shaped Useful for making plants with increased biomass and foliage
atgaagcagctaattcgccgcctctccagggttgcggactcctctcaatatagccttctacgcccgaattctcaatccaccccctccacaaccaacgctcgccggagatcaggcggctcgaggtcggcccaccggcgaggagccgacaagccggtgcctgaggggcacgtaccggtgtatgttggcgatgagatggagcggtttacggtgagtgctgagctattgaaccgcccggtcttcatatggcttctgaacaagtcggctcaagaatacgggtacgagcagagaggagtgctgagaattccatgtcacgtgctggtttttgaacgagttatagagtcgctgagactcgggcttgagtcaagtgaccttgaggatctacttggttctttgttcacctccgaggactatttgtga

SEQ ID NO: 3960 - protein, 138 aa, Populus balsamifera subsp. trichocarpa
  misc_feature (1)..(138): Ceres ANNOT ID no. 1456774
  misc_feature (4)..(116): Pfam Name: Auxin_inducible Pfam Description: Auxin responsive protein
  misc_feature: SWISSPROT Homolog: AXX15_SOYBN Auxin-induced protein X15 with e-value of 5.0e-10 and BLAST sequence identity of 46.7
  misc_feature: SWISSPROT Homolog: ARG7_PHAAU Indole-3-acetic acid-induced protein ARG7 with e-value of 1.3e-09 and BLAST sequence identity of 39.1
  misc_feature: SWISSPROT Homolog: AX15A_SOYBN Auxin-induced protein 15A with e-value of 3.5e-09 and BLAST sequence identity of 38.0
  misc_feature: SWISSPROT Homolog: AX6B_SOYBN Auxin-induced protein 6B with e-value of 5.7e-09 and BLAST sequence identity of 41.5
  misc_feature: SWISSPROT Homolog: AX10A_SOYBN Auxin-induced protein X10A with e-value of 1.9e-08 and BLAST sequence identity of 45.3
  misc_feature 442994:<222: Transcription Factor
  misc_feature: Phenotype: INFLORESCENCE - Late Flowering Useful for modulating flowering time
  misc_feature: Phenotype: ROSETTE LEAVES - Lanceolate Shaped Useful for making plants with increased biomass and foliage
  misc_feature (1)..(138): Functional Homolog of  Ceres CDNA ID no. 36535718 at SEQ ID NO. 4003 with e-value of 5.49E-33 and BLAST sequence identity of 66.9
MKQLIRRLSRVADSSQYSLLRPNSQSTPSTTNARRRSGGSRSAHRRGADKPVPEGHVPVYVGDEMERFTVSAELLNRPVFIWLLNKSAQEYGYEQRGVLRIPCHVLVFERVIESLRLGLESSDLEDLLGSLFTSEDYL

SEQ ID NO: 3961 - protein, 570 aa, Arabidopsis thaliana
  misc_feature (1)..(570): Ceres CDNA ID no. 36536865
  misc_feature (9)..(565): Pfam Name: Auxin_eff Pfam Description: Auxin Efflux Carrier
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
MITGNEFYTVMCAMAPLYFAMFVAYGSVKWCKIFTPAQCSGINRFVSVFAVPVLSFHFISQNNPYKMDTMFILADTLSKIFVFVLLSLWAVFFKAGGLDWLITLFSIATLPNTLVMGIPLLQAMYGDYTQTLMVQLVVLQCIIWYTLLLFLFELRAARLLIRAEFPGQAAGSIAKIQVDDDVISLDGMDPLRTETETDVNGRIRLRIRRSVSSVPDSVMSSSLCLTPRASNLSNAEIFSVNTPNNRFFHGGGGSGTLQFYNGSNEIMFCNGDLGGFGFTRPGLGASPRRLSGYASSDAYSLQPTPRASNFNELDVNGNGTPVWMKSPAAGRIYRQSSPKMMWESGQRHAAKDINGSVPEKEISFRDALKAAPQATAAGGGASMEEGAAGKDTTPVAAIGKQEMPSAIVMMRLILTVVGRKLSRNPNTYSSLLGLVWSLISFKWNIPMPNIVDFSIKIISDAGLGMAMFSLGLFMALQPKMIPCGAKKATMGMLIRFISGPLFMAGASLLVGLRGSRLHAAIVQAALPQGIVPFVFAREYNLHPDLLSTLVIFGMIVSLPVTILYYVLLGL

SEQ ID NO: 3962 - DNA, 1641 bp, Populus balsamifera subsp. trichocarpa
  misc_feature (1)..(1641): Ceres ANNOT ID no. 1505326
  misc_feature 443204:<222: Transcription Factor
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
atgatcactgcagatgatttctacaaggtcatgtgtgcaatggtgcctctgtattttgcaatgctggttgcgtatggatcagtgaaatggtacaagatattcacaccagagcagtgctcagggatcaacagatttgttgctgtttttgcagtccctgtgctgtctttccacttcatcgctcaaaacaatccataccaaatggacaccaagttcatactggctgatactctttcgaaagtcttagcccttgttctgctctcagtgtgggctgttttctttaatggagaatttgactggcttatcactctcttctcagtcgctactttgcctaacacacttgtcatgggcattcctttgctcaaggccatgtatggagatttcacacagagcctcatggtgcaagtggttgttcttcaatgtataatatggtacacgcttctgctcttcctctttgaatacagagctgcaaccctcctaatcaaagcccaatttcccggccccacagcagccaccatttccaaaatcgaactcgacgacgacgtcatctcgctcgacggcagggatccactccgcacagaatcagaaacagacggcaacggacgcatacgagtccgcatcagacggtccacatcttcggctccagactccgctctatcatcctccatatgcctcactcctagaccatcaaacctctccaacgccgaagttttctccgttaacacacctgtaccactgcacgaataccatggttataatggtcatttcagtcatggacccaacaatgagattgtgctatgtaatggtgacttgggattggcatatcggtctggaacgagtccgaggttgtcaggatacgcgtcgtctgatgcttactcacttcaaccgacaccacgtgcgtccaactttaacgaattggacctaactaatgcaacgaacacgcctttttgggtccgatctccggtcgccggtaaaatttaccggcagccatctccggcggttcctgaagtcaagctagtctggggtgagtcgccagtaatatgtccaaatggcggcaaggaaatcagcttcagagacagttgtaaaatgccagcaccagaggaatcgaattcgaaggaatcagtgagcaaccaagaaatgccgcatgccattgtcatgattagacttatacttgttgtggtagggaggaagctctcccgaaatccaaatacatactcgagtgtcttggggcttctctggtctttagcctctttcaaatggaatgtgggaatgcccagcttggtgaaatattcaataaaaataatttcagacgcaggtcttgggatggccatgttcagtttagggttgttcatggctcttcagcctcggataattgtatgcggcaagaaaagggcaacaatggcaatggcaatccgattcatttgtgggccaatcgtaatgtcgacaacttcggtcgctgttggaatgagaggagtgcggctccgtgcggccatagtgcaggcagctctttcacaagggattgtgccattcgtctttgcaagggaatacgggttgcatcccgatataatgagtacaggggtaatcttcggcatgttggtttccttgccggtaaccctcatctactatatatttctaggcctgtga

SEQ ID NO: 3963 - protein, 546 aa, Populus balsamifera subsp. trichocarpa
  misc_feature (1)..(546): Ceres ANNOT ID no. 1505326
  misc_feature (9)..(541): Pfam Name: Auxin_eff Pfam Description: Auxin Efflux Carrier
  misc_feature: SWISSPROT Homolog: PIN6_ARATH Probable auxin efflux carrier component 6 (AtPIN6) with e-value of 1.0e-304 and BLAST sequence identity of 100.0
  misc_feature: SWISSPROT Homolog: PIN3A_ORYSA Probable auxin efflux carrier component 3a (OsPIN3a) with e-value of 3.0e-136 and BLAST sequence identity of 42.6
  misc_feature: SWISSPROT Homolog: PIN3_ARATH Auxin efflux carrier component 3 (AtPIN3) with e-value of 4.4e-135 and BLAST sequence identity of 54.3
  misc_feature: SWISSPROT Homolog: PIN7_ARATH Auxin efflux carrier component 7 (AtPIN7) with e-value of 1.9e-134 and BLAST sequence identity of 50.7
  misc_feature: SWISSPROT Homolog: PIN2_ORYSA Probable auxin efflux carrier component 2 (OsPIN2) with e-value of 7.3e-133 and BLAST sequence identity of 53.4
  misc_feature 443338:<222: Transcription Factor
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature (1)..(546): Functional Homolog of  Ceres CDNA ID no. 36536865 at SEQ ID NO. 4008 with e-value of 4.89E-199 and BLAST sequence identity of 73.7
MITADDFYKVMCAMVPLYFAMLVAYGSVKWYKIFTPEQCSGINRFVAVFAVPVLSFHFIAQNNPYQMDTKFILADTLSKVLALVLLSVWAVFFNGEFDWLITLFSVATLPNTLVMGIPLLKAMYGDFTQSLMVQVVVLQCIIWYTLLLFLFEYRAATLLIKAQFPGPTAATISKIELDDDVISLDGRDPLRTESETDGNGRIRVRIRRSTSSAPDSALSSSICLTPRPSNLSNAEVFSVNTPVPLHEYHGYNGHFSHGPNNEIVLCNGDLGLAYRSGTSPRLSGYASSDAYSLQPTPRASNFNELDLTNATNTPFWVRSPVAGKIYRQPSPAVPEVKLVWGESPVICPNGGKEISFRDSCKMPAPEESNSKESVSNQEMPHAIVMIRLILVVVGRKLSRNPNTYSSVLGLLWSLASFKWNVGMPSLVKYSIKIISDAGLGMAMFSLGLFMALQPRIIVCGKKRATMAMAIRFICGPIVMSTTSVAVGMRGVRLRAAIVQAALSQGIVPFVFAREYGLHPDIMSTGVIFGMLVSLPVTLIYYIFLGL

SEQ ID NO: 3964 - DNA, 1533 bp, Populus balsamifera subsp. trichocarpa
  misc_feature (1)..(1533): Ceres ANNOT ID no. 1496106
  misc_feature 443483:<222: Transcription Factor
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
atgataactgccggcgatttctacaaggtcatgtgtgcgatggtgcctctgtattttgcaatgctggttgcgtatgggtcagttaaacggtacaagatattcacaccggagcagtgctcagggatcaacagatttgttgctgtttttgcagtcccggtgctatctttccacttcatagctcaaaataatccataccagatggacaccaggttcataatggccgataccctttcgaaagtcttggtccttgttctgctgtcaatatgggttattttcttcaatggaggattggattggctcatcactctcttctcaattgctactttgcctaacacacttgtcatgggcattcctttgctcaaggccatgtatggagatttcacccagagcctcatggtgcaagtggttgttctccaatgtataatatggtacacgcttttgctcttcctctttgaatacagggctgcaaccctcctgatcaaaacccaattccctggccccaaagcagcctccatttccaaaatcgaactcgacaatgatgtcatctccctcgacggcagggatccacttcgcacagaatctgaaacagacggaaacggacgccttcgcgtccgcatcagacggtccacgtcatcggctcccgactctgctctatcatcttccatatgccttactcctagaccctcaaacctctccaacgccgaagttttctcggtcagcactcctgccccattgcaagaataccatggttataatggtcgtttcagtcatggacccaacaatgagataatgctttgtaatggtgacttgggatttggatatcatcggtctggaacgagtccgaggttgtcaggatacgcgtcatcagatgcttactcacttcaacccacgccacggacttccaattttaatgaatgggacttgactaatgcaaccaacacacctttctgggcccgatctccagtcgccggtaaaatatcccggcatccatctccggcggttcctgagctcaggctagtatggggtgagtcaccggtaatgtgtccaaatggcggcggcaaagagattgcagggaggaagctctctcgcaatcccaacacatattcaagtgttttggggcttctttggtctttagtctctttcaaatggaatgtgggaatgcccagcttggtgaaatattcaataaaaataatttcagatgcaggtcttgggatggctatgttcagtttagggttgttcatggctcttcagcctcggattattgtctgtggcaagaagagggcgaccatggcaatggcaatccgattcatttgtggacccgtcgtaatgtcaaccgcttcgcttgctgttggaatgagaggggaacggctccgtgcagccatagtgcaggcagctctctcacaggggattgtgccatttgtctttgcaagagaatatgggttgcatcctgatataatgagcacaggggtgattttcggcatgctagtttccttaccggtaaccctcctctactatatatttatagggctgtga

SEQ ID NO: 3965 - protein, 510 aa, Populus balsamifera subsp. trichocarpa
  misc_feature (1)..(510): Ceres ANNOT ID no. 1496106
  misc_feature (9)..(505): Pfam Name: Auxin_eff Pfam Description: Auxin Efflux Carrier
  misc_feature: SWISSPROT Homolog: PIN6_ARATH Probable auxin efflux carrier component 6 (AtPIN6) with e-value of 1.0e-304 and BLAST sequence identity of 100.0
  misc_feature: SWISSPROT Homolog: PIN3A_ORYSA Probable auxin efflux carrier component 3a (OsPIN3a) with e-value of 3.0e-136 and BLAST sequence identity of 42.6
  misc_feature: SWISSPROT Homolog: PIN3_ARATH Auxin efflux carrier component 3 (AtPIN3) with e-value of 4.4e-135 and BLAST sequence identity of 54.3
  misc_feature: SWISSPROT Homolog: PIN7_ARATH Auxin efflux carrier component 7 (AtPIN7) with e-value of 1.9e-134 and BLAST sequence identity of 50.7
  misc_feature: SWISSPROT Homolog: PIN2_ORYSA Probable auxin efflux carrier component 2 (OsPIN2) with e-value of 7.3e-133 and BLAST sequence identity of 53.4
  misc_feature 443613:<222: Transcription Factor
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature (1)..(510): Functional Homolog of  Ceres CDNA ID no. 36536865 at SEQ ID NO. 4008 with e-value of 2.40E-183 and BLAST sequence identity of 73.9
MITAGDFYKVMCAMVPLYFAMLVAYGSVKRYKIFTPEQCSGINRFVAVFAVPVLSFHFIAQNNPYQMDTRFIMADTLSKVLVLVLLSIWVIFFNGGLDWLITLFSIATLPNTLVMGIPLLKAMYGDFTQSLMVQVVVLQCIIWYTLLLFLFEYRAATLLIKTQFPGPKAASISKIELDNDVISLDGRDPLRTESETDGNGRLRVRIRRSTSSAPDSALSSSICLTPRPSNLSNAEVFSVSTPAPLQEYHGYNGRFSHGPNNEIMLCNGDLGFGYHRSGTSPRLSGYASSDAYSLQPTPRTSNFNEWDLTNATNTPFWARSPVAGKISRHPSPAVPELRLVWGESPVMCPNGGGKEIAGRKLSRNPNTYSSVLGLLWSLVSFKWNVGMPSLVKYSIKIISDAGLGMAMFSLGLFMALQPRIIVCGKKRATMAMAIRFICGPVVMSTASLAVGMRGERLRAAIVQAALSQGIVPFVFAREYGLHPDIMSTGVIFGMLVSLPVTLLYYIFIGL

SEQ ID NO: 3966 - protein, 349 aa, Arabidopsis thaliana
  misc_feature (1)..(349): Ceres CDNA ID no. 36539960
  misc_feature (290)..(349): Pfam Name: DUF623 Pfam Description: Protein of unknown function, DUF623
  misc_feature: Phenotype: CAULINE LEAVES - Oval Shaped Useful for making plants with increased biomass and foliage
  misc_feature: Phenotype: ROSETTE LEAVES - Oval Shaped Useful for making plants with increased biomass and foliage
  misc_feature: Phenotype: ROSETTE LEAVES - Undulate Shaped Useful for making plants with increased biomass and foliage
MMRWGRKKPVSSSSSSGLSRALPVSWFSKLSGSSDLKPAKEKKQDEKASQNISVKTSLSSTTRRSDIHENSKRFQRVSVEKENSATRSADKESNEKFEEIMSSVRKKVRDFQKETCGFLEVEAMDRDNGTVILTPRIQVNRDKQRCERRDQRLLEQKPKRSEQDAGVKVKKPARRTGTGGYSREDSVILGHTITKPAHQWEKLKEVKLREVKLKADQQRKSLYLKRELNRIGTKENNKVRVFSPRASEKCRVKAIEDLKKAKQRAREHELLIETADGGMENESFAVVKCSSDPQKDFRDSMIEMIMENGINHPEELKELLVCYLRLNTDEYHDMIISVFQQVHNDFNFH

SEQ ID NO: 3967 - DNA, 1296 bp, Populus balsamifera subsp. trichocarpa
  misc_feature (1)..(1296): Ceres ANNOT ID no. 1448952
  misc_feature 443857:<222: Transcription Factor
  misc_feature: Phenotype: CAULINE LEAVES - Oval Shaped Useful for making plants with increased biomass and foliage
  misc_feature: Phenotype: ROSETTE LEAVES - Oval Shaped Useful for making plants with increased biomass and foliage
  misc_feature: Phenotype: ROSETTE LEAVES - Undulate Shaped Useful for making plants with increased biomass and foliage
atgaagtggggtaggaaaaaaaccccatcttcttcgcgcccttctttaatatctcatgttttccccacttcctggctaacaaagttcaagcacatgagcatcaacccagggcaagaacatgcaaaagcgaagcaaaaagggaaatggaattctgtttccgcaagtccattgccatttgctcgtggtgaaggaggaggtagattctatggaggggatggcgatgctttttggagactttcttttggtgacgagagtgctagcacaggtgctttgagttcatttcataatgatttggacagtgagctccaggctccaccatcaagttgtcacagctgtagatcaaacgctacaagggtaaataatagaaaagaagacaagatcaggttcagcaacaaggtttctgaagcaaggaaaatgagaggactgccaagagaaattgagattttgcctgaaatggatgcatgtataagtgaaaaggtagcagaaatcagaaccccaaggttgagggttgagagagaggagaaattgaggaaaacagatcaaagggttttcgaagcgcagcagttcaaattggatggagaatcgtatgaagcagagcgggtatcaagaaaagagacatcaaagaatatttctgaaacggaatcagaaagaacgattgggaggatagagagagaggactgtaagttgacagcttctcattcaaaaaaagatttctccactcatctaagaaagactaaaaaagactttgtatttgctgctcagaatgaaagtgatggatttgctgctgaaaatttgagttctgagtggcaaacgttgaaagacatgaagattgaagagctcaagacaaagagggagaaacagagaaaatctctgtacataaacagagaattgcagaggaaaaagaaaagtaaagtcagggctatttctccaagaacagcttcaaaagtcgaaatctgcagaataaaagcacttgaagacatgaagaaagccaagatgaaaaagaagaaaaaggttagggagaaaaaaatggagggattcacaggcctagagaatttcgctgtggtgaaaacctcgtttgatccacagaaggacttcagagattcaatgattgaaatgattgaggagaagagaattagccggtcagaagagctcgaagaactcttggcgtgctatctgacattgaacgctgacgagtatcatgatcttattgtcaaggtattccggcaggtatggtttgatctgaacgaggcctgctctgatactgaactagagaatgaacaaggttacgatgaataa

SEQ ID NO: 3968 - protein, 431 aa, Populus balsamifera subsp. trichocarpa
  misc_feature (1)..(431): Ceres ANNOT ID no. 1448952
  misc_feature (358)..(417): Pfam Name: DUF623 Pfam Description: Protein of unknown function, DUF623
  misc_feature 443946:<222: Transcription Factor
  misc_feature: Phenotype: CAULINE LEAVES - Oval Shaped Useful for making plants with increased biomass and foliage
  misc_feature: Phenotype: ROSETTE LEAVES - Oval Shaped Useful for making plants with increased biomass and foliage
  misc_feature: Phenotype: ROSETTE LEAVES - Undulate Shaped Useful for making plants with increased biomass and foliage
  misc_feature (1)..(431): Functional Homolog of  Ceres CDNA ID no. 36539960 at SEQ ID NO. 4013 with e-value of 1.39E-41 and BLAST sequence identity of 42.1
MKWGRKKTPSSSRPSLISHVFPTSWLTKFKHMSINPGQEHAKAKQKGKWNSVSASPLPFARGEGGGRFYGGDGDAFWRLSFGDESASTGALSSFHNDLDSELQAPPSSCHSCRSNATRVNNRKEDKIRFSNKVSEARKMRGLPREIEILPEMDACISEKVAEIRTPRLRVEREEKLRKTDQRVFEAQQFKLDGESYEAERVSRKETSKNISETESERTIGRIEREDCKLTASHSKKDFSTHLRKTKKDFVFAAQNESDGFAAENLSSEWQTLKDMKIEELKTKREKQRKSLYINRELQRKKKSKVRAISPRTASKVEICRIKALEDMKKAKMKKKKKVREKKMEGFTGLENFAVVKTSFDPQKDFRDSMIEMIEEKRISRSEELEELLACYLTLNADEYHDLIVKVFRQVWFDLNEACSDTELENEQGYDE

SEQ ID NO: 3969 - protein, 413 aa, Arabidopsis thaliana
  misc_feature (1)..(413): Ceres CDNA ID no. 36542397
  misc_feature (156)..(410): Pfam Name: NPL4 Pfam Description: NPL4 family
  misc_feature: Phenotype: ROSETTE LEAVES - Cup-shaped Useful for making ornamental plants with altered leaf shape
  misc_feature: Phenotype: ROSETTE LEAVES - Oval Shaped Useful for making plants with increased biomass and foliage
MMMLRIRSRDGLERVTAEGAHITVSQLKTLIADQLQIPLHKQTLSTNRDLLLAKTPADLLAFTDLTDPNLPLSSLNLGHGSMLYLAYDGERSIPGAPPVTPAGSFGRKMTVDDLIARQMRVTRQETSHCDSVSFDRDAANAFQHYVNESLAFAVKRGGFMYGTVTEEGQVEVDFIYEPPQQGTEANLILMRDADEEKRVDAIAMGLGMRRVGFIFNQTVVQDKTEYTLSNAEVLQAAELHAESELKEWVTAVVKLEVNEDGGADVHFEAFQMSDMCIRLFKEEWFETEIMPDDDPKLSKMKKEVVVGVKDLKEVDNDFFLVLVRILDHQGPLSSTFPIENRSSRATMRALKTHLDRAKSLPLVKKMSDFHLLLFVAQFLDVSSDVPALAECVRLQSPVPEGYALLIESMANTC

SEQ ID NO: 3970 - DNA, 1236 bp, Populus balsamifera subsp. trichocarpa
  misc_feature (1)..(1236): Ceres ANNOT ID no. 1497958
  misc_feature 444187:<222: Transcription Factor
  misc_feature: Phenotype: ROSETTE LEAVES - Cup-shaped Useful for making ornamental plants with altered leaf shape
  misc_feature: Phenotype: ROSETTE LEAVES - Oval Shaped Useful for making plants with increased biomass and foliage
atggtgatggttcgaatccgcagcagagacgggctggaacgcgtctccatcgacaacacaaacatcacagtttcccaactcaaaactctaatccaaaaccaactccaaatccctatccgcagccaaaccctctctaccaaccaaagcctcctcttagccaaatcaccctccgatctcctcaaattcactgacatgtccaaccctgacactcctctctcttccctcagcatctctcacggctcccttatcttcttagcctacgatggcgagagaactattgccggccccgctgttcgacctgctggttctttcggccggaagatgacaatcgacgatcttattgccaaacagatgagagtcaccaggcaagaaaatccccactgcgattctgtctcgtttgatcgcgattgcgctaatgcgtttcagcattatgttaatgaaacgctcgcttttgctgttaaaagaggtgggtttatgtacggcacggtgtcggaggaggggaaggttgaagtcgatttcatatacgagccaccgcagcaggggactgaagaggttctgatgctcttgagagattccgatgaagaaaaattagtggaggcgattacggcgtgtttgggaatgaggagagtggggtttatttttacgcagactataatgcaggacaaaaaggactatacgttgtcgcatagggaagttcttcaggcggcggagctgcatgctgagagtgaattgaaagagtgggttactgcggtggtgaagttggaggtaagtgaggatgggggagccgatgtgcatttcgaggcgtttcagatgagtgatatgtgtattaggctgtttaaagaaggatggtttgagacggagattggggaagatgccgatcctaagttgtctaaaatgaagaaagatgtggttgttggtaccaaggatgttaaggaggtcgataatgattttttcttggtcgttgtcaagattttagatcacctgggccctctttcatcaaccttccccattgagaacaggatcacacaagtgacaatgagagcattgaggagtcatctggaccgtgcaaagaatcttccatttgtgaagagaatttctgattttcatctcttgctatttctggccaagtatctggacctcaattctgatgttccggcattagcagagtgtgtgcttgcacagacagcagtaccagagggttatcagatcctaattgagtccatggctactacttga

SEQ ID NO: 3971 - protein, 411 aa, Populus balsamifera subsp. trichocarpa
  misc_feature (1)..(411): Ceres ANNOT ID no. 1497958
  misc_feature (155)..(409): Pfam Name: NPL4 Pfam Description: NPL4 family
  misc_feature: SWISSPROT Homolog: NPL4_HUMAN Nuclear protein localization protein 4 homolog (Protein NPL4) with e-value of 1.6e-13 and BLAST sequence identity of 34.8
  misc_feature: SWISSPROT Homolog: NPL4_MOUSE Nuclear protein localization protein 4 homolog (Protein NPL4) with e-value of 1.0e-12 and BLAST sequence identity of 34.8
  misc_feature: SWISSPROT Homolog: NPL4_RAT Nuclear protein localization protein 4 homolog (Protein NPL4) with e-value of 1.0e-12 and BLAST sequence identity of 34.8
  misc_feature 444291:<222: Transcription Factor
  misc_feature: Phenotype: ROSETTE LEAVES - Cup-shaped Useful for making ornamental plants with altered leaf shape
  misc_feature: Phenotype: ROSETTE LEAVES - Oval Shaped Useful for making plants with increased biomass and foliage
  misc_feature (1)..(411): Functional Homolog of  Ceres CDNA ID no. 36542397 at SEQ ID NO. 4016 with e-value of 1.10E-171 and BLAST sequence identity of 77.8
MVMVRIRSRDGLERVSIDNTNITVSQLKTLIQNQLQIPIRSQTLSTNQSLLLAKSPSDLLKFTDMSNPDTPLSSLSISHGSLIFLAYDGERTIAGPAVRPAGSFGRKMTIDDLIAKQMRVTRQENPHCDSVSFDRDCANAFQHYVNETLAFAVKRGGFMYGTVSEEGKVEVDFIYEPPQQGTEEVLMLLRDSDEEKLVEAITACLGMRRVGFIFTQTIMQDKKDYTLSHREVLQAAELHAESELKEWVTAVVKLEVSEDGGADVHFEAFQMSDMCIRLFKEGWFETEIGEDADPKLSKMKKDVVVGTKDVKEVDNDFFLVVVKILDHLGPLSSTFPIENRITQVTMRALRSHLDRAKNLPFVKRISDFHLLLFLAKYLDLNSDVPALAECVLAQTAVPEGYQILIESMATT

SEQ ID NO: 3972 - DNA, 1236 bp, Populus balsamifera subsp. trichocarpa
  misc_feature (1)..(1236): Ceres ANNOT ID no. 1471743
  misc_feature 444409:<222: Transcription Factor
  misc_feature: Phenotype: ROSETTE LEAVES - Cup-shaped Useful for making ornamental plants with altered leaf shape
  misc_feature: Phenotype: ROSETTE LEAVES - Oval Shaped Useful for making plants with increased biomass and foliage
atgatgattcgaatccgcagcagagacgggctggaacgcgtctctatcgacaacccaaacatcacaatttcccaattcaaaactctaatccaaaaccaactccaaatccctatccacaaccaaaccctctccactaaccaaaacctcctcctagccaaatcccctcccgatctcctccaattcaccgacatgtcaaaccctagcacccttctctcttccctcaacatctctcacggctccattattttcttagcctacgaaggccacagaactattgcgggccccgctgttcaccctgctggttctttcggccgtaagatgacaatggacgatctcattgccaaacagatgagagtcggccggcaagaaaatccgcactgcgattcggtgtcgtttgatcgcgattgcgctaatgcgttccagcattatgttaatgaaacgctcgcgtttgctgttaaaagaggtgggtttatgtatggaacggtgtcggaggaggggaaggttgaagtcaatttcatatacgagctgccgcagcaggggactgaagagattttgatgcttttgagggattctgatgaagaaaaaatagtggacgcgattgcggcgggcttggggatgaggagagtggggtttatattcaatcagactataatgcatgacaaaaaagattatactttgtcgaatagggaggttcttcaggcggcggagctgcacgctgagagtgagttgaaggagtgggttactgcggtggtgaagttggaggtgaatgaggacgggggagctgatgtgcacttcgaggcgtttcagatgagtgatatgtgtattaggttgtttaaagaaggatggttcgagacggagattggggaagatgtggatcctaagttgtctataatgaagaaagatgtggttgttggtagcaaggatgttaaggaggttgataatgatttcttcttggtcgttattaagattctcgatcatctgggccctctttcaacaaccttccccattgagaacaggattacccaagtgacaatgagagcattgaggagtcatctggaccgtgcaaagaatcttccatttgtgaagagaatttctgattttcatctcttgctatttctggccaagtttctagacctcaattctgatgttccggcattggcagagtgtgtgcttacacagacagcagtaccagaaggttatcagctcctaattgagtccatggctaatacttcttga

SEQ ID NO: 3973 - protein, 411 aa, Populus balsamifera subsp. trichocarpa
  misc_feature (1)..(411): Ceres ANNOT ID no. 1471743
  misc_feature (1)..(43): Pfam Name: ubiquitin Pfam Description: Ubiquitin family
  misc_feature (154)..(408): Pfam Name: NPL4 Pfam Description: NPL4 family
  misc_feature: SWISSPROT Homolog: NPL4_HUMAN Nuclear protein localization protein 4 homolog (Protein NPL4) with e-value of 1.6e-13 and BLAST sequence identity of 34.8
  misc_feature: SWISSPROT Homolog: NPL4_MOUSE Nuclear protein localization protein 4 homolog (Protein NPL4) with e-value of 1.0e-12 and BLAST sequence identity of 34.8
  misc_feature: SWISSPROT Homolog: NPL4_RAT Nuclear protein localization protein 4 homolog (Protein NPL4) with e-value of 1.0e-12 and BLAST sequence identity of 34.8
  misc_feature 444519:<222: Transcription Factor
  misc_feature: Phenotype: ROSETTE LEAVES - Cup-shaped Useful for making ornamental plants with altered leaf shape
  misc_feature: Phenotype: ROSETTE LEAVES - Oval Shaped Useful for making plants with increased biomass and foliage
  misc_feature (1)..(411): Functional Homolog of  Ceres CDNA ID no. 36542397 at SEQ ID NO. 4016 with e-value of 5.29E-170 and BLAST sequence identity of 77.8
MMIRIRSRDGLERVSIDNPNITISQFKTLIQNQLQIPIHNQTLSTNQNLLLAKSPPDLLQFTDMSNPSTLLSSLNISHGSIIFLAYEGHRTIAGPAVHPAGSFGRKMTMDDLIAKQMRVGRQENPHCDSVSFDRDCANAFQHYVNETLAFAVKRGGFMYGTVSEEGKVEVNFIYELPQQGTEEILMLLRDSDEEKIVDAIAAGLGMRRVGFIFNQTIMHDKKDYTLSNREVLQAAELHAESELKEWVTAVVKLEVNEDGGADVHFEAFQMSDMCIRLFKEGWFETEIGEDVDPKLSIMKKDVVVGSKDVKEVDNDFFLVVIKILDHLGPLSTTFPIENRITQVTMRALRSHLDRAKNLPFVKRISDFHLLLFLAKFLDLNSDVPALAECVLTQTAVPEGYQLLIESMANTS

SEQ ID NO: 3974 - protein, 175 aa, Arabidopsis thaliana; identical to SEQ ID NO: 3738
  misc_feature (1)..(175): Ceres CDNA ID no. 36542853
  misc_feature (32)..(171): Pfam Name: AUX_IAA Pfam Description: AUX/IAA family
  misc_feature: Phenotype: ROSETTE LEAVES - Curled 2 Useful for making ornamental plants with altered leaf shape
  misc_feature: Phenotype: FLOWER - Reduced fertility Useful for sterility, genetic confinement systems
  misc_feature: Phenotype: INFLORESCENCE - Short Useful for modulating plant height

SEQ ID NO: 3975 - DNA, 528 bp, Populus balsamifera subsp. trichocarpa; identical to SEQ ID NO: 3739
  misc_feature (1)..(528): Ceres ANNOT ID no. 1524883
  misc_feature 444712:<222: Transcription Factor
  misc_feature: Phenotype: ROSETTE LEAVES - Curled 2 Useful for making ornamental plants with altered leaf shape
  misc_feature: Phenotype: FLOWER - Reduced fertility Useful for sterility, genetic confinement systems
  misc_feature: Phenotype: INFLORESCENCE - Short Useful for modulating plant height

SEQ ID NO: 3976 - protein, 175 aa, Populus balsamifera subsp. trichocarpa; identical to SEQ ID NO: 3740
  misc_feature (1)..(175): Ceres ANNOT ID no. 1524883
  misc_feature (63)..(125): Pfam Name: AUX_IAA Pfam Description: AUX/IAA family
  misc_feature: SWISSPROT Homolog: IAA20_ARATH Auxin-responsive protein IAA20 (Indoleacetic acid-induced protein 20) with e-value of 2.6e-91 and BLAST sequence identity of 100.0
  misc_feature: SWISSPROT Homolog: IAA30_ARATH Putative auxin-responsive protein IAA30 (Putative indoleacetic acid-induced protein 30) with e-value of 8.2e-72 and BLAST sequence identity of 83.0
  misc_feature: SWISSPROT Homolog: IAA4_ORYSA Auxin-responsive protein IAA4 (Indoleacetic acid-induced protein 4) with e-value of 6.5e-30 and BLAST sequence identity of 52.7
  misc_feature: SWISSPROT Homolog: IAA31_ARATH Auxin-responsive protein IAA31 (Indoleacetic acid-induced protein 31) with e-value of 7.0e-27 and BLAST sequence identity of 59.8
  misc_feature: SWISSPROT Homolog: IAA8_ORYSA Auxin-responsive protein IAA8 (Indoleacetic acid-induced protein 8) with e-value of 5.7e-25 and BLAST sequence identity of 42.8
  misc_feature 444815:<222: Transcription Factor
  misc_feature: Phenotype: ROSETTE LEAVES - Curled 2 Useful for making ornamental plants with altered leaf shape
  misc_feature: Phenotype: FLOWER - Reduced fertility Useful for sterility, genetic confinement systems
  misc_feature: Phenotype: INFLORESCENCE - Short Useful for modulating plant height
  misc_feature (1)..(175): Functional Homolog of  Ceres CDNA ID no. 36542853 at SEQ ID NO. 4021 with e-value of 1.30E-38 and BLAST sequence identity of 55.0

SEQ ID NO: 3977 - DNA, 525 bp, Populus balsamifera subsp. trichocarpa; identical to SEQ ID NO: 3741
  misc_feature (1)..(525): Ceres ANNOT ID no. 1497918
  misc_feature 444895:<222: Transcription Factor
  misc_feature: Phenotype: ROSETTE LEAVES - Curled 2 Useful for making ornamental plants with altered leaf shape
  misc_feature: Phenotype: FLOWER - Reduced fertility Useful for sterility, genetic confinement systems
  misc_feature: Phenotype: INFLORESCENCE - Short Useful for modulating plant height

SEQ ID NO: 3978 - protein, 174 aa, Populus balsamifera subsp. trichocarpa; identical to SEQ ID NO: 3742
  misc_feature (1)..(174): Ceres ANNOT ID no. 1497918
  misc_feature (85)..(168): Pfam Name: AUX_IAA Pfam Description: AUX/IAA family
  misc_feature: SWISSPROT Homolog: IAA20_ARATH Auxin-responsive protein IAA20 (Indoleacetic acid-induced protein 20) with e-value of 2.6e-91 and BLAST sequence identity of 100.0
  misc_feature: SWISSPROT Homolog: IAA30_ARATH Putative auxin-responsive protein IAA30 (Putative indoleacetic acid-induced protein 30) with e-value of 8.2e-72 and BLAST sequence identity of 83.0
  misc_feature: SWISSPROT Homolog: IAA4_ORYSA Auxin-responsive protein IAA4 (Indoleacetic acid-induced protein 4) with e-value of 6.5e-30 and BLAST sequence identity of 52.7
  misc_feature: SWISSPROT Homolog: IAA31_ARATH Auxin-responsive protein IAA31 (Indoleacetic acid-induced protein 31) with e-value of 7.0e-27 and BLAST sequence identity of 59.8
  misc_feature: SWISSPROT Homolog: IAA8_ORYSA Auxin-responsive protein IAA8 (Indoleacetic acid-induced protein 8) with e-value of 5.7e-25 and BLAST sequence identity of 42.8
  misc_feature 444998:<222: Transcription Factor
  misc_feature: Phenotype: ROSETTE LEAVES - Curled 2 Useful for making ornamental plants with altered leaf shape
  misc_feature: Phenotype: FLOWER - Reduced fertility Useful for sterility, genetic confinement systems
  misc_feature: Phenotype: INFLORESCENCE - Short Useful for modulating plant height
  misc_feature (1)..(174): Functional Homolog of  Ceres CDNA ID no. 36542853 at SEQ ID NO. 4021 with e-value of 3.69E-36 and BLAST sequence identity of 54.7

SEQ ID NO: 3979 - protein, 541 aa, Arabidopsis thaliana
  misc_feature (1)..(541): Ceres CDNA ID no. 36545500
  misc_feature (57)..(506): Pfam Name: p450 Pfam Description: Cytochrome P450
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
MNTFTSNSSDLTTTATETSSFSTLYLLSTLQAFVAITLVMLLKKLMTDPNKKKPYLPPGPTGWPIIGMIPTMLKSRPVFRWLHSIMKQLNTEIACVKLGNTHVITVTCPKIAREILKQQDALFASRPLTYAQKILSNGYKTCVITPFGDQFKKMRKVVMTELVCPARHRWLHQKRSEENDHLTAWVYNMVKNSGSVDFRFMTRHYCGNAIKKLMFGTRTFSKNTAPDGGPTVEDVEHMEAMFEALGFTFAFCISDYLPMLTGLDLNGHEKIMRESSAIMDKYHDPIIDERIKMWREGKRTQIEDFLDIFISIKDEQGNPLLTADEIKPTIKELVMAAPDNPSNAVEWAMAEMVNKPEILRKAMEEIDRVVGKERLVQESDIPKLNYVKAILREAFRLHPVAAFNLPHVALSDTTVAGYHIPKGSQVLLSRYGLGRNPKVWADPLCFKPERHLNECSEVTLTENDLRFISFSTGKRGCAAPALGTALTTMMLARLLQGFTWKLPENETRVELMESSHDMFLAKPLVMVGDLRLPEHLYPTVK

SEQ ID NO: 3980 - DNA, 1584 bp, Populus balsamifera subsp. trichocarpa
  misc_feature (1)..(1584): Ceres ANNOT ID no. 1449045
  misc_feature 445229:<222: Transcription Factor
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atggactattttccatccactagctcattcataatcttattgagcttcccaattctttttcttgtcttagcgatcaccttattttcctttatccagtcctccaagaatgtcaagcaatactcactgcctcctggtccaagaccatggcctcttgttggatccctcccgacaatgctccgaaacaagccagtgtaccaatggatacacaatctcatgaaagaaatgaacactgaaatagcttgtatccgtctaggaaacatccatgtgattcctgtcacctgtcctaatattgcttgtgaattcttgaaagaacaagatgatgtattttcatctagacccgaaaccatatcctcttatctcgcatcaaatgggtacctagcgacagttgtatcaccatttggagatcagtggaagaaaatgaagtcagtcatggcaacacaagtgctttctcctacaaggcatcaatggcttcacaaaaaaagagttgaagaaggtgataaccttgttcgtcttgtttataaacaatgtcaggaatctgatcaagatggcatagtgaatttgcgattcacatcacagcattattgtgcaaatgttattaggaagctgatgttcaacaaaagatattttggagtgggaatggagaatggtggacctggttttgaagaggagcagcatgtggatgcactcttcactatcctcagtcatttattttcattttgtgtctcagattttttgtcattcttgacatggcttgacctagatggtcatgagaaggtgatgaaggagaaagataagatcatcaaaaagtatcatgatcccataattgacgacaggattcaacaatggaaggatggaaaaaagaaagacattgaggacttgcttgatgttttaataaccttaaaggatgacaatggcaatcctttattgtcaaaggatgagataaaagctcaagtggaagacataatcttagcagcagtggacaatccatcaaatgcttgtgaatgggcatttgcagagatgttaaacaaccctgagatactcgaaacagctgttgaagaattggatagagtggttgggaagcaacgactggtccaagaatcagattttgcacaactcaattacgtcaaggcctgcgctagagaagcctttcggctgcatcctgttgcaccatttaacgttcctcacgtatccatggctgatacagtagttgccaagcacttcatcccaaaaggtagttatgttattcttagcagattagggctcggtcgaaaccctaaagtttgggacgagccactagaattcaaaccagagcgtcatctcaaaggaacagggaatgttgtgttggctgagaatggattaagattcatttcattcagcacaggaaagcgtgggtgcatggctgtgacccttgggagttcgatgacgaacatgctatttgctaggcttcttcatggttttagttggagtttgccatcaaatgagtccagcattgacctttccaccgcaaaagatagcatggctctcgctaaaccactgcttgctgttgcgaaaccacgcttgcctgcacatttgtaccctaaataa

SEQ ID NO: 3981 - protein, 527 aa, Populus balsamifera subsp. trichocarpa
  misc_feature (1)..(527): Ceres ANNOT ID no. 1449045
  misc_feature (43)..(518): Pfam Name: p450 Pfam Description: Cytochrome P450
  misc_feature: SWISSPROT Homolog: C79B2_ARATH Cytochrome P450 79B2 (EC 1.14.-.-) with e-value of 1.0e-295 and BLAST sequence identity of 100.0
  misc_feature: SWISSPROT Homolog: C79B1_SINAL Cytochrome P450 79B1 (EC 1.14.-.-) with e-value of 5.8e-277 and BLAST sequence identity of 92.6
  misc_feature: SWISSPROT Homolog: C79A1_SORBI Cytochrome P450 79A1 (EC 1.14.13.41) (Tyrosine N-monooxygenase) (Cytochrome P450Tyr) with e-value of 2.1e-169 and BLAST sequence identity of 58.9
  misc_feature: SWISSPROT Homolog: C79A2_ARATH Cytochrome P450 79A2 (EC 1.-.-.-) with e-value of 3.5e-144 and BLAST sequence identity of 51.6
  misc_feature: SWISSPROT Homolog: C75A6_CAMME Flavonoid 3',5'-hydroxylase (EC 1.14.13.88) (F3'5'H) (Cytochrome P450 75A6) with e-value of 3.4e-66 and BLAST sequence identity of 32.6
  misc_feature 445375:<222: Transcription Factor
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(527): Functional Homolog of  Ceres CDNA ID no. 36545500 at SEQ ID NO. 4026 with e-value of 5.80E-164 and BLAST sequence identity of 56.8
MDYFPSTSSFIILLSFPILFLVLAITLFSFIQSSKNVKQYSLPPGPRPWPLVGSLPTMLRNKPVYQWIHNLMKEMNTEIACIRLGNIHVIPVTCPNIACEFLKEQDDVFSSRPETISSYLASNGYLATVVSPFGDQWKKMKSVMATQVLSPTRHQWLHKKRVEEGDNLVRLVYKQCQESDQDGIVNLRFTSQHYCANVIRKLMFNKRYFGVGMENGGPGFEEEQHVDALFTILSHLFSFCVSDFLSFLTWLDLDGHEKVMKEKDKIIKKYHDPIIDDRIQQWKDGKKKDIEDLLDVLITLKDDNGNPLLSKDEIKAQVEDIILAAVDNPSNACEWAFAEMLNNPEILETAVEELDRVVGKQRLVQESDFAQLNYVKACAREAFRLHPVAPFNVPHVSMADTVVAKHFIPKGSYVILSRLGLGRNPKVWDEPLEFKPERHLKGTGNVVLAENGLRFISFSTGKRGCMAVTLGSSMTNMLFARLLHGFSWSLPSNESSIDLSTAKDSMALAKPLLAVAKPRLPAHLYPK

SEQ ID NO: 3982 - DNA, 1587 bp, Populus balsamifera subsp. trichocarpa
  misc_feature (1)..(1587): Ceres ANNOT ID no. 1470714
  misc_feature 445528:<222: Transcription Factor
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
atggaatatcttgctccaacttccttcacaaccctattaagcttcacagcttcacttcttgtcttagcaatcatactgttttacttcatccaatcccataagaatgtcaagaaacacccattgcctcccggtccaaaacgatggcctgttgttggatgcctccctaccatgctccgaaacaagccagtgtatcgatggatacacaatctcatgaaagaaatgaacactgaaatagcttgtatccgtttaggaaatgttcatgtgattcctgtcatttgtcctgatattgcttgtgaattcttaaaagcacaagataatacctttgcatctagacctcataccatgaccacagatctcatctcgagagggtacttaacaacagctctctctccctctggagaccaatggaataaaatgaagaaagttcttatgactcacgtactttctcctaaaaaacatcagtggctttatagcaaaagagttgaagaagctgatcaccttgttcattacgtgtataaccagtgcaagaagtctgtgcatcaaggtggcattgtgaatttgagaactgctgcccaacactattgtgcaaatctgactaggaagatgctgttcaataagaggttttttggggagggaatgaaagatggtggacctggttttgaggaagaggagtatgtggatgcacttttcagttgccttaatcatatatatgcattttgcatctcggattttttgccatctttgatagggcttgacttagatgggcatgagaaggtggtgatggagaatcataggatcatcaataaataccatgatcccataatccatgagagggttcaacaatggaaggatggtgcaaagaaggatacggaggacttgcttgatattttaattaccctaaaagatcgtcatggcaatcccctgttgtcaaaagatgagataaaagctcaaattacagaaataatggttgcagcagtggacaatccatcaaatgcttgtgaatgggcattcgcagagatgctaaaccaacctgagatacttgaaaaggctagtgaagaactggatagagtggttggaaaggagagacttgtccaagaatcagactttgcgcatctcaattacgtgaaggcatgtgctagagaagcattcaggcttcaccctgtggcaccatttaacgttcctcatgtgtcggccgccgatacaacagttgccaactacttcatcccgaaaggttcctatgttctgcttagccgtctaggactgggcagaaaccctaaagtatgggatgagccgctcaagttcaagcctgagcgccacctcaatgaaatggagaaggtggtgctgactgagaacaatctgcgattcatttcgttttccacaggaaaacgtgggtgcataggtgtgacacttgggacttcaatgactaccatgctatttgctagacttcttcaagcgtttacttggagtttaccacctagtcaatccagcatcgaccttaccattgcagaagacagcatggctcttgcaaaaccactgtgtgcacttgcaaaaccacgcttgcctccacaagtgtatcccggatactga

SEQ ID NO: 3983 - protein, 528 aa, Populus balsamifera subsp. trichocarpa
  misc_feature (1)..(528): Ceres ANNOT ID no. 1470714
  misc_feature (42)..(518): Pfam Name: p450 Pfam Description: Cytochrome P450
  misc_feature: SWISSPROT Homolog: C79B2_ARATH Cytochrome P450 79B2 (EC 1.14.-.-) with e-value of 1.0e-295 and BLAST sequence identity of 100.0
  misc_feature: SWISSPROT Homolog: C79B1_SINAL Cytochrome P450 79B1 (EC 1.14.-.-) with e-value of 5.8e-277 and BLAST sequence identity of 92.6
  misc_feature: SWISSPROT Homolog: C79A1_SORBI Cytochrome P450 79A1 (EC 1.14.13.41) (Tyrosine N-monooxygenase) (Cytochrome P450Tyr) with e-value of 2.1e-169 and BLAST sequence identity of 58.9
  misc_feature: SWISSPROT Homolog: C79A2_ARATH Cytochrome P450 79A2 (EC 1.-.-.-) with e-value of 3.5e-144 and BLAST sequence identity of 51.6
  misc_feature: SWISSPROT Homolog: C75A6_CAMME Flavonoid 3',5'-hydroxylase (EC 1.14.13.88) (F3'5'H) (Cytochrome P450 75A6) with e-value of 3.4e-66 and BLAST sequence identity of 32.6
  misc_feature 445674:<222: Transcription Factor
  misc_feature: Phenotype: FLOWER - Reduced fertility Useful for sterility, genetic confinement systems
  misc_feature: Phenotype: INFLORESCENCE - Short Useful for modulating plant height
  misc_feature: Phenotype: INFLORESCENCE - Other Useful for making ornamental plants with modified flowers
  misc_feature: Phenotype: ROSETTE LEAVES - Other Useful for making ornamental plants with modified leaves
  misc_feature (1)..(528): Functional Homolog of  Ceres CDNA ID no. 36545500 at SEQ ID NO. 4026 with e-value of 1.40E-162 and BLAST sequence identity of 57.5
MEYLAPTSFTTLLSFTASLLVLAIILFYFIQSHKNVKKHPLPPGPKRWPVVGCLPTMLRNKPVYRWIHNLMKEMNTEIACIRLGNVHVIPVICPDIACEFLKAQDNTFASRPHTMTTDLISRGYLTTALSPSGDQWNKMKKVLMTHVLSPKKHQWLYSKRVEEADHLVHYVYNQCKKSVHQGGIVNLRTAAQHYCANLTRKMLFNKRFFGEGMKDGGPGFEEEEYVDALFSCLNHIYAFCISDFLPSLIGLDLDGHEKVVMENHRIINKYHDPIIHERVQQWKDGAKKDTEDLLDILITLKDRHGNPLLSKDEIKAQITEIMVAAVDNPSNACEWAFAEMLNQPEILEKASEELDRVVGKERLVQESDFAHLNYVKACAREAFRLHPVAPFNVPHVSAADTTVANYFIPKGSYVLLSRLGLGRNPKVWDEPLKFKPERHLNEMEKVVLTENNLRFISFSTGKRGCIGVTLGTSMTTMLFARLLQAFTWSLPPSQSSIDLTIAEDSMALAKPLCALAKPRLPPQVYPGY

SEQ ID NO: 3984 - protein, 499 aa, Arabidopsis thaliana
  misc_feature (1)..(499): Ceres CDNA ID no. 36545977
  misc_feature (38)..(487): Pfam Name: p450 Pfam Description: Cytochrome P450
  misc_feature: Phenotype: WHOLE PLANT - Dark Green Useful for increasing chlorophyll and photosynthetic capacity
MVFSVSIFASLAPYLVSALLLFFLIEQLSYLVKKRNLPGPLFVPPIIGNAISLVRDPTSFWFKQSDTAGTSPGLAANYLIGKFIIYIRDTELSHQIFSNVRLEAFHPLGHPFGKQLFGDHSLIYLFGEDHKTVRRHLAPNFTPKALSTYSDLQQIVMLRHLRQWEESFSGGTKPVSMRDLVRELNLETSQTVFVGPYLDKEARNTFCTDYNLFNLGSMALPINLPGFAFNKARRAVMNLEKTLSVCAGKSKKRMATGEEPTCLIDFWMHAFVTEIESGNPPPLHSEDEAIGGLLFDFLFAAQDASTSSLLWAVTFLESHPKVLSKVREEVAKIWSPQSGHLITADQLAEMKYTRAVAREVVRYRPPATMVPHIATNDFPLTESYTIPKGTIVFPSVFDASFQGFTEPNRFDPDRFSETRQEDQVFKRNYLAFGWGAHQCVGQRYALNHLVLFIAMFSSLFDFKRLQSDGCDDIIYCPTISPKDGCTVFLSKRIVTYPNL

SEQ ID NO: 3985 - DNA, 1533 bp, Populus balsamifera subsp. trichocarpa
  misc_feature (1)..(1533): Ceres ANNOT ID no. 1449892
  misc_feature 445954:<222: Transcription Factor
  misc_feature: Phenotype: WHOLE PLANT - Dark Green Useful for increasing chlorophyll and photosynthetic capacity
atgacaaccttgctattgtcctgtgcaactttcttatcaactctagttccatacataatttctttcgttattttcctcgttttggtggagcaggtgagttatttgataaagaaacgaggagctccgggtcctgtttttgtgcttccatttattggcaacgcaatttctttagtaagagatccaacttcattctgggacacccaatccgccaatagctctcgttctggattctctgctaactatataatcgggaggttcatattgtacattcgcgacactaatctctcccacctcattttctcaaacataaggcctgatgctttcttgcttgttggccacccttttgggaagaagctatttggtgagcataatttgatttataagttcggtcaggaacacaaggatctccgccgccgaatcgctcccaacttcactcctcgtgctctttcaacctacacctcactccagcagataatcattctcaagcacttgaaaaaatgggagagcttatcctcaaacagtccaaacaagtccatctctctccgcttgttagttcgagacatgaacctcgagacttcacagaccgtttttgtcggcccgtatttgagcgaagaagagcgggagcgattcaagctggattacaatatgttcaacgttggactaatgaaactccctattgatctcccaggtttcgcatttcgaaatgccaggttggctgttgacaggttagcagaaaccctctcagaatgtgtaatgaagagcaagaaaaaaatggacaataaccatgaaccatcttgcttgatagatttctggatgcaagaaatgcttaaagaaatctccgctgccaaatccgctggagagccagttccaccgcacactagtgaagccgagatcggaggccacctctttgacttcctctttgctgctcaggatgcttcaacgtcatcgctcctttgggcggtggcgcttctcgactcgaacccggaagtcctgctgaaggttcgaaaggaagtgtcgagtttctggtcaccagaatctgatggtttaataaacacggagcagctcagggaaatgaagtacacgcaggcggtggcgcgtgaggtgctgaggtaccgcgcccctgcgacgttagtcccccatgtagctatgaaggagtttgctttgacggagtcgtacacgattcctaaagggaccattgtgttcccgtcggttttagacagttcatttcaagggttcactaaaccggaccggtttgacccggaccgtttctctgaggacaggcaagaggatcagttattcaaaaagaatttcttaacttttggagctggagcccaccagtgtgtgggtcaaaggtatgccctcaatcatttggttttattcatcgccatgttctgtgcgttgcttgattttaagcggtacagagcggacggctgtgatgatattgtttacaatccaactatctgtccaaaggatggctgcattgtttccttgaaaaggcggggcacgcgatatcctaatctctctttggagtga

SEQ ID NO: 3986 - protein, 510 aa, Populus balsamifera subsp. trichocarpa
  misc_feature (1)..(510): Ceres ANNOT ID no. 1449892
  misc_feature (42)..(497): Pfam Name: p450 Pfam Description: Cytochrome P450
  misc_feature: SWISSPROT Homolog: ERG5_YEAST Cytochrome P450 61 (EC 1.14.14.-) (C-22 sterol desaturase) with e-value of 1.4e-46 and BLAST sequence identity of 27.7
  misc_feature: SWISSPROT Homolog: KAO2_ARATH Ent-kaurenoic acid oxidase 2 (EC 1.14.13.79) (AtKAO2) (Cytochrome P450 88A4) with e-value of 2.4e-27 and BLAST sequence identity of 25.8
  misc_feature: SWISSPROT Homolog: CP26B_BRARE Cytochrome P450 26B1 (EC 1.14.-.-) (Cyp26B1) (Retinoic-acid metabolizing cytochrome) with e-value of 3.3e-26 and BLAST sequence identity of 26.9
  misc_feature: SWISSPROT Homolog: KAO1_ARATH Ent-kaurenoic acid oxidase 1 (EC 1.14.13.79) (AtKAO1) (Cytochrome P450 88A3) with e-value of 1.9e-23 and BLAST sequence identity of 25.5
  misc_feature: SWISSPROT Homolog: CP26B_HUMAN Cytochrome P450 26B1 (EC 1.14.-.-) (P450 26A2) with e-value of 1.5e-22 and BLAST sequence identity of 25.2
  misc_feature: SWISSPROT Homolog: CP26B_HUMAN P450 retinoic acid-inactivating 2 (P450RAI-2) Retinoic-acid metabolizing cytochrome
  misc_feature 446084:<222: Transcription Factor
  misc_feature: Phenotype: WHOLE PLANT - Dark Green Useful for increasing chlorophyll and photosynthetic capacity
  misc_feature (1)..(510): Functional Homolog of  Ceres CDNA ID no. 36545977 at SEQ ID NO. 4031 with e-value of 2.30E-178 and BLAST sequence identity of 65.8
MTTLLLSCATFLSTLVPYIISFVIFLVLVEQVSYLIKKRGAPGPVFVLPFIGNAISLVRDPTSFWDTQSANSSRSGFSANYIIGRFILYIRDTNLSHLIFSNIRPDAFLLVGHPFGKKLFGEHNLIYKFGQEHKDLRRRIAPNFTPRALSTYTSLQQIIILKHLKKWESLSSNSPNKSISLRLLVRDMNLETSQTVFVGPYLSEEERERFKLDYNMFNVGLMKLPIDLPGFAFRNARLAVDRLAETLSECVMKSKKKMDNNHEPSCLIDFWMQEMLKEISAAKSAGEPVPPHTSEAEIGGHLFDFLFAAQDASTSSLLWAVALLDSNPEVLLKVRKEVSSFWSPESDGLINTEQLREMKYTQAVAREVLRYRAPATLVPHVAMKEFALTESYTIPKGTIVFPSVLDSSFQGFTKPDRFDPDRFSEDRQEDQLFKKNFLTFGAGAHQCVGQRYALNHLVLFIAMFCALLDFKRYRADGCDDIVYNPTICPKDGCIVSLKRRGTRYPNLSLE

SEQ ID NO: 3987 - protein, 382 aa, Arabidopsis thaliana
  misc_feature (1)..(382): Ceres CDNA ID no. 36547964
  misc_feature (160)..(380): Pfam Name: PEARLI-4 Pfam Description: Arabidopsis phospholipase-like protein PEARLI 4)
  misc_feature: Phenotype: FLOWER - Reduced fertility Useful for sterility, genetic confinement systems
MDVNRKAHPDCRYSSNPFHECASDCLEKISQGRGNKNSKKQGSKILSLPGSFGKKKTESQPPSPLSTRNYQNGAANTPKVRQSRPSPVAMKKTPVPEANKSLHSLSSDGISIDLNGQNDSFNHKQEKPSRTVPLSPNSMADRGKPLSPRPQGHEHSGKNDTASEISLFNVVSPPRSCANDDDDDDDENNGYEEGVELDLISVMSDSCVSVGKYRVNSSVSTILQSIIDKHGDIAANCKLESASMRSRYLECLCSLMQELGSTPVGQLTELKVKEMVAVLKDLESVNIDVGWMRSVLEEFAQYQENTDSEKERQEGLVRSKKQEMEIQEADLARIEKEVAEARLRVEEMKAELAELETERLRMEEMGFKVEKYKGKTFLDELL

SEQ ID NO: 3988 - DNA, 1206 bp, Populus balsamifera subsp. trichocarpa
  misc_feature (1)..(1206): Ceres ANNOT ID no. 1503630
  misc_feature 446314:<222: Transcription Factor
  misc_feature: Phenotype: FLOWER - Reduced fertility Useful for sterility, genetic confinement systems
atggctgagaatggaagggtacatccagattgtatgaatgcttcaaacccttaccatgaatgtggtgtagcttgccttgaaaggatttcccaagggaagagaaggaaagagaagaaacagtcaggttccattattgatgctgctttaagctttggtagaaaaaagaaggaatctggatctcagcagaactctccccgagctgttaacaatgtccctgtggtaaaagcagctcgccgtggtccatcacctcttcctactaaaaagcatgatgaagctgagaatagtggatcgttttcctcatctcaacaacgttctgatgaaagttattctgaagatcattcttttgacaaggggccagttcaatcccctggaccaatgcatgtgtctgggaatatcacgcctgatcctcccaagagccctacaaggcttagtttggcctgctataaaattccaacaccagctgagccgcaacagaatgggaagctccatggttcaccaaaggctgctacatatccttctgctaaccatgagggaaaagtcactgatggtcctatttccgagtatctggacttcagcttttcaggcatatctcgtgcttcagaagagagtgacgaggaagaggttcaatctgtcatctctgattcctgtgtgtcggtagggaaatatcacgtgagagaaaatattgcctctattctacagttaatcttggacaagtatggtgatatagcagcaggcagtcgattggaatcagcttccatgcgagcttattatttagagtgtctgtgctctgtggttcatgagttgcagtgcacttctttcaagcagttgacaaattccaaagttagagaaatgttggctgttctcaaggacgtagaatccgcacagattgatgttagttggctacgggatatactcaatgatctggccgaaggcatggagctgagcagtcagcatcaagctgcggaagaagcaaaatcaaagtgtgatcatgctatagagtcaataaaaaaagaactagaatccatgatggaggatctggctcaaaaagagaaggcagttgctgatgctaaagcacaaatctctgaaacaagagatcgcctgaataagctagagctcgattcttctcggttaagtgagactatttcttcaatctggtcgacagtcgaaaagtttcatgacaaacccttggccgatgagatcttgtaa

SEQ ID NO: 3989 - protein, 401 aa, Populus balsamifera subsp. trichocarpa
  misc_feature (1)..(401): Ceres ANNOT ID no. 1503630
  misc_feature (181)..(399): Pfam Name: PEARLI-4 Pfam Description: Arabidopsis phospholipase-like protein PEARLI 4)
  misc_feature 446388:<222: Transcription Factor
  misc_feature: Phenotype: FLOWER - Reduced fertility Useful for sterility, genetic confinement systems
  misc_feature (1)..(401): Functional Homolog of  Ceres CDNA ID no. 36547964 at SEQ ID NO. 4034 with e-value of 1.50E-55 and BLAST sequence identity of 41.4
MAENGRVHPDCMNASNPYHECGVACLERISQGKRRKEKKQSGSIIDAALSFGRKKKESGSQQNSPRAVNNVPVVKAARRGPSPLPTKKHDEAENSGSFSSSQQRSDESYSEDHSFDKGPVQSPGPMHVSGNITPDPPKSPTRLSLACYKIPTPAEPQQNGKLHGSPKAATYPSANHEGKVTDGPISEYLDFSFSGISRASEESDEEEVQSVISDSCVSVGKYHVRENIASILQLILDKYGDIAAGSRLESASMRAYYLECLCSVVHELQCTSFKQLTNSKVREMLAVLKDVESAQIDVSWLRDILNDLAEGMELSSQHQAAEEAKSKCDHAIESIKKELESMMEDLAQKEKAVADAKAQISETRDRLNKLELDSSRLSETISSIWSTVEKFHDKPLADEIL

SEQ ID NO: 3990 - protein, 423 aa, Arabidopsis thaliana
  misc_feature (1)..(423): Ceres CDNA ID no. 36550053
  misc_feature: Phenotype: WHOLE PLANT - Misc. Dwarf Useful for modulating plant size
MKERGKRTAMERRNDDVSLYYSTPSEFTCRKHPSVSSGVGICPYCLNDRLVNLVCSECGEQRLSSCSCSDISPTRTVDAAVDAAVGENVVRISSLIDEERAKQRKETKQRKTEEVVVFKRSSSSCVEINKRTKNHRFSRIGRFFRKINLKKERDFEKNNNNDSWVLDYNNDVKKLGVSRSRSLCSFRGKDLYCIGSEEDGSSYSGAFSAARSSSVNGGLGLCETEYSRKSNFEGRKSNFSETTEHWKSNFEGGRKSNFSETTTENRKSNFSESEPPRRSGFEARKSNFSETEYPTRRSNFSETEYNTRRGNNPATAENHPRRSSNYEAARKSDSAAMNFTRRVMSMKESSYFTGGEEPGFIDLKFDSSGGGGGDVNDGVLEHGGGGSCRKDGGELRKSRKSFKGWKWIFGHHQHQLHHHNRDS

SEQ ID NO: 3991 - DNA, 1194 bp, Populus balsamifera subsp. trichocarpa
  misc_feature (1)..(1194): Ceres ANNOT ID no. 1464088
  misc_feature 446602:<222: Transcription Factor
  misc_feature: Phenotype: WHOLE PLANT - Misc. Dwarf Useful for modulating plant size
atgaaagaaagaggcaaagccgtggagatgtacagcaatgatttgtttgatcaagattacagtacttcatcagatcttccatgcaagaaacacccatcatcatcttcagttggtatatgtgctcattgtctgaaagaccgtttggtcaatctagtctgttcagattgtggagagcaaagactctcttcttgctcttgctcggagatctcttccaatcgtaattcatgcactgtcgaggtaggcagtgttggtcgcatttcatttttgatagaaaatgaaaaacaaaaaaatgatcaagtttcacagtctagtaatattactgctaagcccaaaagttctagtaaggatcagaaaggagatgaacttaatttcatgctcaagaggagcagcagtagctgtgttgagatcaagaggaaaagtgggttttggaggattggaaggctgtttagtaagaaaagagggaagggctgtgataggagcagtgtcgggggtttcgaagagaaaagtgatgtgtgggttgttgattacatgggtgtgtctaggtgcaggtctctctgcagttttagaggtggtgggttttttggttctgaagatggcaccttttcaggtgctaggagttccatttcagctgctaggagttcaatttcagctgccagaaattcaggtgtcaatggtggtctactttttgatcctgacagaaaaagtgggttcagtgaggcagagccaagaaaaagtggctttgatggtgaaaagagagatgctactggtactgctttagagcctgaaaggcttgatcccggccacagtggaccaaataccagacgtgtattttcacttaaagaagggaattttactacagtggatgattcaggcttcattgacttgaagtttgatttcccatcagaatctaaagcagatttatcttctgtaaagatggtctctttgtcagattcacactctgctttggggagcctgagaggcggtgatgcggtggcgcaggatcaatatggagggcattttggtagtttagtgggagatgggcttttcagtcatgggggttcctgcaggatcacagtcagtgacagagggatcaagaggagcagaaaaagtttcaagagttggagatggattttcaggcagcatccaagtgcaaagaagaaagacgaagaccttgtggtcaaacccttaggttaa

SEQ ID NO: 3992 - protein, 397 aa, Populus balsamifera subsp. trichocarpa
  misc_feature (1)..(397): Ceres ANNOT ID no. 1464088
  misc_feature 446667:<222: Transcription Factor
  misc_feature: Phenotype: WHOLE PLANT - Misc. Dwarf Useful for modulating plant size
  misc_feature (1)..(397): Functional Homolog of  Ceres CDNA ID no. 36550053 at SEQ ID NO. 4037 with e-value of 1.40E-50 and BLAST sequence identity of 50.8
MKERGKAVEMYSNDLFDQDYSTSSDLPCKKHPSSSSVGICAHCLKDRLVNLVCSDCGEQRLSSCSCSEISSNRNSCTVEVGSVGRISFLIENEKQKNDQVSQSSNITAKPKSSSKDQKGDELNFMLKRSSSSCVEIKRKSGFWRIGRLFSKKRGKGCDRSSVGGFEEKSDVWVVDYMGVSRCRSLCSFRGGGFFGSEDGTFSGARSSISAARSSISAARNSGVNGGLLFDPDRKSGFSEAEPRKSGFDGEKRDATGTALEPERLDPGHSGPNTRRVFSLKEGNFTTVDDSGFIDLKFDFPSESKADLSSVKMVSLSDSHSALGSLRGGDAVAQDQYGGHFGSLVGDGLFSHGGSCRITVSDRGIKRSRKSFKSWRWIFRQHPSAKKKDEDLVVKPLG

SEQ ID NO: 3993 - DNA, 1326 bp, Populus balsamifera subsp. trichocarpa
  misc_feature (1)..(1326): Ceres ANNOT ID no. 1458774
  misc_feature 446775:<222: Transcription Factor
  misc_feature: Phenotype: WHOLE PLANT - Misc. Dwarf Useful for modulating plant size
atgcctgcagcctgcaggaacctagtggtttctttcatcactcgttttcttttcctccctgcttgggtacagtctgtggaaagaaaacgtaaagctaagaagacaaatcttttgagctcttgcagttatttccatttaaagagtagcacttcatcaaaagccatgaaagaaagaggcaaagcagtggagatgcacaacaatgacttgtttgatcaagattactgtacttcatcagatcttccatgcaagaaacacccatcatcgtcttcagttggtatatgtgcttattgtcttaaagaccgtttggtcaatctagtgtgttcagattgtggagaacaaagactctcttcttgctcttgctcggagatctcttccaatcgtaattcatgcactgtcgaggtaggcagtgttggtcgcatttcatttttgatagaaaatgaaaatcagaaaaatgatcaagttttacattctaatagtagtactgctaatcctaaaagttctagcggagatcagaaaggagatgaacttaatttcttggtcaagaggaacagtagtagctgcgttgagatcaagcggaaaaatgggttttgggggattgggaggctgttcagtaagaaaagaggaaagggttgtgatagaagcagtgtcgggggtctcgaagagaaaagtgatttgtgggttgttgattacatgggtgtgtctaggtgcaggtctctttgcagtttcagaggtggtggtttttttggctcagaagatggtaccttttcaggtgccaggagttccatttcagctgccaggagttctatttcagctgccaggaattcgggtgtcaatggtggtctactttttgatcctgatagaaaaagtggattcagtgaagcagagccaagaaaaagtggctttgatggtgaaaagagagatactactagtactgctttagagtctgaaaggcttgattctggtcacgacggagctaatactagacgtgtgttttccctcaaagagggcaattttactaccgtggatgattcaggcttcattgacttgaagtttgatttcccaccagagtctaaagcagatttatctgccgtaaaaatggtctcttcgtcggactcaaactctgcttttgggagcatgagaggcggtgacgttgtggcacaggatcaatatggagggtttgggagtctaatgggagatgggccttgcagtaatgggagttcctgcaggatcacagtcagtgacagaggaatcaaaaggagcagaaaaagtttcaagagttggagatggattttcaggcagcatccaagttcaaacaagaaagattaa

SEQ ID NO: 3994 - protein, 387 aa, Populus balsamifera subsp. trichocarpa
  misc_feature (1)..(387): Ceres ANNOT ID no. 1458774
  misc_feature 446846:<222: Transcription Factor
  misc_feature: Phenotype: WHOLE PLANT - Misc. Dwarf Useful for modulating plant size
  misc_feature (1)..(387): Functional Homolog of  Ceres CDNA ID no. 36550053 at SEQ ID NO. 4037 with e-value of 3.49E-47 and BLAST sequence identity of 50.0
MKERGKAVEMHNNDLFDQDYCTSSDLPCKKHPSSSSVGICAYCLKDRLVNLVCSDCGEQRLSSCSCSEISSNRNSCTVEVGSVGRISFLIENENQKNDQVLHSNSSTANPKSSSGDQKGDELNFLVKRNSSSCVEIKRKNGFWGIGRLFSKKRGKGCDRSSVGGLEEKSDLWVVDYMGVSRCRSLCSFRGGGFFGSEDGTFSGARSSISAARSSISAARNSGVNGGLLFDPDRKSGFSEAEPRKSGFDGEKRDTTSTALESERLDSGHDGANTRRVFSLKEGNFTTVDDSGFIDLKFDFPPESKADLSAVKMVSSSDSNSAFGSMRGGDVVAQDQYGGFGSLMGDGPCSNGSSCRITVSDRGIKRSRKSFKSWRWIFRQHPSSNKKD

SEQ ID NO: 3995 - protein, 502 aa, Arabidopsis thaliana
  misc_feature (1)..(502): Ceres CDNA ID no. 36553419
  misc_feature (31)..(496): Pfam Name: p450 Pfam Description: Cytochrome P450
  misc_feature: Utility: Cold Germination Useful for making plants with increased tolerance to cold stress
  misc_feature: Utility: Cold Growth Useful for making plants with increased tolerance to cold stress
  misc_feature: Phenotype: WHOLE PLANT - Cold Germination Useful for making plants with increased tolerance to cold stress
  misc_feature: Phenotype: WHOLE PLANT - Cold Growth Useful for making plants with increased tolerance to cold stress
MAISFLCVFLITFVSLIFFAKKIKRSKWNLPPSPPKFPVIGNLHQIGELPHRSLQHLAERYGPVMLLHFGFVPITVVSSREAAEEVLRTHDLDCCSRPKLVGTRLLSRDFKDIGFTPYGNEWKARRKFALRELFCLKKVQSFRHIREEECNFLVKQLSESAVDRSPVDLSKSLFWLTASILFRVALGQNFHESDFIDKEKIEELVFEAETALASFTCSDFFPVAGLGWLVDWFSGQHKRLNDVFYKLDALFQHVIDDHLNPGRSKEHEDIIDSMLDVIHKQGEDSSLELTIDHIKGFLANIFLAGIDTGAITMIWAVTELVKNPKLIKKVQGDIREQLGSNKERITEEDIEKVPYLKMVIKETFRLHPAAPLILPRETMAHIKVQGYDIPPKRRILVNVSAIGRDPKLWTNPKEFDPERFMDSFVDYRGQHYELLPFGSGRRICPGMPMGIAAVELGLLNLLYFFDWKLPDGMTHKDIDTEEAGTLTIVKKVPLKLVPVRVQ

SEQ ID NO: 3996 - DNA, 1449 bp, Populus balsamifera subsp. trichocarpa; identical to SEQ ID NO: 2091
  misc_feature (1)..(1449): Ceres ANNOT ID no. 1459723
  misc_feature 447098:<222: Transcription Factor
  misc_feature: Phenotype: WHOLE PLANT - Cold Germination Useful for making plants with increased tolerance to cold stress
  misc_feature: Phenotype: WHOLE PLANT - Cold Growth Useful for making plants with increased tolerance to cold stress

SEQ ID NO: 3997 - protein, 482 aa, Populus balsamifera subsp. trichocarpa; identical to SEQ ID NO: 2092
  misc_feature (1)..(482): Ceres ANNOT ID no. 1459723
  misc_feature (12)..(475): Pfam Name: p450 Pfam Description: Cytochrome P450
  misc_feature: SWISSPROT Homolog: C71BJ_ARATH Cytochrome P450 71B19 (EC 1.14.-.-) with e-value of 3.3e-274 and BLAST sequence identity of 100.0
  misc_feature: SWISSPROT Homolog: C71BK_ARATH Cytochrome P450 71B20 (EC 1.14.-.-) with e-value of 5.0e-262 and BLAST sequence identity of 95.0
  misc_feature: SWISSPROT Homolog: C71BH_ARATH Cytochrome P450 71B17 (EC 1.14.-.-) with e-value of 2.7e-224 and BLAST sequence identity of 79.2
  misc_feature: SWISSPROT Homolog: C71BG_ARATH Cytochrome P450 71B16 (EC 1.14.-.-) with e-value of 4.0e-221 and BLAST sequence identity of 77.9
  misc_feature: SWISSPROT Homolog: C71BM_ARATH Cytochrome P450 71B22 (EC 1.14.-.-) with e-value of 1.9e-166 and BLAST sequence identity of 60.0
  misc_feature 447226:<222: Transcription Factor
  misc_feature: Phenotype: WHOLE PLANT - Cold Germination Useful for making plants with increased tolerance to cold stress
  misc_feature: Phenotype: WHOLE PLANT - Cold Growth Useful for making plants with increased tolerance to cold stress
  misc_feature (1)..(482): Functional Homolog of  Ceres CDNA ID no. 36553419 at SEQ ID NO. 4047 with e-value of 1.69E-134 and BLAST sequence identity of 53.5

SEQ ID NO: 3998 - DNA, 1407 bp, Populus balsamifera subsp. trichocarpa; identical to SEQ ID NO: 2093
  misc_feature (1)..(1407): Ceres ANNOT ID no. 1516455
  misc_feature 447359:<222: Transcription Factor
  misc_feature: Phenotype: WHOLE PLANT - Cold Germination Useful for making plants with increased tolerance to cold stress
  misc_feature: Phenotype: WHOLE PLANT - Cold Growth Useful for making plants with increased tolerance to cold stress

SEQ ID NO: 3999 - protein, 443 aa, Populus balsamifera subsp. trichocarpa; identical to SEQ ID NO: 2094
  misc_feature (1)..(443): Ceres ANNOT ID no. 1516455
  misc_feature (363)..(436): Pfam Name: p450 Pfam Description: Cytochrome P450
  misc_feature: SWISSPROT Homolog: C71BJ_ARATH Cytochrome P450 71B19 (EC 1.14.-.-) with e-value of 3.3e-274 and BLAST sequence identity of 100.0
  misc_feature: SWISSPROT Homolog: C71BK_ARATH Cytochrome P450 71B20 (EC 1.14.-.-) with e-value of 5.0e-262 and BLAST sequence identity of 95.0
  misc_feature: SWISSPROT Homolog: C71BH_ARATH Cytochrome P450 71B17 (EC 1.14.-.-) with e-value of 2.7e-224 and BLAST sequence identity of 79.2
  misc_feature: SWISSPROT Homolog: C71BG_ARATH Cytochrome P450 71B16 (EC 1.14.-.-) with e-value of 4.0e-221 and BLAST sequence identity of 77.9
  misc_feature: SWISSPROT Homolog: C71BM_ARATH Cytochrome P450 71B22 (EC 1.14.-.-) with e-value of 1.9e-166 and BLAST sequence identity of 60.0
  misc_feature 447485:<222: Transcription Factor
  misc_feature: Phenotype: WHOLE PLANT - Cold Germination Useful for making plants with increased tolerance to cold stress
  misc_feature: Phenotype: WHOLE PLANT - Cold Growth Useful for making plants with increased tolerance to cold stress
  misc_feature (1)..(443): Functional Homolog of  Ceres CDNA ID no. 36553419 at SEQ ID NO. 4047 with e-value of 3.29E-113 and BLAST sequence identity of 53.9

SEQ ID NO: 4000 - protein, 333 aa, Arabidopsis thaliana
  misc_feature (1)..(333): Ceres CDNA ID no. 36554381
  misc_feature (77)..(141): Pfam Name: DnaJ Pfam Description: DnaJ domain
  misc_feature: Phenotype: INFLORESCENCE - Weak Useful for making stronger plants
  misc_feature: Phenotype: WHOLE PLANT - Other Useful for making bigger plants
MQTHLLVGPIPLKGYRRFSSSSFSGDLLPPSSNPIGRDLFPHRRRHRDGKSRSYRNRSKTTITSAAFSSSSNTGGQNHYAVLGIARNATQGDIKRAYRLLARKFHPDVNKDSKAGELFKSVRCSYEVLSNEATRTQYDRALKLQENSRFHRVKRHSYTPEVEDAMKYYYTWSEKRQRSRHGRFYGHYSTYPNSHFYAETEPQEEEGVETAPDQRDSFVEALKSAFLSMFLLYTFGCLASLTFSTFTALLDKELDMGYKVGFMIAWILGGKGGILLTLCLTFASWLCGKASSSVVVLVLVAMWVGSNLARHAPLPQGALLTLLYMSIKLQVDST

SEQ ID NO: 4001 - DNA, 999 bp, Populus balsamifera subsp. trichocarpa
  misc_feature (1)..(999): Ceres ANNOT ID no. 1523115
  misc_feature 447707:<222: Transcription Factor
  misc_feature: Phenotype: INFLORESCENCE - Weak Useful for making stronger plants
  misc_feature: Phenotype: WHOLE PLANT - Other Useful for making bigger plants
atgcaagcgcgcctcctcctggtgggacctatccccaccacaatcgacgcctctgcttcattctcctcctccagctccatcatcaccggtggccgcaattccctgatcggtagctggatctaccatcctaaccttgacaataaatcccgccatcgcaaaaacaacaaatggggctcgacagtggtagttgcatcatcatcgtcatcatgggcagcaatcaacggcggcgagcaagaccattacgcggtgctgggactcgagcggaccgccacttcagccgatattaaaaaagcttatcgctttcttgctcgaaagtatcatcctgatgtcagcaagcattcacaagctggtgagctgttcaagagcattcggcatgcatacgaaatactctctaatgaagtgacaaggactcagtatgatcgagtacttaggtttcaagaagaaactggcaggtcatatagcaaaaaccaatactatgcacctgaagttgaaaactgggtaaggatatacaggtgggctgaaatgaagcggaaaacgaggagcgagagatatagggagcattataacgtgagtgaggatccttccttctacagtgagacagaagaggaagccgaagaaggaagcctagatcaggaaagaggcccttttagcgaagtgctaagatctgcatttatctctctcttcttactgcatacttttggatctctattatctctcgccttcagcagtctcatggctttgttcgacagacaattggatgctgggtataagattggttatttgattgcatggattttgggtgggagaggtgggatttcgcttgttctgtgtctccaatttgctagctgggcatgtggaaagaggagcagcagcatggttgctctggtagtggtagccatgtgggttggttcaaatcttgctaggtttgctccactcccgcaaggtgctcttgttacacttctgtacatgtctattaagctgcaagcggacctaaattga

SEQ ID NO: 4002 - protein, 332 aa, Populus balsamifera subsp. trichocarpa
  misc_feature (1)..(332): Ceres ANNOT ID no. 1523115
  misc_feature (79)..(143): Pfam Name: DnaJ Pfam Description: DnaJ domain
  misc_feature: SWISSPROT Homolog: DNAJ_OCEIH Chaperone protein dnaJ with e-value of 6.4e-13 and BLAST sequence identity of 53.0
  misc_feature: SWISSPROT Homolog: DNJA3_MOUSE DnaJ homolog subfamily A member 3, with e-value of 1.2e-12 and BLAST sequence identity of 47.4
  misc_feature: SWISSPROT Homolog: DNJA3_MOUSE Tumorous imaginal discs protein Tid56 homolog DnaJ protein Tid-1 (mTid-1)
  misc_feature: SWISSPROT Homolog: DNJA3_HUMAN DnaJ homolog subfamily A member 3, with e-value of 1.2e-12 and BLAST sequence identity of 48.7
  misc_feature: SWISSPROT Homolog: DNJA3_HUMAN Tumorous imaginal discs protein Tid56 homolog DnaJ protein Tid-1 (hTid-1)
  misc_feature: SWISSPROT Homolog: DNAJ_ANASP Chaperone protein dnaJ with e-value of 1.5e-12 and BLAST sequence identity of 54.7
  misc_feature: SWISSPROT Homolog: DNAJ_BACST Chaperone protein dnaJ with e-value of 1.5e-12 and BLAST sequence identity of 44.6
  misc_feature 447830:<222: Transcription Factor
  misc_feature: Phenotype: INFLORESCENCE - Weak Useful for making stronger plants
  misc_feature: Phenotype: WHOLE PLANT - Other Useful for making bigger plants
  misc_feature (1)..(332): Functional Homolog of  Ceres CDNA ID no. 36554381 at SEQ ID NO. 4052 with e-value of 9.99E-87 and BLAST sequence identity of 56.6
MQARLLLVGPIPTTIDASASFSSSSSIITGGRNSLIGSWIYHPNLDNKSRHRKNNKWGSTVVVASSSSSWAAINGGEQDHYAVLGLERTATSADIKKAYRFLARKYHPDVSKHSQAGELFKSIRHAYEILSNEVTRTQYDRVLRFQEETGRSYSKNQYYAPEVENWVRIYRWAEMKRKTRSERYREHYNVSEDPSFYSETEEEAEEGSLDQERGPFSEVLRSAFISLFLLHTFGSLLSLAFSSLMALFDRQLDAGYKIGYLIAWILGGRGGISLVLCLQFASWACGKRSSSMVALVVVAMWVGSNLARFAPLPQGALVTLLYMSIKLQADLN

SEQ ID NO: 4003 - DNA, 1077 bp, Populus balsamifera subsp. trichocarpa
  misc_feature (1)..(1077): Ceres ANNOT ID no. 1479243
  misc_feature 447933:<222: Transcription Factor
  misc_feature: Phenotype: INFLORESCENCE - Weak Useful for making stronger plants
  misc_feature: Phenotype: WHOLE PLANT - Other Useful for making bigger plants
atggaagaaaaacaagtgtcgcgctcacttgatgtcctctctgcatgtgcatcatttgagaaacgaacgataatgcaggcgcacctcttcctggtgggacccatccccgccacaattgacgcctctgcttcctcctcctccagctccatcagcaggggtggccacaattccccgactcgtagctggagccgacaccgtaaatgtagcaataaatcccaccatcacaagaaaaacaacaagcggggcccaacaacagtggtagttgcatcatcatcatcatcatcatgggcagcattcaacggcggcgagcaagaccattatgcggtgctgggactcgaacgcaccgccacttcagccgatattaagaaagcttatcgccttcttgctcgaaagtatcatcctgatgttagcaagcattcacaagcttgtgagctgttcaagagtgttcggcatgcatatgaaatactctttaatgaagtgacaagggctcggtatgatcgagtacttagatttcaagaagatactggcaggtcatatagtaaaagacactattatactcccgaagttgaagactggggaaggatctacaaatgggctgaaatgaagcggaaaatgagaagtggggcacattgggagcactataacgtgagcgaggacccttccttctacagtgacacagaagaggaggctgaagaaggaagcctagatcaggaaagaggaccctttagcgaagtgctaagatctgcatttttatccctctttttactgcagactcttggatctctatcatctcttaccttcagtagtctcatggctttgttcgacagacaattggatgctgggtataagattggttatttcattgcatggattttgggtgggagaggtgggattctgcttgttctgtgtctccaatttgctagctgggcctgtggaaagacaagcagcagtgtggttgctctggtggtggtggccctgtgtgttggttcaaatcttgcgagggtcgctccactcccacacggtgctcttgtcacacttttgtacatgtctattaagctgcaagcggacctaaactga

SEQ ID NO: 4004 - protein, 334 aa, Populus balsamifera subsp. trichocarpa
  misc_feature (1)..(334): Ceres ANNOT ID no. 1479243
  misc_feature (81)..(145): Pfam Name: DnaJ Pfam Description: DnaJ domain
  misc_feature: SWISSPROT Homolog: DNAJ_OCEIH Chaperone protein dnaJ with e-value of 6.4e-13 and BLAST sequence identity of 53.0
  misc_feature: SWISSPROT Homolog: DNJA3_MOUSE DnaJ homolog subfamily A member 3, with e-value of 1.2e-12 and BLAST sequence identity of 47.4
  misc_feature: SWISSPROT Homolog: DNJA3_MOUSE Tumorous imaginal discs protein Tid56 homolog DnaJ protein Tid-1 (mTid-1)
  misc_feature: SWISSPROT Homolog: DNJA3_HUMAN DnaJ homolog subfamily A member 3, with e-value of 1.2e-12 and BLAST sequence identity of 48.7
  misc_feature: SWISSPROT Homolog: DNJA3_HUMAN Tumorous imaginal discs protein Tid56 homolog DnaJ protein Tid-1 (hTid-1)
  misc_feature: SWISSPROT Homolog: DNAJ_ANASP Chaperone protein dnaJ with e-value of 1.5e-12 and BLAST sequence identity of 54.7
  misc_feature: SWISSPROT Homolog: DNAJ_BACST Chaperone protein dnaJ with e-value of 1.5e-12 and BLAST sequence identity of 44.6
  misc_feature 448058:<222: Transcription Factor
  misc_feature: Phenotype: INFLORESCENCE - Weak Useful for making stronger plants
  misc_feature: Phenotype: WHOLE PLANT - Other Useful for making bigger plants
  misc_feature (1)..(334): Functional Homolog of  Ceres CDNA ID no. 36554381 at SEQ ID NO. 4052 with e-value of 2.79E-86 and BLAST sequence identity of 56.7
MQAHLFLVGPIPATIDASASSSSSSISRGGHNSPTRSWSRHRKCSNKSHHHKKNNKRGPTTVVVASSSSSSWAAFNGGEQDHYAVLGLERTATSADIKKAYRLLARKYHPDVSKHSQACELFKSVRHAYEILFNEVTRARYDRVLRFQEDTGRSYSKRHYYTPEVEDWGRIYKWAEMKRKMRSGAHWEHYNVSEDPSFYSDTEEEAEEGSLDQERGPFSEVLRSAFLSLFLLQTLGSLSSLTFSSLMALFDRQLDAGYKIGYFIAWILGGRGGILLVLCLQFASWACGKTSSSVVALVVVALCVGSNLARVAPLPHGALVTLLYMSIKLQADLN

SEQ ID NO: 4005 - protein, 633 aa, Arabidopsis thaliana
  misc_feature (1)..(633): Ceres CDNA ID no. 36560639
  misc_feature (554)..(604): Pfam Name: UPF0061 Pfam Description: Uncharacterized ACR, YdiU/UPF0061 family
  misc_feature: Phenotype: INFLORESCENCE - Late Flowering Useful for modulating flowering time
  misc_feature: Phenotype: ROSETTE LEAVES - Short Petioles Useful for modulating plant size
MLLRVCCPSSFFYLRPLHLFSSTAKVPFCPSLPRQFRLSPSRSSSFRRMESSPASSSSPTPVTDSSADSLAKDLQNQSLGAVDEGVKIKKKLEDFNWDHSFVKELPGDPRTDVISREVLHACYSKVSPSVEVDDPQLVAWSVSVAELLDLDPKEFERPDFPLMLSGAKPLPGAMSYAQCYGGHQFGMWAGQLGDGRAITLGEVLNSKGERWELQLKGAGRTPYSRFADGLAVLRSSIREFLCSETMHCLGIPTTRALCLLTTGQNVTRDMFYDGNPKEEPGAIVCRVSQSFLRFGSYQIHASRGKEDLDIVRKLADYAIKHHFPHIESMDRSDSLSFKTGDEDDSVVDLTSNKYAAWIVEIAERTATLVARWQGVGFTHGVLNTDNMSILGQTIDYGPFGFLDAFDPSYTPNTTDLPGRRYCFANQPDIGLWNIAQFSKTLAVAQLINQKEANYAMERYGDKFMDEYQAIMSKKLGLTKYNKEVISKLLNNMSVDKVDYTNFFRLLANVKANPNTPENELLKPLKAVLLDIGKERKEAWIKWMRSYIQEVGGSEVSDEERKARMDSVNPKYILRNYLCQSAIDAAEQGDFSEVNNLIRLMKRPYEEQPGMEKYARLPPAWAYRPGVCMLSCSS

SEQ ID NO: 4006 - DNA, 1941 bp, Populus balsamifera subsp. trichocarpa
  misc_feature (1)..(1941): Ceres ANNOT ID no. 1437702
  misc_feature 448318:<222: Transcription Factor
  misc_feature: Phenotype: INFLORESCENCE - Late Flowering Useful for modulating flowering time
  misc_feature: Phenotype: ROSETTE LEAVES - Short Petioles Useful for modulating plant size
atgccaccactgctttctcattcctcctcttcactctccctcctccgtcccttcctccctatcaaattccctttctaccctccccctttcgtcaaatcccaattctgccctctatcacctcctgctcacctcttcaaaccctccctgtcacgccacgtcagcacgagctccttcccttctagcagaggtagaggtagtagtgtttccatggagtcatcctcaccagaaccaactgtgtcactcgactccgtgacgcaggatttaaagaatcaaactttaggtcctgatgatgttagtaaggctaaattgaagcttgaagatctcaattgggaccattcttttgttagagcattgcccggggatccaagggctgatacaattccacgtcaggtgatgcatgcttgctatacgaaagtgttaccatctgctgaagtggagaaccctgagcttgttgcttggtctgattctgttgctgatttatttgatttggatcctaaagaatttgaaaggccagattttccccttttgttttcaggggcttctcctttggttggagcgttgccatatgctcagtgctatggaggacatcaatttgggatgtgggcaggtcagctgggtgatggtagggcaataacacttggggaggttgtaaattcaaagtctgaaaggtgggaactgcaacttaaaggttccgggaggactccgtatagccgttttgcagatggccttgcggttttgcgtagcagcattagggaatttctttgcagtgaagcaatgcactgtctaggaatcccgacaactcgtgcactttctctcgtgacaacaggaaaatatgttacccgtgacatgttttacgatggcaatgcaaaggaagaacctggtgctattgtttgccgagttgcaccatcctttcttcggtttggttcgtaccaaatacatgcctctagagggaaagaggaccttgaaattgttcgtgctttggcagattatgccatcagacatcattttcctcatattgagaacatgaataaaagcgagagcttatcttttagtacaggtgatgaagatcattcagttgtggatctgacctcaaacaagtatgcagcttggacagtggagattgctgaacggactgcttctatgatcgcaagctggcaaggggttggctttacacatggagtaatgaacactgacaacatgagtatactgggtctcaccattgattatggtccctttggattcctggatgcctttgatcctagtttcactccaaacaccacggatcttccaggaagaagatactgttttgcaaatcagcctgatattggtttatggaatattgcacagttcacagctaccctttcaactgccaagttgattagcgataaggaggcagattatgccatggaaagatatggaaacaaattcatggatgagtatcaagctatgatgactagaaaacttggccttccaaagtacaataaacaattgatcagcaaactccttaataatatggctgtggataaagttgattacacaaatttcttccggttgctttccaatgttaaagcagacccaaaaattccggaagatgagttgttagttcccctgaaggctgttcttttagatattggacaggagcgtaaagaggcatggatgagctgggtgcaatcctatgtgcatgagctggctgctagtgggatctcagatgagcagaggaaggcccaaatgaattcagtaaaccccaagtatgttctccgaaactacttgtgccagactgccattgatgcagctgaacaaggtgattacacagaggtcaggaggctccttaaattaatggagcggccgtatgatgagcagcctggaatggaaaaatatgctcgccttccaccagcctgggcgtatcggcctggtgtttgcatgctttcatgctcttcatga

SEQ ID NO: 4007 - protein, 646 aa, Populus balsamifera subsp. trichocarpa
  misc_feature (1)..(646): Ceres ANNOT ID no. 1437702
  misc_feature (188)..(523): Pfam Name: UPF0061 Pfam Description: Uncharacterized ACR, YdiU/UPF0061 family
  misc_feature: SWISSPROT Homolog: Y9953_RHOBA UPF0061 protein RB9953 with e-value of 6.8e-126 and BLAST sequence identity of 54.5
  misc_feature: SWISSPROT Homolog: Y2392_XANAC UPF0061 protein XAC2392 with e-value of 2.2e-116 and BLAST sequence identity of 54.8
  misc_feature: SWISSPROT Homolog: Y2284_XANCP UPF0061 protein XCC2284 with e-value of 2.8e-116 and BLAST sequence identity of 55.7
  misc_feature: SWISSPROT Homolog: Y1992_XYLFT UPF0061 protein PD1992 with e-value of 1.1e-112 and BLAST sequence identity of 55.7
  misc_feature: SWISSPROT Homolog: Y2619_XYLFA UPF0061 protein Xf2619 with e-value of 2.9e-112 and BLAST sequence identity of 56.1
  misc_feature 448457:<222: Transcription Factor
  misc_feature: Phenotype: INFLORESCENCE - Late Flowering Useful for modulating flowering time
  misc_feature: Phenotype: ROSETTE LEAVES - Short Petioles Useful for modulating plant size
  misc_feature (1)..(646): Functional Homolog of  Ceres CDNA ID no. 36560639 at SEQ ID NO. 4062 with e-value of 4.19E-264 and BLAST sequence identity of 76.96
MPPLLSHSSSSLSLLRPFLPIKFPFYPPPFVKSQFCPLSPPAHLFKPSLSRHVSTSSFPSSRGRGSSVSMESSSPEPTVSLDSVTQDLKNQTLGPDDVSKAKLKLEDLNWDHSFVRALPGDPRADTIPRQVMHACYTKVLPSAEVENPELVAWSDSVADLFDLDPKEFERPDFPLLFSGASPLVGALPYAQCYGGHQFGMWAGQLGDGRAITLGEVVNSKSERWELQLKGSGRTPYSRFADGLAVLRSSIREFLCSEAMHCLGIPTTRALSLVTTGKYVTRDMFYDGNAKEEPGAIVCRVAPSFLRFGSYQIHASRGKEDLEIVRALADYAIRHHFPHIENMNKSESLSFSTGDEDHSVVDLTSNKYAAWTVEIAERTASMIASWQGVGFTHGVMNTDNMSILGLTIDYGPFGFLDAFDPSFTPNTTDLPGRRYCFANQPDIGLWNIAQFTATLSTAKLISDKEADYAMERYGNKFMDEYQAMMTRKLGLPKYNKQLISKLLNNMAVDKVDYTNFFRLLSNVKADPKIPEDELLVPLKAVLLDIGQERKEAWMSWVQSYVHELAASGISDEQRKAQMNSVNPKYVLRNYLCQTAIDAAEQGDYTEVRRLLKLMERPYDEQPGMEKYARLPPAWAYRPGVCMLSCSS

SEQ ID NO: 4008 - protein, 254 aa, Arabidopsis thaliana; identical to SEQ ID NO: 3805
  misc_feature (1)..(254): Ceres CDNA ID no. 36560856
  misc_feature (63)..(112): Pfam Name: HLH Pfam Description: Helix-loop-helix DNA-binding domain
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: SILIQUES - Sickle Useful for modifying fruit shape, composition and seed yield
  misc_feature: Phenotype: ROSETTE LEAVES - Oval Shaped Useful for making plants with increased biomass and foliage

SEQ ID NO: 4009 - DNA, 780 bp, Populus balsamifera subsp. trichocarpa; identical to SEQ ID NO: 3806
  misc_feature (1)..(780): Ceres ANNOT ID no. 1517998
  misc_feature 448717:<222: Transcription Factor
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: SILIQUES - Sickle Useful for modifying fruit shape, composition and seed yield
  misc_feature: Phenotype: ROSETTE LEAVES - Oval Shaped Useful for making plants with increased biomass and foliage

SEQ ID NO: 4010 - protein, 259 aa, Populus balsamifera subsp. trichocarpa; identical to SEQ ID NO: 3807
  misc_feature (1)..(259): Ceres ANNOT ID no. 1517998
  misc_feature (67)..(116): Pfam Name: HLH Pfam Description: Helix-loop-helix DNA-binding domain
  misc_feature: SWISSPROT Homolog: SPT_ARATH Protein SPATULA with e-value of 2.5e-06 and BLAST sequence identity of 54.3
  misc_feature: SWISSPROT Homolog: PIF3_ARATH Phytochrome-interacting factor 3(Phytochrome-associated protein 3) (Basic helix-loop-helix protein 8) (bHLH8) (AtbHLH008) with e-value of 3.5e-06 and BLAST sequence identity of 45.6
  misc_feature 448812:<222: Transcription Factor
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: SILIQUES - Sickle Useful for modifying fruit shape, composition and seed yield
  misc_feature: Phenotype: ROSETTE LEAVES - Oval Shaped Useful for making plants with increased biomass and foliage
  misc_feature (1)..(259): Functional Homolog of  Ceres CDNA ID no. 36560856 at SEQ ID NO. 4065 with e-value of 1.50E-39 and BLAST sequence identity of 54.2

SEQ ID NO: 4011 - DNA, 780 bp, Populus balsamifera subsp. trichocarpa; identical to SEQ ID NO: 3808
  misc_feature (1)..(780): Ceres ANNOT ID no. 1458313
  misc_feature 448917:<222: Transcription Factor
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: SILIQUES - Sickle Useful for modifying fruit shape, composition and seed yield
  misc_feature: Phenotype: ROSETTE LEAVES - Oval Shaped Useful for making plants with increased biomass and foliage

SEQ ID NO: 4012 - protein, 259 aa, Populus balsamifera subsp. trichocarpa; identical to SEQ ID NO: 3809
  misc_feature (1)..(259): Ceres ANNOT ID no. 1458313
  misc_feature (67)..(116): Pfam Name: HLH Pfam Description: Helix-loop-helix DNA-binding domain
  misc_feature: SWISSPROT Homolog: SPT_ARATH Protein SPATULA with e-value of 2.5e-06 and BLAST sequence identity of 54.3
  misc_feature: SWISSPROT Homolog: PIF3_ARATH Phytochrome-interacting factor 3(Phytochrome-associated protein 3) (Basic helix-loop-helix protein 8) (bHLH8) (AtbHLH008) with e-value of 3.5e-06 and BLAST sequence identity of 45.6
  misc_feature 449012:<222: Transcription Factor
  misc_feature: Phenotype: WHOLE PLANT - Misc. Dwarf Useful for modulating plant size
  misc_feature: Phenotype: FLOWER - Reduced fertility Useful for sterility, genetic confinement systems
  misc_feature: Phenotype: SILIQUES - Sickle Useful for modifying fruit shape, composition and seed yield
  misc_feature: Phenotype: ROSETTE LEAVES - Oval Shaped Useful for making plants with increased biomass and foliage
  misc_feature (1)..(259): Functional Homolog of  Ceres CDNA ID no. 36560856 at SEQ ID NO. 4065 with e-value of 4.99E-39 and BLAST sequence identity of 51.5

SEQ ID NO: 4013 - protein, 128 aa, Arabidopsis thaliana
  misc_feature (1)..(128): Ceres CDNA ID no. 36566404
  misc_feature: Phenotype: ROSETTE LEAVES - Serrate Margins Useful for making plants with increased biomass and foliage
  misc_feature: Phenotype: ROSETTE LEAVES - Undulate Shaped Useful for making plants with increased biomass and foliage
MDLELLQDLSKFNFPTPIKIRSKTSKTKKDEGDDDEDDLRCSTPTSQEHKIPAVVDSPPPPPRKPRPPPSAPSATAALMIRSCKRKLLVSTCEIIMNREEIDRFFSSVYNETSTTAKRRRSYPYCSRR

SEQ ID NO: 4014 - DNA, 312 bp, Populus balsamifera subsp. trichocarpa
  misc_feature (1)..(312): Ceres ANNOT ID no. 1465208
  misc_feature 449173:<222: Transcription Factor
  misc_feature: Phenotype: ROSETTE LEAVES - Serrate Margins Useful for making plants with increased biomass and foliage
  misc_feature: Phenotype: ROSETTE LEAVES - Undulate Shaped Useful for making plants with increased biomass and foliage
atgtctagcgatcaggaactcttccaaaacttgccaaaacttggattgaaagtgataaagacgactcgtaatgatgatggtgaagatgatgactgtgagcaatatgagtgctgcactccaacatcagctcaacacaagattcccgccttgttaacctgtccaccagcaccaaagaaaccaccaagaagtccagattcatgcaagaggaaactgtcaaatctgcacttttttgaggttatgaaccgtgaagaggtggacttgttttttaggtcaagcaagaaggttggtttcgcctctggggtggtcgcctaa

SEQ ID NO: 4015 - protein, 103 aa, Populus balsamifera subsp. trichocarpa
  misc_feature (1)..(103): Ceres ANNOT ID no. 1465208
  misc_feature 449217:<222: Transcription Factor
  misc_feature: Phenotype: ROSETTE LEAVES - Serrate Margins Useful for making plants with increased biomass and foliage
  misc_feature: Phenotype: ROSETTE LEAVES - Undulate Shaped Useful for making plants with increased biomass and foliage
  misc_feature (1)..(103): Functional Homolog of  Ceres CDNA ID no. 36566404 at SEQ ID NO. 4070 with e-value of 4.60E-13 and BLAST sequence identity of 51.7
MSSDQELFQNLPKLGLKVIKTTRNDDGEDDDCEQYECCTPTSAQHKIPALLTCPPAPKKPPRSPDSCKRKLSNLHFFEVMNREEVDLFFRSSKKVGFASGVVA

SEQ ID NO: 4016 - DNA, 348 bp, Populus balsamifera subsp. trichocarpa
  misc_feature (1)..(348): Ceres ANNOT ID no. 1465207
  misc_feature 449278:<222: Transcription Factor
  misc_feature: Phenotype: ROSETTE LEAVES - Serrate Margins Useful for making plants with increased biomass and foliage
  misc_feature: Phenotype: ROSETTE LEAVES - Undulate Shaped Useful for making plants with increased biomass and foliage
atgtctacggatcttgaattactccatgatctgccaagaattcaagttcggcctgcaatcaagattgagaccctacaatcttgtagtgctacggatggcaataaagccataattcagcaagaaaacagcgaaactgatgacgactgtcaaacgccgaaatctgaagagcacaagattcctgccgttttaagctgtccgccggcgccacgaaaagcaaagaggaatatttcatgcaaaagaaagctgacagaaatcgacttctttgagatcgtgaacggtgaagaagtagattcgttttttcaatcaagttttgagcttcttacaaagagaaggtgcccttgtatatga

SEQ ID NO: 4017 - protein, 115 aa, Populus balsamifera subsp. trichocarpa
  misc_feature (1)..(115): Ceres ANNOT ID no. 1465207
  misc_feature 449322:<222: Transcription Factor
  misc_feature: Phenotype: ROSETTE LEAVES - Serrate Margins Useful for making plants with increased biomass and foliage
  misc_feature: Phenotype: ROSETTE LEAVES - Undulate Shaped Useful for making plants with increased biomass and foliage
  misc_feature (1)..(115): Functional Homolog of  Ceres CDNA ID no. 36566404 at SEQ ID NO. 4070 with e-value of 4.79E-11 and BLAST sequence identity of 52.4
MSTDLELLHDLPRIQVRPAIKIETLQSCSATDGNKAIIQQENSETDDDCQTPKSEEHKIPAVLSCPPAPRKAKRNISCKRKLTEIDFFEIVNGEEVDSFFQSSFELLTKRRCPCI

SEQ ID NO: 4018 - protein, 368 aa, Arabidopsis thaliana
  misc_feature (1)..(368): Ceres CDNA ID no. 36566773
  misc_feature (174)..(223): Pfam Name: HLH Pfam Description: Helix-loop-helix DNA-binding domain
  misc_feature: Phenotype: ROSETTE LEAVES - Curled 5 Useful for making ornamental plants with altered leaf shape
  misc_feature: Phenotype: WHOLE PLANT - Small Useful for modulating plant size
  misc_feature: Phenotype: ROSETTE LEAVES - Oval Shaped Useful for making plants with increased biomass and foliage
MCAKKEEEEEEEEDSSEAMNNIQNYQNDLFFHQLISHHHHHHHDPSQSETLGASGNVGSGFTIFSQDSVSPIWSLPPPTSIQPPFDQFPPPSSSPASFYGSFFNRSRAHHQGLQFGYEGFGGATSAAHHHHEQLRILSEALGPVVQAGSGPFGLQAELGKMTAQEIMDAKALAASKSHSEAERRRRERINNHLAKLRSILPNTTKTDKASLLAEVIQHVKELKRETSVISETNLVPTESDELTVAFTEEEETGDGRFVIKASLCCEDRSDLLPDMIKTLKAMRLKTLKAEITTVGGRVKNVLFVTGEESSGEEVEEEYCIGTIEEALKAVMEKSNVEESSSSGNAKRQRMSSHNTITIVEQQQQYNQR

SEQ ID NO: 4019 - DNA, 1629 bp, Populus balsamifera subsp. trichocarpa
  misc_feature (1)..(1629): Ceres ANNOT ID no. 1464046
  misc_feature 449500:<222: Transcription Factor
  misc_feature: Phenotype: ROSETTE LEAVES - Curled 5 Useful for making ornamental plants with altered leaf shape
  misc_feature: Phenotype: WHOLE PLANT - Small Useful for modulating plant size
  misc_feature: Phenotype: ROSETTE LEAVES - Oval Shaped Useful for making plants with increased biomass and foliage
atggagtggagagcaaacctagctagacagagagagaaagaggtggagtgtgttccaagacacaatgattacatggcctcggggaagcagaaaggttggggtggaaatagcgaagagtatggaagggcgtggggcttgaccgatcgagatatccccacccccacccctgatagctacagagatggatggatgaatagagaatgccgtaagaagaaaggaaaggagactagcagtacttacagactctatatatttagagtggtgggagagagaaaaatgttaagagaggtgcagatcagcacagaaagtgaaaaggagagagatatgtgtggacttaaagaggaagatcaaggagagtgttctcaaaccatccataacctacaaaactaccaagagcagctacttctacaataccaccaacaaatgcaacagcaccaacaacaacaaagcagtgatatctatggaggagctagaggatcaggatttattttccctgaagtttcacctatcttaccatggcctctcccccctgttcactctttcaacccggcgcacttcacgccaaaccacccagttcgtgatcatgacccatttcttatccctcctccagtaccatcctcatacgggggtttattcaatagaagagctccttcccttcagtttgcttatgatggtaccccaagtgatcatcttcggatcatatctgacactcttggaccggtggttcaacccggttcagctcctttcggtttacaagctgagttgagcaagatgactgctcaagaaattatggatgctaaggctcttgctgcttctaagagtcacagtgaagctgagaggagaagaagagagagaatcaacaaccacctagctaagctacgcagtttgctacccagcaccaccaaaacagacaaagcttcactgctagcagaagtgatccaacatgttaaagagctaaaacgccagactactttgatagccgaaacaagtccagtaccaacagaaatggatgagctaacagtggatacggctgatgaagatggtaagtttgtgatcaaagcatcactttgctgtgaagacaggcctgatctcttgcctgacctaataaagaccttgaaagctttacgtttaagaacattaaaagctgagatcacaacacttggtggacgtgtaaagaatgttttgtttattagtggtgaagaagattcatcaagtgatagcaatgatcaacatcagcagcaggaaccactacaatattctataagttcgattcaggaagcattgaaagcagttatggagaagactggaggtgatgagtcttcctcgggaagtgttaagagacagagaaccaatatcaatctccttgaacaacaacaacaacaacaacagcacagtttttgccagttaacaaagaaggcaatgatgccaccacaaccttcttcctgtcagtacattgttgcatcagtcttcccccgatcttgtttaaatttctcaaggggaagggaaaataaaacagaaaaaaagaaaaaccctagtgcggcattcatgtcctgtgggttacaagatgagcattacaatggtcgaatggtttgtccaattatggctaagctcaactacttgaatgggtaa

SEQ ID NO: 4020 - protein, 479 aa, Populus balsamifera subsp. trichocarpa
  misc_feature (1)..(479): Ceres ANNOT ID no. 1464046
  misc_feature (208)..(257): Pfam Name: HLH Pfam Description: Helix-loop-helix DNA-binding domain
  misc_feature: SWISSPROT Homolog: SPT_ARATH Protein SPATULA with e-value of 2.0e-09 and BLAST sequence identity of 29.2
  misc_feature: SWISSPROT Homolog: ARRS_MAIZE Anthocyanin regulatory R-S protein with e-value of 5.1e-08 and BLAST sequence identity of 24.4
  misc_feature: SWISSPROT Homolog: ARLC_MAIZE Anthocyanin regulatory Lc protein with e-value of 8.5e-07 and BLAST sequence identity of 25.3
  misc_feature: SWISSPROT Homolog: TT8_ARATH TRANSPARENT TESTA 8 protein (Basic helix-loop-helix protein 42) (bHLH42) (AtbHLH042) with e-value of 1.0e-06 and BLAST sequence identity of 32.1
  misc_feature: SWISSPROT Homolog: RAP1_ARATH Transcription factor AtMYC2 (R-homologous Arabidopsis protein 1) with e-value of 1.9e-06 and BLAST sequence identity of 41.9
  misc_feature: SWISSPROT Homolog: RAP1_ARATH RAP-1 (Basic helix-loop-helix protein 6) bHLH6 (AtbHLH006) (rd22BP1)
  misc_feature 449645:<222: Transcription Factor
  misc_feature: Phenotype: ROSETTE LEAVES - Curled 5 Useful for making ornamental plants with altered leaf shape
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature (1)..(479): Functional Homolog of  Ceres CDNA ID no. 36566773 at SEQ ID NO. 4075 with e-value of 9.20E-95 and BLAST sequence identity of 67.7
MNRECRKKKGKETSSTYRLYIFRVVGERKMLREVQISTESEKERDMCGLKEEDQGECSQTIHNLQNYQEQLLLQYHQQMQQHQQQQSSDIYGGARGSGFIFPEVSPILPWPLPPVHSFNPAHFTPNHPVRDHDPFLIPPPVPSSYGGLFNRRAPSLQFAYDGTPSDHLRIISDTLGPVVQPGSAPFGLQAELSKMTAQEIMDAKALAASKSHSEAERRRRERINNHLAKLRSLLPSTTKTDKASLLAEVIQHVKELKRQTTLIAETSPVPTEMDELTVDTADEDGKFVIKASLCCEDRPDLLPDLIKTLKALRLRTLKAEITTLGGRVKNVLFISGEEDSSSDSNDQHQQQEPLQYSISSIQEALKAVMEKTGGDESSSGSVKRQRTNINLLEQQQQQQQHSFCQLTKKAMMPPQPSSCQYIVASVFPRSCLNFSRGRENKTEKKKNPSAAFMSCGLQDEHYNGRMVCPIMAKLNYLNG

SEQ ID NO: 4021 - DNA, 1662 bp, Populus balsamifera subsp. trichocarpa
  misc_feature (1)..(1662): Ceres ANNOT ID no. 1458861
  misc_feature 449782:<222: Transcription Factor
  misc_feature: Phenotype: ROSETTE LEAVES - Curled 5 Useful for making ornamental plants with altered leaf shape
  misc_feature: Phenotype: WHOLE PLANT - Small Useful for modulating plant size
  misc_feature: Phenotype: ROSETTE LEAVES - Oval Shaped Useful for making plants with increased biomass and foliage
atgaatatacatgtaactgaaaccaagaaccttatggagtggagagcaaacctagctagacagagaaggaaagagatggagtgtgatcgaagacacaatgattacgtggtcttggggaagcagaaagggtggcgtggaaatatggaagaacgtgggaggcttgaccggtcgagagatatccccacgcccaccccagatggctacagagattggatggatggatggatggagaatgccagagagaagcctgaaacttgctttctttcttcggcttttcccttaccatctccaccaccaccaaagataaaagagtctagattactgaaaatcagtacagaattaagagtgacagagagagatatgtgtggacttaaagaagaagaccaagaagagcaaacaatccataacctccaaaactaccaagagcagctactttttcaataccaccaacaaatgcaacagcaccaccaacaacaaagcagtgatatctatggaggagcacgaggatcaggattgattttccctgaagtttcaccgatcttaccatggcctctccctccagcccactcttttaacccagatcacttcacttcaaatcacccagttcgtgaccatgacccatttcttatccctcctccaataccttcctcatatgggggtttattcaatagaagatctccttcccttcagtttgcttatgatggtacatcaagtgatcatcttaggattatatctgaaactcttggaccagtggttcaacccggttcagctcctttcgggttgcaagctgagttgagcaacatgactgctcaagaaatcatggatgctaaggctcttgctgcttctaagagtcacagtgaggctgagaggagaagaagagagagaatcaacaaccaccttgccaagctacgtagtttactacccagcacgaccaaaacagacaaagcttcactgctagcagaagtgatccaacatgttaaagagttaaaacgccagacttctttgatagccgaaacaagtccagtaccaacagaaatggatgagctaacagtggatacagctgatgaagatggtaagtttgtgctcaaagcatcgctttgctgcgaagataggtctgatctcttgcctgacctaataaaaaccttgaaagctttgcgtttaagaacactaaaagctgagatcacgacacttggtggacgtgtaaagaatgttttgttcattgctggtgaagaagattcatcaagtgatagcaatgatcatcaacagcaacagcaaccactgcaatattctataagctcaattcaagaagcactgaaatcggttatggagaagacaggtggtgacgagtcttcttcaggaagtgttaagagacaaagaaccaatatcaatgtccttcaacaacaacacagagaagagagaatggatatattgcgggctggtgcctggtggggttacctttccattttgttgtcggatgttagtgcagagagagaaaaggggtggtttggtggaatttatggatcatcatgtatgatgcatggtgacgatattgttgttcccgtcatgtgctacttccctactgaccaccaccaccaccttcttcctggcagtacaatgttgcttcagtcatctccggatcttgttttaatttctcaagggtaa

SEQ ID NO: 4022 - protein, 528 aa, Populus balsamifera subsp. trichocarpa
  misc_feature (1)..(528): Ceres ANNOT ID no. 1458861
  misc_feature (256)..(305): Pfam Name: HLH Pfam Description: Helix-loop-helix DNA-binding domain
  misc_feature: SWISSPROT Homolog: SPT_ARATH Protein SPATULA with e-value of 2.0e-09 and BLAST sequence identity of 29.2
  misc_feature: SWISSPROT Homolog: ARRS_MAIZE Anthocyanin regulatory R-S protein with e-value of 5.1e-08 and BLAST sequence identity of 24.4
  misc_feature: SWISSPROT Homolog: ARLC_MAIZE Anthocyanin regulatory Lc protein with e-value of 8.5e-07 and BLAST sequence identity of 25.3
  misc_feature: SWISSPROT Homolog: TT8_ARATH TRANSPARENT TESTA 8 protein (Basic helix-loop-helix protein 42) (bHLH42) (AtbHLH042) with e-value of 1.0e-06 and BLAST sequence identity of 32.1
  misc_feature: SWISSPROT Homolog: RAP1_ARATH Transcription factor AtMYC2 (R-homologous Arabidopsis protein 1) with e-value of 1.9e-06 and BLAST sequence identity of 41.9
  misc_feature: SWISSPROT Homolog: RAP1_ARATH RAP-1 (Basic helix-loop-helix protein 6) bHLH6 (AtbHLH006) (rd22BP1)
  misc_feature 449927:<222: Transcription Factor
  misc_feature: Phenotype: ROSETTE LEAVES - Curled 5 Useful for making ornamental plants with altered leaf shape
  misc_feature: Phenotype: WHOLE PLANT - Small Useful for modulating plant size
  misc_feature: Phenotype: ROSETTE LEAVES - Oval Shaped Useful for making plants with increased biomass and foliage
  misc_feature (1)..(528): Functional Homolog of  Ceres CDNA ID no. 36566773 at SEQ ID NO. 4075 with e-value of 8.29E-94 and BLAST sequence identity of 68.5
MECDRRHNDYVVLGKQKGWRGNMEERGRLDRSRDIPTPTPDGYRDWMDGWMENAREKPETCFLSSAFPLPSPPPPKIKESRLLKISTELRVTERDMCGLKEEDQEEQTIHNLQNYQEQLLFQYHQQMQQHHQQQSSDIYGGARGSGLIFPEVSPILPWPLPPAHSFNPDHFTSNHPVRDHDPFLIPPPIPSSYGGLFNRRSPSLQFAYDGTSSDHLRIISETLGPVVQPGSAPFGLQAELSNMTAQEIMDAKALAASKSHSEAERRRRERINNHLAKLRSLLPSTTKTDKASLLAEVIQHVKELKRQTSLIAETSPVPTEMDELTVDTADEDGKFVLKASLCCEDRSDLLPDLIKTLKALRLRTLKAEITTLGGRVKNVLFIAGEEDSSSDSNDHQQQQQPLQYSISSIQEALKSVMEKTGGDESSSGSVKRQRTNINVLQQQHREERMDILRAGAWWGYLSILLSDVSAEREKGWFGGIYGSSCMMHGDDIVVPVMCYFPTDHHHHLLPGSTMLLQSSPDLVLISQG

SEQ ID NO: 4023 - protein, 478 aa, Arabidopsis thaliana
  misc_feature (1)..(478): Ceres CDNA ID no. 36567494
  misc_feature (176)..(207): Pfam Name: Kelch_1 Pfam Description: Kelch motif
  misc_feature (21)..(66): Pfam Name: F-box Pfam Description: F-box domain
  misc_feature (348)..(385): Pfam Name: Kelch_2 Pfam Description: Kelch motif
  misc_feature: Phenotype: ROSETTE LEAVES - Cup-shaped Useful for making ornamental plants with altered leaf shape
MAAESTRNSSPPSTSQSSSPIINLPDDHLLTILLLLPVDSILSFSMTCKRYKSLACSDSLWEALCEREWGPTSVDALKLSSLRDGFSWMLMFQRVYKMDSVCCHKISDPDDDDEESSSFPIPRASHSLNFVNDHLVLFGGGCQGGRHLDDTWTSYVDKSNQSILKWKKVKSGTPSGRFGHTCIVIGEYLLLFGGINDRGERLNDTWIGQVFCHEGLSWKLLNVGSLQRPRPPPRGAHSACCIAEKKMVVHGGIGLNGVRLGDTWILELSEDFSSGTWHMVESPQLPPPRSGHTLTCIRENQVVLFGGRGLGYDVLDDVWILDIQEPCEEKWIQIFYDFQDVPEYASLPRVGHSATLVLGGRILIYGGEDSYRHRKDDFWVLDVKTIPSSGLKPQGLSLNGSSVWKKLDRISYGPKSRSFHRACADCSGRFLYVFGGMVDGLLQPAASSGLRFDGELFMVELVLGFSDLDHQQRPGKSM

SEQ ID NO: 4024 - DNA, 1503 bp, Populus balsamifera subsp. trichocarpa
  misc_feature (1)..(1503): Ceres ANNOT ID no. 1465272
  misc_feature 450206:<222: Transcription Factor
  misc_feature: Phenotype: ROSETTE LEAVES - Cup-shaped Useful for making ornamental plants with altered leaf shape
atgactactttcttcatggctgagacaagcactagtactacaagcagcaacattggatcgtcgtcgccaattgttaagctagctcaagaccatctcttcacaatcttgcttctgcttcctatagattcactcatctcctttgccaggacttgcaaaaggttcaggtccttaacaagttctgatacactgtgggagtccatatgcaggagggagtgggggtccacatcagtggatgccctcaagtcttctatcaataccaaaaacaatcagcagttgccatggatgaggctatacaagcaggtgtctcagcttgactcagtttcctgccataaactgtccgacccagatagtgaattgatgctcccaactcccagggcttctcactgtcttaactttgtatctgattgcctggtcttgtttggtggtggctgtgaaggagggcgagatctcgatgatacatgggtggcatacataggtaatgattttcaaaggatgctgaagtggcagaaagttaattcaggaattccaaacgggagatttgggcatgcatgcatcgtcattggcgattatctggtgctctttggaggaattaatgatcgtgggattcgtcaaaatgatacatgggtggggaaagtagtgctcagtgagaaccttggtataacattgtcatggaggctgcttgatgtgagatccatagcaccacctccccgtggggctcatgctgcttgctgcattgataaaagtacaatggtcatccatggagggattggattgtacggccttagaatgggagacacttggattctagaactttcagaaaatttctgttctggaacatggagggagctggtgactcatccatcacctccagctcgttcaggacacacattaacatgcatcgaaggaacaggaattgttctatttggaggaagaggttcaggttatgatgtgctgcatgatgtctggctcttgcaggtgtctgaggttgaactcaagtggatacagattctctataatttgcaagacatacctgcaggagtctccctcccacgagtcggccactcagccacactgattttgggaggtcggctgctaatctatggaggtgaagattcacagcggcacaggaaggacgatttttgggtattggatgttagtaagatcccatcaaataaagcgcagtctccattaaactcaaggggattgcaggcaaataatatgtggaaaatgctcaaggcaaagggttataaaccctaccgcagatcattccaccgagcctgtgcggatcattcagggtgtcgcttgtacgtttttggtggaatggtggatggcttacttcagcctgccgaagcatatgggttgaggtttgatggggagctctttctggtcaaattggagctggaaacagatatagtaaggccataccatctggcggctgaaaagagcctctttaagtttcttcagaaagaaatcccatgttctgttgacaaactagagctgtaa

SEQ ID NO: 4025 - protein, 495 aa, Populus balsamifera subsp. trichocarpa
  misc_feature (1)..(495): Ceres ANNOT ID no. 1465272
  misc_feature (173)..(204): Pfam Name: Kelch_1 Pfam Description: Kelch motif
  misc_feature (19)..(64): Pfam Name: F-box Pfam Description: F-box domain
  misc_feature (345)..(382): Pfam Name: Kelch_2 Pfam Description: Kelch motif
  misc_feature: SWISSPROT Homolog: ADO2_ARATH Adagio protein 2 (LOV kelch protein 2) with e-value of 3.2e-33 and BLAST sequence identity of 28.9
  misc_feature: SWISSPROT Homolog: ADO2_ARATH Flavin-binding kelch repeat F-box protein 1-like protein 1 FKF1-like protein 1 (F-box only protein 2c) (FBX2c)
  misc_feature: SWISSPROT Homolog: ADO3_ARATH Adagio protein 3 (Flavin-binding kelch repeat F-box protein 1) (F-box only protein 2a) (FBX2a) with e-value of 7.1e-32 and BLAST sequence identity of 27.9
  misc_feature: SWISSPROT Homolog: ADO1_ARATH Adagio protein 1 (Protein ZEITLUPE) (LOV kelch protein 1) with e-value of 3.1e-30 and BLAST sequence identity of 28.2
  misc_feature: SWISSPROT Homolog: ADO1_ARATH Flavin-binding kelch repeat F-box protein 1-like protein 2 FKF1-like protein 2 (F-box only protein 2b) (FBX2b) Clock-associated PAS protein ZTL
  misc_feature: SWISSPROT Homolog: RNGB_DICDI Ring finger protein B (Protein rngB) with e-value of 3.3e-21 and BLAST sequence identity of 31.0
  misc_feature: SWISSPROT Homolog: HCFC1_HUMAN Host cell factor (HCF) (HCF-1) (C1 factor)(VP16 accessory protein) with e-value of 5.6e-15 and BLAST sequence identity of 30.4
  misc_feature: SWISSPROT Homolog: HCFC1_HUMAN VCAF) (CFF) [Contains: HCF N-terminal chain 1; HCF N-terminal chain 2; HCF N-terminal chain 3; HCF N-terminal chain 4; HCF N-terminal chain 5; HCF N-terminal chain
  misc_feature 450364:<222: Transcription Factor
  misc_feature: Phenotype: ROSETTE LEAVES - Cup-shaped Useful for making ornamental plants with altered leaf shape
  misc_feature (1)..(495): Functional Homolog of  Ceres CDNA ID no. 36567494 at SEQ ID NO. 4080 with e-value of 8.39E-156 and BLAST sequence identity of 65.6
MAETSTSTTSSNIGSSSPIVKLAQDHLFTILLLLPIDSLISFARTCKRFRSLTSSDTLWESICRREWGSTSVDALKSSINTKNNQQLPWMRLYKQVSQLDSVSCHKLSDPDSELMLPTPRASHCLNFVSDCLVLFGGGCEGGRDLDDTWVAYIGNDFQRMLKWQKVNSGIPNGRFGHACIVIGDYLVLFGGINDRGIRQNDTWVGKVVLSENLGITLSWRLLDVRSIAPPPRGAHAACCIDKSTMVIHGGIGLYGLRMGDTWILELSENFCSGTWRELVTHPSPPARSGHTLTCIEGTGIVLFGGRGSGYDVLHDVWLLQVSEVELKWIQILYNLQDIPAGVSLPRVGHSATLILGGRLLIYGGEDSQRHRKDDFWVLDVSKIPSNKAQSPLNSRGLQANNMWKMLKAKGYKPYRRSFHRACADHSGCRLYVFGGMVDGLLQPAEAYGLRFDGELFLVKLELETDIVRPYHLAAEKSLFKFLQKEIPCSVDKLEL

SEQ ID NO: 4026 - DNA, 1413 bp, Populus balsamifera subsp. trichocarpa
  misc_feature (1)..(1413): Ceres ANNOT ID no. 1510814
  misc_feature 450490:<222: Transcription Factor
  misc_feature: Phenotype: ROSETTE LEAVES - Cup-shaped Useful for making ornamental plants with altered leaf shape
atggcaaagagtactcctagaagcagcaacattggatcatcatcagcatcaccgatagttaagctggctgatgaccatctcttcacaattatgcttctgcttcctgtagattcacttatctcctttgccatgacttgcaaaaggttcaggtccttaacaacttctgatacactgtgggagtccatatgcaggagggagtgggggtccacatcagtggatgccttcaagtcttctatcaataccaacaacaatcagcagttgccatggatgaggctatacaagcaggtgtctcagcttgactcattttcttgccataaactgcctgacccagatagtgacttgatgctcccaactcccagggcttctcactctctcaactttgtatctgattgcctggtcttgtttggtggtggccgtgaaggagggcgagatctcgatgatacatgggtggcatacataggtaaagattttcaaagaatgctaaaatggcagaaggttacctcaggaattccgagtgggagatttgggcatacttgcgccgtcattggcgaaaatcttgtgctttttggaggaattaatgatcgtgggatgcgtcaaaatgatacatgggtggggcaagtagtacttggtgagaaccttggtataacaacattgtcatggaggctgcttgatgtgagctccgtagcaccaccaccccgtggggctcatgctgcttgttgcattgataaaaggacaatggtcatccatggaggcattggattgtacggccttagattgggagatacttggattctagaactttcagagaatttctgttctggaacgtggatagagctggtggctcatccatcacctccacctcgttcaggacacacattgacatgtatcgaaggaacaggaactgttctatttggaggaagaggtttggggtatgatgtgctgcatgatgtctggctcttgcaagcgtctgaggatcaactcaagtgggtacagatgctctataatttgcaagacatacctgaaggagtctccctcccgcgagttggccactcagccacactaattttgggaggtcggctgctaatctatggaggtgaagattcacagagacacaggaagggagatttttgggtgttagatgttagtaagatcccatcaattaaagagcagtcaactccattaaattcaaggggattacaagcaaatatgtggagaaggctcaaggcaaagggttataaacccaactgcagatcattccatcgagcctgtgcagatcattcagggcgtcgcttgtacgtttttggtggaatggtggatagcttacttcaccctgccgaagcatctgagttgaggtttgatggggagctctttctggtaaaatttgagctggaaacaggagcagtaaggtgctga

SEQ ID NO: 4027 - protein, 470 aa, Populus balsamifera subsp. trichocarpa
  misc_feature (1)..(470): Ceres ANNOT ID no. 1510814
  misc_feature (173)..(227): Pfam Name: Kelch_2 Pfam Description: Kelch motif
  misc_feature (19)..(64): Pfam Name: F-box Pfam Description: F-box domain
  misc_feature: SWISSPROT Homolog: ADO2_ARATH Adagio protein 2 (LOV kelch protein 2) with e-value of 3.2e-33 and BLAST sequence identity of 28.9
  misc_feature: SWISSPROT Homolog: ADO2_ARATH Flavin-binding kelch repeat F-box protein 1-like protein 1 FKF1-like protein 1 (F-box only protein 2c) (FBX2c)
  misc_feature: SWISSPROT Homolog: ADO3_ARATH Adagio protein 3 (Flavin-binding kelch repeat F-box protein 1) (F-box only protein 2a) (FBX2a) with e-value of 7.1e-32 and BLAST sequence identity of 27.9
  misc_feature: SWISSPROT Homolog: ADO1_ARATH Adagio protein 1 (Protein ZEITLUPE) (LOV kelch protein 1) with e-value of 3.1e-30 and BLAST sequence identity of 28.2
  misc_feature: SWISSPROT Homolog: ADO1_ARATH Flavin-binding kelch repeat F-box protein 1-like protein 2 FKF1-like protein 2 (F-box only protein 2b) (FBX2b) Clock-associated PAS protein ZTL
  misc_feature: SWISSPROT Homolog: RNGB_DICDI Ring finger protein B (Protein rngB) with e-value of 3.3e-21 and BLAST sequence identity of 31.0
  misc_feature: SWISSPROT Homolog: HCFC1_HUMAN Host cell factor (HCF) (HCF-1) (C1 factor)(VP16 accessory protein) with e-value of 5.6e-15 and BLAST sequence identity of 30.4
  misc_feature: SWISSPROT Homolog: HCFC1_HUMAN VCAF) (CFF) [Contains: HCF N-terminal chain 1; HCF N-terminal chain 2; HCF N-terminal chain 3; HCF N-terminal chain 4; HCF N-terminal chain 5; HCF N-terminal chain
  misc_feature 450638:<222: Transcription Factor
  misc_feature: Phenotype: ROSETTE LEAVES - Cup-shaped Useful for making ornamental plants with altered leaf shape
  misc_feature (1)..(470): Functional Homolog of  Ceres CDNA ID no. 36567494 at SEQ ID NO. 4080 with e-value of 5.90E-155 and BLAST sequence identity of 65.9
MAKSTPRSSNIGSSSASPIVKLADDHLFTIMLLLPVDSLISFAMTCKRFRSLTTSDTLWESICRREWGSTSVDAFKSSINTNNNQQLPWMRLYKQVSQLDSFSCHKLPDPDSDLMLPTPRASHSLNFVSDCLVLFGGGREGGRDLDDTWVAYIGKDFQRMLKWQKVTSGIPSGRFGHTCAVIGENLVLFGGINDRGMRQNDTWVGQVVLGENLGITTLSWRLLDVSSVAPPPRGAHAACCIDKRTMVIHGGIGLYGLRLGDTWILELSENFCSGTWIELVAHPSPPPRSGHTLTCIEGTGTVLFGGRGLGYDVLHDVWLLQASEDQLKWVQMLYNLQDIPEGVSLPRVGHSATLILGGRLLIYGGEDSQRHRKGDFWVLDVSKIPSIKEQSTPLNSRGLQANMWRRLKAKGYKPNCRSFHRACADHSGRRLYVFGGMVDSLLHPAEASELRFDGELFLVKFELETGAVRC

SEQ ID NO: 4028 - protein, 326 aa, Arabidopsis thaliana
  misc_feature (1)..(326): Ceres CDNA ID no. 36567943
  misc_feature: Phenotype: ROSETTE LEAVES - Curled 3 Useful for making ornamental plants with altered leaf shape
MEALTFMKFWLTNNTTIKPRREIRISESAVDSTTGSEDPDLDLCEGEDSFFELKISLSDFKTPKEKQRLETTTTTTTYSVSNKSKVLPFVDISSKPQQSPTTLLKSGQKFRAFSFKKSEKSTTTEKKKEENNRTSLNVRFRVDDETTTTSFRKTASIARSQQTDDTMFDDSVSKRFFSLIKPLYTKSTKKQSSSTITSPTSSPATREKQRSNIPSGMRSVRRQLGKSRSASAAIGGMSPANRIDESLQVQQDGIQSAILHCKKSFHGSRESSLLSRSTSESSSQEKLSTSSSEDSYLFSRISSDSISEKSMDSLTSIKEQREKISD

SEQ ID NO: 4029 - DNA, 1080 bp, Populus balsamifera subsp. trichocarpa
  misc_feature (1)..(1080): Ceres ANNOT ID no. 1467355
  misc_feature 450846:<222: Transcription Factor
  misc_feature: Phenotype: ROSETTE LEAVES - Curled 3 Useful for making ornamental plants with altered leaf shape
atggaagctctctacttcctcaggttctggagacccaccaccaactcccacaaagaaaaccggccctctagtggaagcagtgatgacaccaccgagatcccattcacagattgtgaatttgaggagggagaagactcgttctttgaattggaacttactgtgcctgactttgacaccagtaaaagcagcagcagcagcaacaccaccagcataaaaaactaccacccactagacaaggaaagcaacatctttgaccctaaacaagcacctcccctcaatttagcccacaaagagagcaactccccccagcatatatttcatccaccaactctttcaactgatcatctcctttcgaagagaaaaatcctccctattgaacccgtttcattcaaacctcagtctccaatctccctactcaaatcagctccgaggtttaagatcctcatgttcaagaaatcaaagtcaatggcatcgcagaaaacagagaaaacaggggcgacagagtacttgaaagcaaataacaagaagcatgaaagcaacaagcttttcactgtcaagttcaagcttgaagaggtcacaaatatttctttcttcaccaaacagaacagcttgagaaagcagatctctcatgaatccgatgacaatgatacatcaaagcgattttcaaaggaaatgatacagaagtacttgaagctaatcaaaccattatacatcaaggtttccaagaagcatagtgacaagatgaaattctccagtgagttgtcagtcgggtctccgtcatcttctccggcaacagtgccggcgaaggagaaacaggggagttttccgtcagggattagagtggtttctaggcatcttggaaaaagcaaatcagcttcagcgaccacaggagtttctcctccagttgtgagtaggagagatgattctctgctgctacaacatgatgggattcaaagtgccatcctgcattgcaagaaatctttcaattcttcaagagattcttcttcaatgtcaagattcgtaagtgacccttcgcacgagaaatcaatgtcttcaccaaggatttcatctagtgaatag

SEQ ID NO: 4030 - protein, 359 aa, Populus balsamifera subsp. trichocarpa
  misc_feature (1)..(359): Ceres ANNOT ID no. 1467355
  misc_feature 450909:<222: Transcription Factor
  misc_feature: Phenotype: ROSETTE LEAVES - Curled 3 Useful for making ornamental plants with altered leaf shape
  misc_feature (1)..(359): Functional Homolog of  Ceres CDNA ID no. 36567943 at SEQ ID NO. 4085 with e-value of 6.90E-42 and BLAST sequence identity of 48.7
MEALYFLRFWRPTTNSHKENRPSSGSSDDTTEIPFTDCEFEEGEDSFFELELTVPDFDTSKSSSSSNTTSIKNYHPLDKESNIFDPKQAPPLNLAHKESNSPQHIFHPPTLSTDHLLSKRKILPIEPVSFKPQSPISLLKSAPRFKILMFKKSKSMASQKTEKTGATEYLKANNKKHESNKLFTVKFKLEEVTNISFFTKQNSLRKQISHESDDNDTSKRFSKEMIQKYLKLIKPLYIKVSKKHSDKMKFSSELSVGSPSSSPATVPAKEKQGSFPSGIRVVSRHLGKSKSASATTGVSPPVVSRRDDSLLLQHDGIQSAILHCKKSFNSSRDSSSMSRFVSDPSHEKSMSSPRISSSE

SEQ ID NO: 4031 - protein, 516 aa, Arabidopsis thaliana
  misc_feature (1)..(516): Ceres CDNA ID no. 36568595
  misc_feature (155)..(466): Pfam Name: PALP Pfam Description: Pyridoxal-phosphate dependent enzyme
MASFSLPHSATYFPSHSETSLKPHSAASFTVRCTSASPAVPPQTPQKPRRSPDENIRDEARRRPHQLQNLSARYVPFNAPPSSTESYSLDEIVYRSQSGALLDVQHDFAALKRYDGEFWRNLFDSRVGKTNWPYGSGVWSKKEWVLPEIDDDDIVSAFEGNSNLFWAERFGKQYLQMNDLWVKHCGISHTGSFKDLGMSVLVSQVNRLRKMNKPVIGVGCASTGDTSAALSAYCASAGIPSIVFLPADKISMAQLVQPIANGAFVLSIDTDFDGCMHLIREVTAELPIYLANSLNSLRLEGQKTAAIEILQQFNWQVPDWVIVPGGNLGNIYAFYKGFHMCKELGLVDRIPRLVCAQAANANPLYLHYKSGFKEDFNPLKANTTFASAIQIGDPVSIDRAVYALKKSNGIVEEATEEELMDATALADSTGMFICPHTGVALTALMKLRKSGVIGANDRTVVVSTAHGLKFTQSKIDYHSKNIKEMACRLANPPVKVKAKFGSVMDVLKEYLKSNDK

SEQ ID NO: 4032 - DNA, 1566 bp, Populus balsamifera subsp. trichocarpa
  misc_feature (1)..(1566): Ceres ANNOT ID no. 1490247
  misc_feature 451131:<222: Transcription Factor
atgccttcttcatatcttctccaatctcccagcttctccaccaatctcaagcttccctcaaaacccagaactcccacaccaaccccttgttctctctccgtcaaagcctcctcctcctcctcctcctcgaacaatacccccgccagcacctcaagcaaagggaacaacattcgcgacgaagcccgccgccaatacctcacaaacccaccacaaaaccagaacttctccgccaaatacgtccctttcaacgctgaccctgccaccaacacagagtcctactccctcgacgagatcgtctaccgatcccagtctggcggcctcctcgatgtccaacacgacatctccgccctcaaagcctttcctggctcctactggcgtgccctcttcgactctcgcgttggcaagaccacttggccttatggttccggtgtgtggtccaagaaagaatgggtcttgcctgagatttctagtgatgatattgtcagtgcctttgagggcaactctaatctcttctgggctgaaaggcttggtaaacacttccttgagatgaatgagttgtgggttaaacattgtgggattagccatacagggagttttaaagatctgggcatgactgttcttgttagtcaggttaatagattgagaaaaatgaacaaacctgtttttggtgttggctgtgcttcaacaggcgacacctctgctgctttgtctgcttattgtgcttctgctggtattccttctattgtatttttgcctgctaataagatctctattgcccagctcgtgcagcccattgccaatggcgcttttgttctgagtgttgatactgattttgatggctgtatgcagttgataagagaggttacgtctgagttgcctatttatttagccaattcgctaaatagtctgaggatagaagggcagaaaactgctgccatagagattttgcagcagtttgattgggaagtgcccgactgggttattattcctggtgggaatttggggaatatctatgctttttataaagggtttcatatgtgcaaagagttggggcttgtggataagattccaaggcttgtttgtgcacaggccgcgaatgccaatcctctctacttgtattataagtcagggtggaaggaatttaaagctgtgaaagccagtggtacatttgcatctgctattcagattggcgatcctgtttcaattgatagagctgtttatgcgctgaaacaatcgaatgggattgtcgaggaggctaccgaggaggagttaatggatgcaatggcgcaagcggattcgacggggatgtttatatgcccgcatacaggagtggcattgacggctttgatgaagcttaggaagagtggggttataggtccaactgatcggacagtggtggttagtactgcccatgggcttaagttcactcaaagtaagattgattatcactcgaataatattaaggaaatggcttgtaggtttgctaacccgcctgtgagtgttaaggctgattttggttctgttatggatgttttgaagaagtatttgagtaaaacaccaaagtag

SEQ ID NO: 4033 - protein, 521 aa, Populus balsamifera subsp. trichocarpa
  misc_feature (1)..(521): Ceres ANNOT ID no. 1490247
  misc_feature (161)..(471): Pfam Name: PALP Pfam Description: Pyridoxal-phosphate dependent enzyme
  misc_feature: SWISSPROT Homolog: THRC_SOLTU Threonine synthase, chloroplast precursor (EC 4.2.3.1) (TS) with e-value of 5.2e-221 and BLAST sequence identity of 82.3
  misc_feature: SWISSPROT Homolog: THRC_ARATH Threonine synthase, chloroplast precursor (EC 4.2.3.1) (TS) with e-value of 9.6e-220 and BLAST sequence identity of 81.9
  misc_feature: SWISSPROT Homolog: THRC_METJA Probable threonine synthase (EC 4.2.3.1) (TS) with e-value of 1.7e-62 and BLAST sequence identity of 39.8
  misc_feature: SWISSPROT Homolog: THRC_SYNY3 Threonine synthase (EC 4.2.3.1) with e-value of 5.0e-49 and BLAST sequence identity of 36.9
  misc_feature: SWISSPROT Homolog: THRC_MYCBO Probable threonine synthase (EC 4.2.3.1) with e-value of 1.9e-47 and BLAST sequence identity of 38.8
  misc_feature 451249:<222: Transcription Factor
  misc_feature (1)..(521): Functional Homolog of  Ceres CDNA ID no. 36568595 at SEQ ID NO. 4088 with e-value of 5.29E-218 and BLAST sequence identity of 83.1
MPSSYLLQSPSFSTNLKLPSKPRTPTPTPCSLSVKASSSSSSSNNTPASTSSKGNNIRDEARRQYLTNPPQNQNFSAKYVPFNADPATNTESYSLDEIVYRSQSGGLLDVQHDISALKAFPGSYWRALFDSRVGKTTWPYGSGVWSKKEWVLPEISSDDIVSAFEGNSNLFWAERLGKHFLEMNELWVKHCGISHTGSFKDLGMTVLVSQVNRLRKMNKPVFGVGCASTGDTSAALSAYCASAGIPSIVFLPANKISIAQLVQPIANGAFVLSVDTDFDGCMQLIREVTSELPIYLANSLNSLRIEGQKTAAIEILQQFDWEVPDWVIIPGGNLGNIYAFYKGFHMCKELGLVDKIPRLVCAQAANANPLYLYYKSGWKEFKAVKASGTFASAIQIGDPVSIDRAVYALKQSNGIVEEATEEELMDAMAQADSTGMFICPHTGVALTALMKLRKSGVIGPTDRTVVVSTAHGLKFTQSKIDYHSNNIKEMACRFANPPVSVKADFGSVMDVLKKYLSKTPK

SEQ ID NO: 4034 - DNA, 1560 bp, Populus balsamifera subsp. trichocarpa
  misc_feature (1)..(1560): Ceres ANNOT ID no. 1540534
  misc_feature 451374:<222: Transcription Factor
atggcttcctcgcatctcctccaatgtcccaacttctccaccaacctcaagctcccttccaagcccaccaccctcaaaaccaccccatctttcctcctcatcaaagccgcgtcctcctcaaacaacaacacctccacctcccccgccacaagcaataacattcgcgacgaagcccgccaccagaacctcactaacccgccacaaagccataacttttccgccaagtacgtcccttttggcgccgacccagccaccagcaccgaatcctactcactcgacgacatcgtctaccgctcccaatccggcggcctccttgatgtccatcacgacttctccgccctcaaagccttccctggctcctactggcgtgccctcttcgactctcgcgttggcaagacgacttggccttatggatccggtgtctggtccaagaaagaatgggtcttgcctgaaatttcgagtgatgatattgtcagtgcttttgaaggcaactctaatctcttctgggctgaaaggtttggcaagcaatttcttgaaatgaatgatttgtgggttaaacattgtgggattagtcatactgggagttttaaggatctgggcatgactgttcttgttagtcaggttaataggttgagaaaaatgaacaaacctctttttggtgttggctgtgcttcaacaggcgatacttctgctgccttgtctgcttattgtgcttctgctggtattccttctattgtctttttgcctgctaataagatatctatggcgcagcttgtgcagcccattgccaatggggcttttgttttgagtattgatactgattttgatggttgtatgcagttgataagagaggttacttccgagttacctatttatttagccaattcgcttaatagtttgaggttagaagggcagaaaactgctgccattgagattttgcagcagtttgattgggaagtgcccgagtgggttattgttcctggtgggaatttggggaatatttatgctttttataaagggtttcatatgtgcaaagagttggggcttgtggataagattccaaggcttgtttgtgcacaggctgcgaatgccaatcctctttacttgtattataagtcggcatggaaagaatttaaagctgtgaaagctaatagtacatttgcgtctgctattcagattggtgatcctgtttcaattgatagagctgtttatgcactgaaaaaatcaaatgggattgttgaggaggctactgaggaggagttaatggatgcaatggcacaggcagattcaacagggatgtttatttgtccacatacaggagtggcgttgacggctttgatgaagcttaggaagagtggtgttatacgttcgagtgatcggacggtggtggttagtactgcccacgggctgaagtttactcaaagtaagattgattatcactcgaataatattaaggaaatggcttgtaggtatgcgaatccgcctgttagtgttgcggctgattttggttctgttatggatgttttgaagaaatatttgagtaaaacacccaagtattag

SEQ ID NO: 4035 - protein, 519 aa, Populus balsamifera subsp. trichocarpa
  misc_feature (1)..(519): Ceres ANNOT ID no. 1540534
  misc_feature (158)..(468): Pfam Name: PALP Pfam Description: Pyridoxal-phosphate dependent enzyme
  misc_feature: SWISSPROT Homolog: THRC_SOLTU Threonine synthase, chloroplast precursor (EC 4.2.3.1) (TS) with e-value of 5.2e-221 and BLAST sequence identity of 82.3
  misc_feature: SWISSPROT Homolog: THRC_ARATH Threonine synthase, chloroplast precursor (EC 4.2.3.1) (TS) with e-value of 9.6e-220 and BLAST sequence identity of 81.9
  misc_feature: SWISSPROT Homolog: THRC_METJA Probable threonine synthase (EC 4.2.3.1) (TS) with e-value of 1.7e-62 and BLAST sequence identity of 39.8
  misc_feature: SWISSPROT Homolog: THRC_SYNY3 Threonine synthase (EC 4.2.3.1) with e-value of 5.0e-49 and BLAST sequence identity of 36.9
  misc_feature: SWISSPROT Homolog: THRC_MYCBO Probable threonine synthase (EC 4.2.3.1) with e-value of 1.9e-47 and BLAST sequence identity of 38.8
  misc_feature 451492:<222: Transcription Factor
  misc_feature (1)..(519): Functional Homolog of  Ceres CDNA ID no. 36568595 at SEQ ID NO. 4088 with e-value of 9.90E-217 and BLAST sequence identity of 82.5
MASSHLLQCPNFSTNLKLPSKPTTLKTTPSFLLIKAASSSNNNTSTSPATSNNIRDEARHQNLTNPPQSHNFSAKYVPFGADPATSTESYSLDDIVYRSQSGGLLDVHHDFSALKAFPGSYWRALFDSRVGKTTWPYGSGVWSKKEWVLPEISSDDIVSAFEGNSNLFWAERFGKQFLEMNDLWVKHCGISHTGSFKDLGMTVLVSQVNRLRKMNKPLFGVGCASTGDTSAALSAYCASAGIPSIVFLPANKISMAQLVQPIANGAFVLSIDTDFDGCMQLIREVTSELPIYLANSLNSLRLEGQKTAAIEILQQFDWEVPEWVIVPGGNLGNIYAFYKGFHMCKELGLVDKIPRLVCAQAANANPLYLYYKSAWKEFKAVKANSTFASAIQIGDPVSIDRAVYALKKSNGIVEEATEEELMDAMAQADSTGMFICPHTGVALTALMKLRKSGVIRSSDRTVVVSTAHGLKFTQSKIDYHSNNIKEMACRYANPPVSVAADFGSVMDVLKKYLSKTPKY

SEQ ID NO: 4036 - protein, 387 aa, Arabidopsis thaliana
  misc_feature (1)..(387): Ceres CDNA ID no. 36569105
  misc_feature (127)..(147): Pfam Name: IQ Pfam Description: IQ calmodulin-binding motif
  misc_feature: Phenotype: WHOLE PLANT - Large Useful for making bigger plants
  misc_feature: Phenotype: INFLORESCENCE - Tall Useful for making taller plants and plants with longer inflorescences
  misc_feature: Phenotype: ROSETTE LEAVES - Oval Shaped Useful for making plants with increased biomass and foliage
MGKTSKWFRSLLTGKKERTKEHIIQSECVFTSSIPGTPKEKRRWSFRRSSATGPPPPACAITLKDSPPPPPPPPPPPPLQQPFVVEIVDNEDEQIKNVSAEEIEEFAAIKIQACYRSHLARKALRALKGLVKLQALVRGHLVRKQATATLRCMQALITLQAKAREQRIRMIGGDSTNPRTSIHKTRINNFYHENEENIKIVEMDIQSKMYSPAPSALTEMSPRAYSSHFEDCNSFNTAQSSPQCFSRFKEYYNGDTLSSYDYPLFPNYMANTQSSKAKARSQSAPKQRPPEIYEKQMSGRRRSSMEAPRNNGVPRAVRMQRSSSQLGSNTAKESQQHHHHQYYPWMAIKLDRSNISLMESECGSTSTVMTNTNYGRHVDVQGNNNMY

SEQ ID NO: 4037 - DNA, 1293 bp, Populus balsamifera subsp. trichocarpa
  misc_feature (1)..(1293): Ceres ANNOT ID no. 1463445
  misc_feature 451734:<222: Transcription Factor
  misc_feature: Phenotype: WHOLE PLANT - Large Useful for making bigger plants
  misc_feature: Phenotype: INFLORESCENCE - Tall Useful for making taller plants and plants with longer inflorescences
  misc_feature: Phenotype: ROSETTE LEAVES - Oval Shaped Useful for making plants with increased biomass and foliage
atggggaagccaggcaaatggcttagaagtttcttgacagggaagaaagacaaggagaaggaaaagggtacaagtaatcagaattccacacctagtattgagaatccggtgactccaatttcgatcccaccaactactgcgaaagaaaaaagaagatggagttttcgcagatcatcggccacagcagctgctcccaaggactcgaattatacagaaccaactgccaccacacaaccagctgcagtgcaggacacgttcgattcagagaatgaacagaaaatgcacgccatggctatcgcaaacaaagaggctaaagccataaaaattcaatcagtctttcgatcttatctggcaagaaaagcattgcgtgcattaaaaggcttagtgaagttgcaggcacttgtaaggggtcacctggtgaggaaacaggcaactgccactctccggtgcatgcaggcattggtgaatgtacagactagagctcgggctcagaggatctggatgaatgaagacgtaaatcccagccagaggcaatcaatccacagaaaatcgactcaggagaacaggattaggcacacaaattatgagaatgaaagagtcatggatgagaacatcaagattgtggagatggacgttggagaatcaaagggaagtataaagagcagaaatagctactcacaccatccacaaacagatcgagcagagcacagattctccacacattctgccccaaatcatgcatacccgaagcaagagaactaccagatctctccagctccatcagctctaacagatatgagccccagagcctgcagtgggcattttgaggactattccttcagcacagcacaaagcagtccccagtactactctacagtgtcaaaacctgatccatcaacaattccatttgcctttccaaggccagagtatgcagaatccctgacctatgactactcattatttccaaattacatggcaaacacggaatcatccagggccaaagttcggtcacatagtgcaccgaaacaaaggccagactcatttgagaggcaaccaaaccggaggaaggtatcgatagagggaaggaatgtcccaagggcagtgcggatgcagcggtcatcttctcatgttggagccactgctcaaaactatcaatatccatggtcaattaagcttgacagatcatccgtttcacttaaagagagtgagtgcgaatccaacagtacgatgctcacgaacaccaattactgcagatctcttgttggatttgaagtgagtatgagccatccttaa

SEQ ID NO: 4038 - protein, 430 aa, Populus balsamifera subsp. trichocarpa
  misc_feature (1)..(430): Ceres ANNOT ID no. 1463445
  misc_feature (125)..(145): Pfam Name: IQ Pfam Description: IQ calmodulin-binding motif
  misc_feature 451823:<222: Transcription Factor
  misc_feature: Phenotype: WHOLE PLANT - Large Useful for making bigger plants
  misc_feature: Phenotype: INFLORESCENCE - Tall Useful for making taller plants and plants with longer inflorescences
  misc_feature: Phenotype: ROSETTE LEAVES - Oval Shaped Useful for making plants with increased biomass and foliage
  misc_feature (1)..(430): Functional Homolog of  Ceres CDNA ID no. 36569105 at SEQ ID NO. 4093 with e-value of 7.40E-77 and BLAST sequence identity of 64.5
MGKPGKWLRSFLTGKKDKEKEKGTSNQNSTPSIENPVTPISIPPTTAKEKRRWSFRRSSATAAAPKDSNYTEPTATTQPAAVQDTFDSENEQKMHAMAIANKEAKAIKIQSVFRSYLARKALRALKGLVKLQALVRGHLVRKQATATLRCMQALVNVQTRARAQRIWMNEDVNPSQRQSIHRKSTQENRIRHTNYENERVMDENIKIVEMDVGESKGSIKSRNSYSHHPQTDRAEHRFSTHSAPNHAYPKQENYQISPAPSALTDMSPRACSGHFEDYSFSTAQSSPQYYSTVSKPDPSTIPFAFPRPEYAESLTYDYSLFPNYMANTESSRAKVRSHSAPKQRPDSFERQPNRRKVSIEGRNVPRAVRMQRSSSHVGATAQNYQYPWSIKLDRSSVSLKESECESNSTMLTNTNYCRSLVGFEVSMSHP

SEQ ID NO: 4039 - DNA, 1344 bp, Populus balsamifera subsp. trichocarpa
  misc_feature (1)..(1344): Ceres ANNOT ID no. 1512677
  misc_feature 451951:<222: Transcription Factor
  misc_feature: Phenotype: WHOLE PLANT - Large Useful for making bigger plants
  misc_feature: Phenotype: INFLORESCENCE - Tall Useful for making taller plants and plants with longer inflorescences
  misc_feature: Phenotype: ROSETTE LEAVES - Oval Shaped Useful for making plants with increased biomass and foliage
atggggaagtcaggcaaatggcttaaaagtttcttgacagggaagaaagacaaggagagggagaagaaggtgaccccaatctcgatcccacctgctactcctaaagaaaaaagaagatggagttttcgcagatcatcagccactgcagctgctcccaaggactcgaattctacagaaccaattgccaccacacaaccagctgcggtgcagggaacgttggattcagataatgaacagaaaatgcacgcgatggctatggcagctgctgcggatgcagctatggccgctgcacaggctgcagctgctgtgatccgtctaactactgccacctccaggagaaacagtacaatcgaagaggatgctgccgtaaaaattcaatcagtctttcgatcttatttggcaagaaaagcattatgtgcattgaaaggcttagtgaagttgcaggcactcgtgaggggtcacctggtgaggaaacaggcaactgctacactcaggtgcatgcaggcattggtgaatgtacagactagagctcgggctcagaggatctggatggctgaagacgtaaagcccagccagaggaattcgatccacagaaaatcgacacaagagaataggattaggcacacaaatgatgagaatgatagaggcatggatcaggagaacatcaagattgtagaggtggatgttggagaatcgaagggaagtataaagagcagaaatggcttctctcatcgtccacaaacagatctaacagagcatagattttccacacattatgcctcaaatcatgcgtacttgaagaaagagaaccaccagatctctccagctccatcagctctaacagatatgagccccagtgcttgcagtgggcattttgaggaaaattccttcagcacagcacatagcagccctcagtactactctgcagtatcaaaacctgatccatcaagaattccattcgccttaccaaggccagagtacgcagaatctctgtcctatgactacccattatttccaaattacatggcaaacacagaatctttcagggccaaagttcggtcacatagtgcaccaaaacaaaggccagactcatttgagaggcaaccaagtaggaagagggcatcaatagagggaaggaatgtcccaaggcctatgcggatgcagcggtcgtcttccaatgttggagccacagctcaaggctatatatatccatggtcaattaagcttgacagaacaacagtatcacttagagatagtgagtgcggatccacaagtacagtgctcacaaacaccaatgactgcagttctcttgttggatttgaagtaagcatcagccatccttaa

SEQ ID NO: 4040 - protein, 447 aa, Populus balsamifera subsp. trichocarpa
  misc_feature (1)..(447): Ceres ANNOT ID no. 1512677
  misc_feature (141)..(161): Pfam Name: IQ Pfam Description: IQ calmodulin-binding motif
  misc_feature 452042:<222: Transcription Factor
  misc_feature: Phenotype: WHOLE PLANT - Large Useful for making bigger plants
  misc_feature: Phenotype: INFLORESCENCE - Tall Useful for making taller plants and plants with longer inflorescences
  misc_feature: Phenotype: ROSETTE LEAVES - Oval Shaped Useful for making plants with increased biomass and foliage
  misc_feature (1)..(447): Functional Homolog of  Ceres CDNA ID no. 36569105 at SEQ ID NO. 4093 with e-value of 3.49E-70 and BLAST sequence identity of 59.8
MGKSGKWLKSFLTGKKDKEREKKVTPISIPPATPKEKRRWSFRRSSATAAAPKDSNSTEPIATTQPAAVQGTLDSDNEQKMHAMAMAAAADAAMAAAQAAAAVIRLTTATSRRNSTIEEDAAVKIQSVFRSYLARKALCALKGLVKLQALVRGHLVRKQATATLRCMQALVNVQTRARAQRIWMAEDVKPSQRNSIHRKSTQENRIRHTNDENDRGMDQENIKIVEVDVGESKGSIKSRNGFSHRPQTDLTEHRFSTHYASNHAYLKKENHQISPAPSALTDMSPSACSGHFEENSFSTAHSSPQYYSAVSKPDPSRIPFALPRPEYAESLSYDYPLFPNYMANTESFRAKVRSHSAPKQRPDSFERQPSRKRASIEGRNVPRPMRMQRSSSNVGATAQGYIYPWSIKLDRTTVSLRDSECGSTSTVLTNTNDCSSLVGFEVSISHP

SEQ ID NO: 4041 - DNA, 1344 bp, Populus balsamifera subsp. trichocarpa
  misc_feature (1)..(1344): Ceres ANNOT ID no. 1459412
  misc_feature 452173:<222: Transcription Factor
  misc_feature: Phenotype: WHOLE PLANT - Large Useful for making bigger plants
  misc_feature: Phenotype: INFLORESCENCE - Tall Useful for making taller plants and plants with longer inflorescences
  misc_feature: Phenotype: ROSETTE LEAVES - Oval Shaped Useful for making plants with increased biomass and foliage
atggggaagtcaggcaaatggcttaaaagtttcttgacagggaagaaagacaaggagagggagaagaaggtgaccccaatctcgatcccacctgctactcctaaagaaaaaagaagatggagttttcgcagatcatcagccactgcagctgctcccaaggactcgaattctacagaaccaattgccaccacacaaccagctgcggtgcagggaacgttggattcagataatgaacagaaaatgcacgcgatggctatggcagctgctgcggatgcagctatggccgctgcacaggctgcagctgctgtgatccgtctaactactgccacctccaggagaaacagtacaatcgaagaggatgctgccgtaaaaattcaatcagtctttcgatcttatttggcaagaaaagcattatgtgcattgaaaggcttagtgaagttgcaggcactcgtgaggggtcacctggtgaggaaacaggcaactgctacactcaggtgcatgcaggcattggtgaatgtacagactagagctcgggctcagaggatctggatggctgaagacgtaaagcccagccagaggaattcgatccacagaaaatcgacacaagagaataggattaggcacacaaatgatgagaatgatagaggcatggatcaggagaacatcaagattgtagaggtggatgttggagaatcgaagggaagtataaagagcagaaatggcttctctcatcgtccacaaacagatctaacagagcatagattttccacacattatgcctcaaatcatgcgtacttgaagaaagagaaccaccagatctctccagctccatcagctctaacagatatgagccccagtgcttgcagtgggcattttgaggaaaattccttcagcacagcacatagcagccctcagtactactctgcagtatcaaaacctgatccatcaagaattccattcgccttaccaaggccagagtacgcagaatctctgtcctatgactacccattatttccaaattacatggcaaacacagaatctttcagggccaaagttcggtcacatagtgcaccaaaacaaaggccagactcatttgagaggcaaccaagtaggaagagggcatcaatagagggaaggaatgtcccaaggcctatgcggatgcagcggtcgtcttccaatgttggagccacagctcaaggctatatatatccatggtcaattaagcttgacagaacaacagtatcacttagagatagtgagtgcggatccacaagtacagtgctcacaaacaccaatgactgcagttctcttgttggatttgaagttcgtggaaataggtactaa

SEQ ID NO: 4042 - protein, 447 aa, Populus balsamifera subsp. trichocarpa
  misc_feature (1)..(447): Ceres ANNOT ID no. 1459412
  misc_feature (141)..(161): Pfam Name: IQ Pfam Description: IQ calmodulin-binding motif
  misc_feature 452264:<222: Transcription Factor
  misc_feature: Phenotype: WHOLE PLANT - Large Useful for making bigger plants
  misc_feature: Phenotype: INFLORESCENCE - Tall Useful for making taller plants and plants with longer inflorescences
  misc_feature: Phenotype: ROSETTE LEAVES - Oval Shaped Useful for making plants with increased biomass and foliage
  misc_feature (1)..(447): Functional Homolog of  Ceres CDNA ID no. 36569105 at SEQ ID NO. 4093 with e-value of 3.49E-70 and BLAST sequence identity of 59.8
MGKSGKWLKSFLTGKKDKEREKKVTPISIPPATPKEKRRWSFRRSSATAAAPKDSNSTEPIATTQPAAVQGTLDSDNEQKMHAMAMAAAADAAMAAAQAAAAVIRLTTATSRRNSTIEEDAAVKIQSVFRSYLARKALCALKGLVKLQALVRGHLVRKQATATLRCMQALVNVQTRARAQRIWMAEDVKPSQRNSIHRKSTQENRIRHTNDENDRGMDQENIKIVEVDVGESKGSIKSRNGFSHRPQTDLTEHRFSTHYASNHAYLKKENHQISPAPSALTDMSPSACSGHFEENSFSTAHSSPQYYSAVSKPDPSRIPFALPRPEYAESLSYDYPLFPNYMANTESFRAKVRSHSAPKQRPDSFERQPSRKRASIEGRNVPRPMRMQRSSSNVGATAQGYIYPWSIKLDRTTVSLRDSECGSTSTVLTNTNDCSSLVGFEVRGNRY

SEQ ID NO: 4043 - protein, 512 aa, Arabidopsis thaliana
  misc_feature (1)..(512): Ceres CDNA ID no. 36571789
  misc_feature (39)..(503): Pfam Name: p450 Pfam Description: Cytochrome P450
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: INFLORESCENCE - Short Useful for modulating plant height
  misc_feature: Phenotype: ROSETTE LEAVES - Other Useful for making ornamental plants with modified leaves
MDIISGQALLLLFCFILSCFLIFTTTRSGRISRGATALPPGPPRLPIIGNIHLVGKHPHRSFAELSKTYGPVMSLKLGSLNTVVIASPEAAREVLRTHDQILSARSPTNAVRSINHQDASLVWLPSSSARWRLLRRLSVTQLLSPQRIEATKALRMNKVKELVSFISESSDREESVDISRVAFITTLNIISNILFSVDLGSYNAKASINGVQDTVISVMDAAGTPDAANYFPFLRFLDLQGNVKTFKVCTERLVRVFRGFIDAKIAEKSSQNNPKDVSKNDFVDNLLDYKGDESELSISDIEHLLLDMFTAGTDTSSSTLEWAMTELLKNPKTMAKAQAEIDCVIGQNGIVEESDISKLPYLQAVVKETFRLHTPVPLLIPRKAESDAEILGFMVLKDTQVLVNVWAIGRDPSVWDNPSQFEPERFLGKDMDVRGRDYELTPFGAGRRICPGMPLAMKTVSLMLASLLYSFDWKLPKGVLSEDLDMDETFGLTLHKTNPLHAVPVKKRANIN

SEQ ID NO: 4044 - DNA, 1491 bp, Populus balsamifera subsp. trichocarpa
  misc_feature (1)..(1491): Ceres ANNOT ID no. 1444156
  misc_feature 452557:<222: Transcription Factor
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: INFLORESCENCE - Short Useful for modulating plant height
  misc_feature: Phenotype: ROSETTE LEAVES - Other Useful for making ornamental plants with modified leaves
atggagtaccttttttttgtgctactaatttcttttacttgggcatgtctacacgtgcccatcgcatccattctacttcgccggaagtccggttgcaccgtcctcccacctggccctcgccaattgccgataattggaaacatattagccctcggtgacaagccccaccgaacacttgctaacctctcacaaacttatggacctttaatgaccctcaagcttggtaggataaccacaatagtcatctcctctccgaacattgccaaagaagcattacagaaacatgaccaagccttgtccagcagaacagtcccagatgctcttcgtgtacaccacaaaaattcaatgatatggttgcctgcgtcgactcattggaaatttctcagaaaactcactgccacacaaatgttcacttcgcaaaggcttgatgccagccgagccctccgtggaaaaaaggttcaagaattgctagaatatgttcatgaaaactgtaacaatggacatgctgtcgacgttggtagatctgttttcacaactgtccttaatttaatttcaaacaccttcttctctcttgatgtaaccaattacaattctgatttgtctcaagaattcagcgatctcgtggtgggtgtcatggaacaaattggcaagccaaatattgccgactatttcccaatacttcgattagtagatccacaaggtataagacgaaagacgaataattatttgaaaagattaactcaaatttttgatagtatcatcaacgagaggacacgactacgttcttcttcggttgcatccaaggcaagccatgatgtacttgatgccctgctgattctagccaaagaaaacaatactgaattgagctccactgacatacaggttttgcttattgattttttcattgcgggcactgacactacctcaagcacagtagagtgggcaatgacagagttattactgaaccctgataaaatggtcaaagccaaaaatgagctccaacaagtcgaaggaccagttcaagaatcagacatctccaagtgtccttaccttcaagcaatagtcaaagagacatttcggctgcacccaccagttccactcctgctgccccgtaaagccgtatccgaagtagagatgcaaggcttcacagtgccaaaaaatgctcaaatactaatcaatatttgggcaataggaagagatccagccatatggccagatcctaattcgttcaagcctgaaaggttcctagaatgccaagctgacgtgaaaggaagagattttgagctaattccatttggagcaggaagaaggatttgccctggattgcctttgggccacaagatggtgcatttgacgttggcatctctcatccactcttttgattggaagattgctgatgacttgacaccagaggatatagacacgagtgaaacgtttgggattacattacataagagtgagcctctccgggctatacccatgaaaacgtga

SEQ ID NO: 4045 - protein, 496 aa, Populus balsamifera subsp. trichocarpa
  misc_feature (1)..(496): Ceres ANNOT ID no. 1444156
  misc_feature (36)..(492): Pfam Name: p450 Pfam Description: Cytochrome P450
  misc_feature: SWISSPROT Homolog: C76C1_ARATH Cytochrome P450 76C1 (EC 1.14.-.-) with e-value of 8.1e-271 and BLAST sequence identity of 100.0
  misc_feature: SWISSPROT Homolog: C76C2_ARATH Cytochrome P450 76C2 (EC 1.14.-.-) with e-value of 1.4e-209 and BLAST sequence identity of 77.3
  misc_feature: SWISSPROT Homolog: C76C4_ARATH Cytochrome P450 76C4 (EC 1.14.-.-) with e-value of 8.2e-207 and BLAST sequence identity of 75.6
  misc_feature: SWISSPROT Homolog: C76C3_ARATH Cytochrome P450 76C3 (EC 1.14.-.-) with e-value of 7.1e-153 and BLAST sequence identity of 56.1
  misc_feature: SWISSPROT Homolog: C76B1_HELTU Cytochrome P450 76B1 (EC 1.14.-.-) (7-ethoxycoumarin O-deethylase) (ECOD) (Phenylurea dealkylase) with e-value of 1.6e-100 and BLAST sequence identity of 44.7
  misc_feature 452713:<222: Transcription Factor
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: INFLORESCENCE - Short Useful for modulating plant height
  misc_feature: Phenotype: ROSETTE LEAVES - Other Useful for making ornamental plants with modified leaves
  misc_feature (1)..(496): Functional Homolog of  Ceres CDNA ID no. 36571789 at SEQ ID NO. 4100 with e-value of 2.60E-129 and BLAST sequence identity of 51.4
MEYLFFVLLISFTWACLHVPIASILLRRKSGCTVLPPGPRQLPIIGNILALGDKPHRTLANLSQTYGPLMTLKLGRITTIVISSPNIAKEALQKHDQALSSRTVPDALRVHHKNSMIWLPASTHWKFLRKLTATQMFTSQRLDASRALRGKKVQELLEYVHENCNNGHAVDVGRSVFTTVLNLISNTFFSLDVTNYNSDLSQEFSDLVVGVMEQIGKPNIADYFPILRLVDPQGIRRKTNNYLKRLTQIFDSIINERTRLRSSSVASKASHDVLDALLILAKENNTELSSTDIQVLLIDFFIAGTDTTSSTVEWAMTELLLNPDKMVKAKNELQQVEGPVQESDISKCPYLQAIVKETFRLHPPVPLLLPRKAVSEVEMQGFTVPKNAQILINIWAIGRDPAIWPDPNSFKPERFLECQADVKGRDFELIPFGAGRRICPGLPLGHKMVHLTLASLIHSFDWKIADDLTPEDIDTSETFGITLHKSEPLRAIPMKT

SEQ ID NO: 4046 - DNA, 1503 bp, Populus balsamifera subsp. trichocarpa
  misc_feature (1)..(1503): Ceres ANNOT ID no. 1497097
  misc_feature 452877:<222: Transcription Factor
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: INFLORESCENCE - Short Useful for modulating plant height
  misc_feature: Phenotype: ROSETTE LEAVES - Other Useful for making ornamental plants with modified leaves
atggagtaccttttttacctgctactaatttctttttgttgggcatgtctacacgtgctcaacgcatccgttctacttcgccggaagtccggttgcaccgtcctcccacctggccctcgccagttgccgataattggaaacatattagccctcggtgacaagccccaccgaacacttgctaaactctcacaaacttatggacctttaatgaccctcaagcttggtaggataaccacaatagtcatctcctctccgaatatcgccaaagaagcattacagaaacatgaccaagccttgtctagcagaacagtcccagatgctcttcatgtacaatactataactaccacaaaaattcaatggtatggttgcctgcgtcgactcattggaaatttctcagaaaactcactgccacacaaatgttcacttcgcaaaggcttgatgccagccgagccctccgtggaaaaaaggttcaagaattgctagaatatgttcatgaaaagtgcaacaacggacatgctgtcgacgttggtagatctgttttcacaactgtccttaatttaatttcaaacaccttcttctctcttgatgtaaccaattacaattctgatttgtctcaagagttcagcaatcttgtggtgggtgtcttggaacaaattggcaagccaaatattgccgactatttcccaatacttcgattagtagatccacaaggtataagacgaaagacgaataattatttgaaaagattaactcaaatttttgatagtatcatcaacgagaggacacgactacgttcttcttcggttgcatccaaggcaagccatgatgtacttgatgccctgctgattctagccaaagaaaacaatactgaattgagctccactgacatacaggttttgcttattgattttttcattgcgggcactgacactacctcaagcacagtagagtgggcaatgacagagttattactgaaccctgataaaatggtcaaagccaaaaatgagctccaacaagtcgaaggaccagttcaagaatcagacatctccaagtgtccttaccttcaagcaatagtcaaagagacatttcggctgcacccaccatcaccactcctgctgccccgtaaagccgtatccgaagtagagatgcaaggcttcacagtgcccaaaaatgcacaaatactaatcaatatttgggcaataggaagagatccagccatatggccagatcctaattcgttcaagcctgaaaggttcctagaatgccaagctgacgtgaaaggaagagattttgagctaattccatttggagcaggaagaaggatttgccctggattgcctttgggccacaagatggtgcatttgacgttggcatctctcatccactcttttgattggaagattgcaggtgacttgacaccagaggatatagacacgagtgaaacgtttgggcttacattacataagagtgagcctctccgggctatacccatgaaaacgtga

SEQ ID NO: 4047 - protein, 500 aa, Populus balsamifera subsp. trichocarpa
  misc_feature (1)..(500): Ceres ANNOT ID no. 1497097
  misc_feature (36)..(496): Pfam Name: p450 Pfam Description: Cytochrome P450
  misc_feature: SWISSPROT Homolog: C76C1_ARATH Cytochrome P450 76C1 (EC 1.14.-.-) with e-value of 8.1e-271 and BLAST sequence identity of 100.0
  misc_feature: SWISSPROT Homolog: C76C2_ARATH Cytochrome P450 76C2 (EC 1.14.-.-) with e-value of 1.4e-209 and BLAST sequence identity of 77.3
  misc_feature: SWISSPROT Homolog: C76C4_ARATH Cytochrome P450 76C4 (EC 1.14.-.-) with e-value of 8.2e-207 and BLAST sequence identity of 75.6
  misc_feature: SWISSPROT Homolog: C76C3_ARATH Cytochrome P450 76C3 (EC 1.14.-.-) with e-value of 7.1e-153 and BLAST sequence identity of 56.1
  misc_feature: SWISSPROT Homolog: C76B1_HELTU Cytochrome P450 76B1 (EC 1.14.-.-) (7-ethoxycoumarin O-deethylase) (ECOD) (Phenylurea dealkylase) with e-value of 1.6e-100 and BLAST sequence identity of 44.7
  misc_feature 453035:<222: Transcription Factor
  misc_feature: Phenotype: ROSETTE LEAVES - Disorganized Rosette Useful for making plants with increased biomass
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: ROSETTE LEAVES - Long Petioles Useful for making plants that grow better in shade
  misc_feature: Phenotype: INFLORESCENCE - Short Useful for modulating plant height
  misc_feature: Phenotype: ROSETTE LEAVES - Other Useful for making ornamental plants with modified leaves
  misc_feature (1)..(500): Functional Homolog of  Ceres CDNA ID no. 36571789 at SEQ ID NO. 4100 with e-value of 2.99E-128 and BLAST sequence identity of 51.2
MEYLFYLLLISFCWACLHVLNASVLLRRKSGCTVLPPGPRQLPIIGNILALGDKPHRTLAKLSQTYGPLMTLKLGRITTIVISSPNIAKEALQKHDQALSSRTVPDALHVQYYNYHKNSMVWLPASTHWKFLRKLTATQMFTSQRLDASRALRGKKVQELLEYVHEKCNNGHAVDVGRSVFTTVLNLISNTFFSLDVTNYNSDLSQEFSNLVVGVLEQIGKPNIADYFPILRLVDPQGIRRKTNNYLKRLTQIFDSIINERTRLRSSSVASKASHDVLDALLILAKENNTELSSTDIQVLLIDFFIAGTDTTSSTVEWAMTELLLNPDKMVKAKNELQQVEGPVQESDISKCPYLQAIVKETFRLHPPSPLLLPRKAVSEVEMQGFTVPKNAQILINIWAIGRDPAIWPDPNSFKPERFLECQADVKGRDFELIPFGAGRRICPGLPLGHKMVHLTLASLIHSFDWKIAGDLTPEDIDTSETFGLTLHKSEPLRAIPMKT

SEQ ID NO: 4048 - protein, 545 aa, Arabidopsis thaliana
  misc_feature (1)..(545): Ceres CDNA ID no. 36572659
  misc_feature (197)..(256): Pfam Name: La Pfam Description: La domain
  misc_feature: Phenotype: FLOWER - Reduced fertility Useful for sterility, genetic confinement systems
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
MADQQTLDSSTPPPTQSDDLSHSHSTSSTTSASSSSDPSLLRSLSLSRLNAGAPEFVPGRTTPPLPQPPRMIIPPPPPHGMLHMYHHQPPFNTPVLGPVPIQPHLVPVQNHHPHHRFHQHHHHNRHQNQQYVPVRNHGEYQQRGGVGGEQEPDLVSKKNDRRDHSKRESKNDQVTETGASVSIDSKTGLPEDSIQKIVNQVEYYFSDLNLATTDHLMRFICKDPEGYVPIHVVASFKKIKAVINNNSQLAAVLQNSAKLFVSEDGKKVRRISPITESAIEELQSRIIVAENLPEDHCYQNLMKIFSTVGSVKNIRTCQPQNNGSGAPPAARSAAKSDGTLFSNKVHAFVEYEIVELAERAVTELSEAGNWRSGLKVRLMLKHQTKEPKQGQGRGRKGHDADVEHEEDDATTSEQQPIEKQSDDCSGEWDTHMQEQPIGEDQGNEKAAGQRKGRNRGRGKGRGRGQPHQNQNQNNNHSHNQNHNHNGRGNHHHHHHHQVGTQPSNNPMNNMEQPGMGKQQPPGPRMPDGTRGFSMGRGKPVMVQAE

SEQ ID NO: 4049 - DNA, 1548 bp, Populus balsamifera subsp. trichocarpa
  misc_feature (1)..(1548): Ceres ANNOT ID no. 1455805
  misc_feature 453346:<222: Transcription Factor
  misc_feature: Phenotype: FLOWER - Reduced fertility Useful for sterility, genetic confinement systems
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
atggcacaacaaaatcaagaagaagaagaagaagaagtggtagcgatagtagaatctgtacctgaatccctagatcaatcctcttcttcttcttcttctggtccttcgctttctcgtaacgtgtccttcagtaaactcaacgcgcaagctccagcctttgtccccacgcgcccccaatctcagcctcaacctccaccacgaatgaccgtgatccctcctcctccgcctcctcccgccgctatgatgcatatgtatccaccaccttccccgtttcatgttccgattcatagccctgtacatttgcctcacgtcatccccgtccaaaaccacccccaccaccataaccaccatcacaacagccataaccaccttcacaaccaccagcagcatcataatcagcaccaacagtatgttcctgttcggaatcataaccagcatcatcaacagcataattctaaaaaggtgcagcagcactctgacgaagaggtcgaggttattgggaataaggatgcagctgcttcttcggatcatgcctcaaagagtgacagtaaaagtgatgaagctatgaataagctcttaaatcaggtggagtactatttcagtgatttgaacctggccactactgatcatcttatgaggtttattaccaaagatcctgaaggatatgtgccaatatctgttgttgcttcctttaagaaggttaaagctgccataaacagtaattctcagcttgctaacattctgcggaactcaacaaagcttgtagttagtgacgatggaaagaaagtaaggcgccagcatcccctaactgattcagatgttgaggagttgcaatctcgtatagttgttgctgaaaatttacctgaggatcattgccaccaaaacctcatgaagatattttctgctgttgggagtgtgaagacaattcgtacctgtccacctcaaacttctggtggtggtgcttcttcagcatctagatctgcaaaagctgatgggatgcatttcagtaacaagttgcatgcatttgtggaatatgagaccattgagattgctgagaaagcagttgctgagctaaacgatgagggaaactggaggagtggtcttagggttcggttaatgctcaagcgtgggtcaaaatccactcaggcacgaggcaagaaggggcatgatggtcaagggcattcagaggaagatgagatttctgcaactgagcaaatgccgaatgataaacagacagaagatctgtcccagcagcatgatgcccattcacatgagcattctggagaggatcatgccaatgacaaggaaggtgcgcagagaaaagggcgtaaccgggggaggggcaagggacgtgggcgaggtcaataccatcataacaaccatcacaataaccgtggaaatcatctgggaacttccccttcaaataatccagttattggcgagcatccagcaatggccaagcaacctccagggccacggatgccagatggcactagaggatttgcaatgggtcgagggaagccggctgctgttaataatatcgcatga

SEQ ID NO: 4050 - protein, 515 aa, Populus balsamifera subsp. trichocarpa
  misc_feature (1)..(515): Ceres ANNOT ID no. 1455805
  misc_feature (192)..(251): Pfam Name: La Pfam Description: La domain
  misc_feature: SWISSPROT Homolog: HRPX_PLALO Histidine-rich glycoprotein precursor with e-value of 5.8e-09 and BLAST sequence identity of 34.9
  misc_feature: SWISSPROT Homolog: LA_DROME La protein homolog (La ribonucleoprotein) (La autoantigen homolog) with e-value of 6.3e-09 and BLAST sequence identity of 29.9
  misc_feature: SWISSPROT Homolog: LA_AEDAL La protein homolog (La ribonucleoprotein) (La autoantigen homolog) with e-value of 1.0e-07 and BLAST sequence identity of 29.1
  misc_feature: SWISSPROT Homolog: LA_HUMAN Lupus La protein (Sjoegren syndrome type B antigen) (SS-B) (La ribonucleoprotein) (La autoantigen) with e-value of 1.3e-07 and BLAST sequence identity of 29.7
  misc_feature: SWISSPROT Homolog: LAA_XENLA Lupus La protein homolog A (La ribonucleoprotein A) (La autoantigen homolog A) with e-value of 6.3e-07 and BLAST sequence identity of 28.7
  misc_feature 453482:<222: Transcription Factor
  misc_feature: Phenotype: FLOWER - Reduced fertility Useful for sterility, genetic confinement systems
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature (1)..(515): Functional Homolog of  Ceres CDNA ID no. 36572659 at SEQ ID NO. 4105 with e-value of 9.80E-146 and BLAST sequence identity of 64.8
MAQQNQEEEEEEVVAIVESVPESLDQSSSSSSSGPSLSRNVSFSKLNAQAPAFVPTRPQSQPQPPPRMTVIPPPPPPPAAMMHMYPPPSPFHVPIHSPVHLPHVIPVQNHPHHHNHHHNSHNHLHNHQQHHNQHQQYVPVRNHNQHHQQHNSKKVQQHSDEEVEVIGNKDAAASSDHASKSDSKSDEAMNKLLNQVEYYFSDLNLATTDHLMRFITKDPEGYVPISVVASFKKVKAAINSNSQLANILRNSTKLVVSDDGKKVRRQHPLTDSDVEELQSRIVVAENLPEDHCHQNLMKIFSAVGSVKTIRTCPPQTSGGGASSASRSAKADGMHFSNKLHAFVEYETIEIAEKAVAELNDEGNWRSGLRVRLMLKRGSKSTQARGKKGHDGQGHSEEDEISATEQMPNDKQTEDLSQQHDAHSHEHSGEDHANDKEGAQRKGRNRGRGKGRGRGQYHHNNHHNNRGNHLGTSPSNNPVIGEHPAMAKQPPGPRMPDGTRGFAMGRGKPAAVNNIA

SEQ ID NO: 4051 - DNA, 1452 bp, Populus balsamifera subsp. trichocarpa
  misc_feature (1)..(1452): Ceres ANNOT ID no. 1529744
  misc_feature 453628:<222: Transcription Factor
  misc_feature: Phenotype: FLOWER - Reduced fertility Useful for sterility, genetic confinement systems
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
atggcacaacaaaatcaagaagaagaagaagagttagtggctgtagtagaatctgtacctgaaaccctagatcaatctccttcttcgtctgatccttcgctttctcgtaatgtttcctttagtaaactcaacgcacaagctcccgcctttgtccccacgcgcccccaacctcaacctcctccgcgattgtccgtgatccctccccctccccctcctcccgcgggcatgatgcatatgttccctccgtctccgtttcacgttccgattcatggccctgttcccttgcctcacgtcatccccgttccgaaccaccaccaccacaacaaccaccaccaccaccataatcatcccaatcagcatcaacagcagtatgttccggttcgaaagcataatcagctgcataattctaaaagggtgccgcagcaatttgaggaagaggttgaagtggttgtgaataaggatgcagcagcttcttcggatcatgcggctaagagtgatgaagctatgaataagctgttgaatcaggtggagtattatttcagtgatttgaacttggccactactgatcatcttatgaggtttatcaccaaggatcctgaaggatatgtgccaatatctgttgttgcttcctttaagaaggttaaagctgtcgtaaacaataattctcagcttgctaccattctgcggaactcaacaaagcttgtagttagtgaagatggaaagaaagtaagacgccagcatcccttaactgagtcagatgttgaggagttgcaatctcgtatagttgttgctgaaaatttacccgaggatcattgccaccaaaacctcatgaagatcttttctgctgttgggagtgtgaagactattcgcacctgtccacctcaaccttctggtggagcttcttcagcatctagatctggaaaagctgatgggatgcatttcagtaacaagttgcatgcatttgtggaatatgagactgtcgagattgctgagaaagcagttgctgagctaaatgatgagggaaactggaggagtggtcttaaggttcggttaatgctcaagcgtggggcacaaggaaagaaggggcatgatggtcaagggcattctgaggaagatgaggtttctgcttttgagcaaatgccgaatgaaaagctgacagaagatcaagcccagcagcctgatgtccattcacatgagcattctggagaggatcatgccaatgacaaggaaggtgcacagcgaaagcggaaccgggggcggggcaagggccgtgggcgaggtcaataccatcacaataaccaccacagtaaccacgggggaactcccccttcaaatccagttcttggtgagcatctgacaatggctaagcaaccacctgggccccgaatgcccgatggcacgagaggatttgcaatgggtcgagggaaactagttgctgtgaatatcgcatga

SEQ ID NO: 4052 - protein, 483 aa, Populus balsamifera subsp. trichocarpa
  misc_feature (1)..(483): Ceres ANNOT ID no. 1529744
  misc_feature (172)..(231): Pfam Name: La Pfam Description: La domain
  misc_feature: SWISSPROT Homolog: HRPX_PLALO Histidine-rich glycoprotein precursor with e-value of 5.8e-09 and BLAST sequence identity of 34.9
  misc_feature: SWISSPROT Homolog: LA_DROME La protein homolog (La ribonucleoprotein) (La autoantigen homolog) with e-value of 6.3e-09 and BLAST sequence identity of 29.9
  misc_feature: SWISSPROT Homolog: LA_AEDAL La protein homolog (La ribonucleoprotein) (La autoantigen homolog) with e-value of 1.0e-07 and BLAST sequence identity of 29.1
  misc_feature: SWISSPROT Homolog: LA_HUMAN Lupus La protein (Sjoegren syndrome type B antigen) (SS-B) (La ribonucleoprotein) (La autoantigen) with e-value of 1.3e-07 and BLAST sequence identity of 29.7
  misc_feature: SWISSPROT Homolog: LAA_XENLA Lupus La protein homolog A (La ribonucleoprotein A) (La autoantigen homolog A) with e-value of 6.3e-07 and BLAST sequence identity of 28.7
  misc_feature 453762:<222: Transcription Factor
  misc_feature: Phenotype: FLOWER - Reduced fertility Useful for sterility, genetic confinement systems
  misc_feature: Phenotype: ROSETTE LEAVES - Short Petioles Useful for modulating plant size
  misc_feature: Phenotype: ROSETTE LEAVES - Oval Shaped Useful for making plants with increased biomass and foliage
  misc_feature (1)..(483): Functional Homolog of  Ceres CDNA ID no. 36572659 at SEQ ID NO. 4105 with e-value of 2.09E-134 and BLAST sequence identity of 64.5
MAQQNQEEEEELVAVVESVPETLDQSPSSSDPSLSRNVSFSKLNAQAPAFVPTRPQPQPPPRLSVIPPPPPPPAGMMHMFPPSPFHVPIHGPVPLPHVIPVPNHHHHNNHHHHHNHPNQHQQQYVPVRKHNQLHNSKRVPQQFEEEVEVVVNKDAAASSDHAAKSDEAMNKLLNQVEYYFSDLNLATTDHLMRFITKDPEGYVPISVVASFKKVKAVVNNNSQLATILRNSTKLVVSEDGKKVRRQHPLTESDVEELQSRIVVAENLPEDHCHQNLMKIFSAVGSVKTIRTCPPQPSGGASSASRSGKADGMHFSNKLHAFVEYETVEIAEKAVAELNDEGNWRSGLKVRLMLKRGAQGKKGHDGQGHSEEDEVSAFEQMPNEKLTEDQAQQPDVHSHEHSGEDHANDKEGAQRKRNRGRGKGRGRGQYHHNNHHSNHGGTPPSNPVLGEHLTMAKQPPGPRMPDGTRGFAMGRGKLVAVNIA

SEQ ID NO: 4053 - protein, 334 aa, Arabidopsis thaliana
  misc_feature (1)..(334): Ceres CDNA ID no. 36575796
  misc_feature (117)..(158): Pfam Name: zf-C3HC4 Pfam Description: Zinc finger, C3HC4 type (RING finger)
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
MESLINPSHGGGNYDSHSSSLDSLKPSVLVIILILLMTLLISVSICFLLRCLNRCSHRSVLPLSSSSSVATVTSDSRRFSGHRVSPETERSSVLDSLPIFKFSSVTRRSSSMNSGDCAVCLSKFEPEDQLRLLPLCCHAFHADCIDIWLVSNQTCPLCRSPLFASESDLMKSLAVVGSNNGGGENSFRLEIGSISRRRQTPIPESVEQHRTYSIGSFDYIVDDVDSEISESNFNRGKQEDATTTTATATAVTTNPTSFEASLAADIGNDGSRSWLKDYVDRLSRGISSRAMSFRSSGRFFTGSSRRSEELTVMDLEANHAGEEISELFRWLSGV

SEQ ID NO: 4054 - DNA, 1050 bp, Populus balsamifera subsp. trichocarpa
  misc_feature (1)..(1050): Ceres ANNOT ID no. 1486224
  misc_feature 454014:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
atgtctgctcccccagacttgttcaccacaacacccaccgatacggccagcggaggcaccaagacttcgccgtttcagaaccttaactcaagcatattgatcatcattttaatcctctccatcactctgttagtctctgtttctctttgcttccttcttcgtgtcttaaaccgccgttgcctcagccacctctctccctctagaaccaccgccacaactaccacgataacagccccctcctcctctaaccgtcactcaggtaacaacaaccaccgtgtttcaccagaaaccttagagccttccatttctgactcacttcctctcttctccttttcctccatcaaacggcggtcatcctcctcccctgctatctccggcggcgattgcgcggtttgtctgtccaagttcgaaccggatgatctcttgcgattgcttccgctttgttgtcatgctttccatgcacattgcattgacacgtgggtcaattctaatcaatcatgtcctctctgccggtctcctattcttatatcggagtccgacctcgccaaagctatctccgatgtcgaagctcgcggtggtgatagtttccgccttgagattggttctattagccgccgagaacatcctgctcctaactcggcctcctctctctccacatccgccgcctcctttgctgcaggcgagcatcggagctcgtactctgttggttcgtttgattacgtcgtggaggaggaatcggaggttacgatcaatcaatcacacaggaggagcatgtcgaaggagagtggtggcggtggcggtccgacattgtccgagcagcagattttggcagcggaagtggctgcggcgagaggaagttggttaagagaatacgttgaccgtctatcggcttctctctcttcacgcacggcatcgtttagaggttctggaaggttctttacgggaagcagtcgccggagcgagatcgccggtgttggggattatgatttggaggcgaaccgtgtaggagaagaaattagcgaactgtttcgttggttttcaggggtataa

SEQ ID NO: 4055 - protein, 349 aa, Populus balsamifera subsp. trichocarpa
  misc_feature (1)..(349): Ceres ANNOT ID no. 1486224
  misc_feature (129)..(170): Pfam Name: zf-C3HC4 Pfam Description: Zinc finger, C3HC4 type (RING finger)
  misc_feature: SWISSPROT Homolog: ATL3J_ARATH RING-H2 finger protein ATL3J (RING-H2 finger protein ATL4) (RING-H2 finger protein RHX1a) with e-value of 2.4e-175 and BLAST sequence identity of 100.0
  misc_feature: SWISSPROT Homolog: ATL4K_ARATH RING-H2 finger protein ATL4K (RING-H2 finger protein ATL13) with e-value of 4.4e-25 and BLAST sequence identity of 37.7
  misc_feature: SWISSPROT Homolog: ATL2C_ARATH Putative RING-H2 finger protein ATL2C with e-value of 4.6e-25 and BLAST sequence identity of 38.0
  misc_feature: SWISSPROT Homolog: ATL5I_ARATH RING-H2 finger protein ATL5I with e-value of 1.1e-22 and BLAST sequence identity of 36.9
  misc_feature: SWISSPROT Homolog: ATL1D_ARATH RING-H2 finger protein ATL1D with e-value of 1.1e-22 and BLAST sequence identity of 37.7
  misc_feature 454139:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
  misc_feature (1)..(349): Functional Homolog of  Ceres CDNA ID no. 36575796 at SEQ ID NO. 4110 with e-value of 2.70E-79 and BLAST sequence identity of 59.6
MSAPPDLFTTTPTDTASGGTKTSPFQNLNSSILIIILILSITLLVSVSLCFLLRVLNRRCLSHLSPSRTTATTTTITAPSSSNRHSGNNNHRVSPETLEPSISDSLPLFSFSSIKRRSSSSPAISGGDCAVCLSKFEPDDLLRLLPLCCHAFHAHCIDTWVNSNQSCPLCRSPILISESDLAKAISDVEARGGDSFRLEIGSISRREHPAPNSASSLSTSAASFAAGEHRSSYSVGSFDYVVEEESEVTINQSHRRSMSKESGGGGGPTLSEQQILAAEVAAARGSWLREYVDRLSASLSSRTASFRGSGRFFTGSSRRSEIAGVGDYDLEANRVGEEISELFRWFSGV

SEQ ID NO: 4056 - DNA, 1056 bp, Populus balsamifera subsp. trichocarpa
  misc_feature (1)..(1056): Ceres ANNOT ID no. 1444021
  misc_feature 454259:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
atgtccgctcctccatattcgtttatccctctaaacaacaccgacgaggccagcgatacaagcggaggcaccaagtcgccctttcagaacctaaactcaagcattttgatcatcattttaatcctctccgtaactctgttagtctctgtttctctttgtttccttctccgtatcttaagccgccgttccctccgccacctttctccctctagaaccaccgccatagctaccacaataacaaccttatcctctaaccgcctctccagtaacaacaaccatcgtgtttcaccggaagatttagagtcttccgtttctgactcactccctctcttctctttctcctccatcaaacacagaccatcctcttcccctgaaatctccagcggcgattgcgcggtttgtttatcgacgttcgaaccagaggatatcctgcgattgcttccgctctgctgtcatgctttccatgcacattgcattgaaacatggctcaattctaaccaatcgtgtcctctttgccggtctcgtattcatttttcggaatcagagctcgccaaagctctctttgaaggtgacgctcgtggtggtgatagcttccgccttgagattggctctattagccgtcgagaacatactgctcctaaccccgcgtcctctctctctacagccacagcctccgccggtgcagacgaggatcggagcacgtactcggttggttcgtttgattatgtcgtggaggaggaatcggaggttactatcagtcaatcgcacagaaggagtatgtcgaaggagagtggtcgcgggggtggtctgacattgtccgaggagccgattctggcagcagaagtggcttcggcgagaggaagtttgttaagagaatatgttgataggctgtctgcttctctctcttcacgtacgacatcttttagaggttctggaaggttatttaccggtagcagtggccggagcgagattgccggtggcggagattatggtttgggggcgagtcgtgctggagaagaaattagtgagctgtttcgttggttttcaggggtatga

SEQ ID NO: 4057 - protein, 351 aa, Populus balsamifera subsp. trichocarpa
  misc_feature (1)..(351): Ceres ANNOT ID no. 1444021
  misc_feature (131)..(172): Pfam Name: zf-C3HC4 Pfam Description: Zinc finger, C3HC4 type (RING finger)
  misc_feature: SWISSPROT Homolog: ATL3J_ARATH RING-H2 finger protein ATL3J (RING-H2 finger protein ATL4) (RING-H2 finger protein RHX1a) with e-value of 2.4e-175 and BLAST sequence identity of 100.0
  misc_feature: SWISSPROT Homolog: ATL4K_ARATH RING-H2 finger protein ATL4K (RING-H2 finger protein ATL13) with e-value of 4.4e-25 and BLAST sequence identity of 37.7
  misc_feature: SWISSPROT Homolog: ATL2C_ARATH Putative RING-H2 finger protein ATL2C with e-value of 4.6e-25 and BLAST sequence identity of 38.0
  misc_feature: SWISSPROT Homolog: ATL5I_ARATH RING-H2 finger protein ATL5I with e-value of 1.1e-22 and BLAST sequence identity of 36.9
  misc_feature: SWISSPROT Homolog: ATL1D_ARATH RING-H2 finger protein ATL1D with e-value of 1.1e-22 and BLAST sequence identity of 37.7
  misc_feature 454384:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: WHOLE PLANT - Other Useful for making bigger plants
  misc_feature: Phenotype: ROSETTE LEAVES - Serrate Margins Useful for making plants with increased biomass and foliage
  misc_feature (1)..(351): Functional Homolog of  Ceres CDNA ID no. 36575796 at SEQ ID NO. 4110 with e-value of 2.70E-72 and BLAST sequence identity of 58.0
MSAPPYSFIPLNNTDEASDTSGGTKSPFQNLNSSILIIILILSVTLLVSVSLCFLLRILSRRSLRHLSPSRTTAIATTITTLSSNRLSSNNNHRVSPEDLESSVSDSLPLFSFSSIKHRPSSSPEISSGDCAVCLSTFEPEDILRLLPLCCHAFHAHCIETWLNSNQSCPLCRSRIHFSESELAKALFEGDARGGDSFRLEIGSISRREHTAPNPASSLSTATASAGADEDRSTYSVGSFDYVVEEESEVTISQSHRRSMSKESGRGGGLTLSEEPILAAEVASARGSLLREYVDRLSASLSSRTTSFRGSGRLFTGSSGRSEIAGGGDYGLGASRAGEEISELFRWFSGV

SEQ ID NO: 4058 - protein, 508 aa, Arabidopsis thaliana
  misc_feature (1)..(508): Ceres CDNA ID no. 36577981
  misc_feature (28)..(483): Pfam Name: p450 Pfam Description: Cytochrome P450
MSWFLIAVATIAAVVSYKLIQRLRYKFPPGPSPKPIVGNLYDIKPVRFRCYYEWAQSYGPIISVWIGSILNVVVSSAELAKEVLKEHDQKLADRHRNRSTEAFSRNGQDLIWADYGPHYVKVRKVCTLELFTPKRLESLRPIREDEVTAMVESVFRDCNLPENRAKGLQLRKYLGAVAFNNITRLAFGKRFMNAEGVVDEQGLEFKAIVSNGLKLGASLSIAEHIPWLRWMFPADEKAFAEHGARRDRLTRAIMEEHTLARQKSSGAKQHFVDALLTLKDQYDLSEDTIIGLLWDMITAGMDTTAITAEWAMAEMIKNPRVQQKVQEEFDRVVGLDRILTEADFSRLPYLQCVVKESFRLHPPTPLMLPHRSNADVKIGGYDIPKGSNVHVNVWAVARDPAVWKNPFEFRPERFLEEDVDMKGHDFRLLPFGAGRRVCPGAQLGINLVTSMMSHLLHHFVWTPPQGTKPEEIDMSENPGLVTYMRTPVQAVATPRLPSDLYKRVPYDM

SEQ ID NO: 4059 - DNA, 1527 bp, Populus balsamifera subsp. trichocarpa
  misc_feature (1)..(1527): Ceres ANNOT ID no. 1453454
  misc_feature 454621:<222: Transcription Factor
atgaatctccttctgattccgatatccttcatcacccttctcttgacatacaaaatctaccaacgtctacgcttcaagctcccaccagggccaagaccatggccaatagtaggcaacctttatgacgtcaagcctgtgaggttccggtgctttgcagagtgggctcaggcatatggtcctatcatctcagtttggttcggttcaactcttaacgtgattgtttccaatacagaattggcaaaggaagtgctcaaggaaaatgatcaacagttagctgatagacataggagtcgatcagctgccaagtttagcagagacggtaaagaccttatatgggctgattatggacctcactatgttaaggttcgaaaggtttgcacccttgagcttttctctcccaaaagacttgaagctttgaggcctatcagagaagatgaggttgctgccatggttgaatcaattttcaatgactgcactaatcctgaaaacaatggaaaaaccttgacggtgaagaaatatttgggggcagttgcattcaacaacattacaaggctagcatttgggaagcgattcgtgaatgccgaaggcgttatggatgagcaagggctagaattcaaggcaattgtatccaatggacttaagttgggtgcatcacttgcaatggcagagcacattccatggcttcgttggatgtttccgttagaggaagatgcatttgccaagcatggggctcgtcgggaccgactcactagagctattatggatgaacatacccttgcccggcagacgagtggcggtgccaagcagcattttgttgatgcattgcttacattgaaggagaagtatgaccttagtgaagacacaatcattggactgctttgggacatgattactgcgggcatggacacaactgcaatctcagtagaatgggcaatggcagagctaatcaagaacccaagggtgcaacagaaggctcaggaagagttggacagtgttgttggatttgaacgtgtcatgaccgaggctgatttctcaggccttccttacttacaatgtgtagccaaggaggcgctaaggttgcaccccccaacaccacttatgctcccgcaccgtgccaatgccaatgtgaaagttggtggctacgacattcctaagggatcaaatgttcacgtcaatgtatgggccgtagctcgcgatccggccacctggaagaaacccttagagttccggccagagaggttcctggaggaggatgttgacatgaagggtcatgatttcaggctacttccatttggtgcaggaaggagagtgtgccctggtgcacaacttggtatcaatttggtcacatccatgctgggtcacttgctgcaccatttttgttggacccctcctgaaggaatgaagccagaggaaattgacatgtcggaaaatcctgggcttgtcacttacatgacgactccattacaagcagtggccactcctcggttgccttcacatttgtacaaacgtgttgctgttgatatttaa

SEQ ID NO: 4060 - protein, 508 aa, Populus balsamifera subsp. trichocarpa
  misc_feature (1)..(508): Ceres ANNOT ID no. 1453454
  misc_feature (28)..(492): Pfam Name: p450 Pfam Description: Cytochrome P450
  misc_feature: SWISSPROT Homolog: C98A3_ARATH Cytochrome P450 98A3 (EC 1.14.-.-) with e-value of 9.1e-279 and BLAST sequence identity of 100.0
  misc_feature: SWISSPROT Homolog: C98A2_SOYBN Cytochrome P450 98A2 (EC 1.14.-.-) with e-value of 9.2e-231 and BLAST sequence identity of 80.4
  misc_feature: SWISSPROT Homolog: C98A1_SORBI Cytochrome P450 98A1 (EC 1.14.-.-) with e-value of 3.6e-197 and BLAST sequence identity of 69.9
  misc_feature: SWISSPROT Homolog: F3PH_PETHY Flavonoid 3'-monooxygenase EC 1.14.13.21(Flavonoid 3'-hydroxylase) (Cytochrome P450 75B2) with e-value of 5.6e-89 and BLAST sequence identity of 39.3
  misc_feature: SWISSPROT Homolog: F3PH_ARATH Flavonoid 3'-monooxygenase EC 1.14.13.21(Flavonoid 3'-hydroxylase) (AtF3'H) (Cytochrome P450 75B1) (TRANSPARENT TESTA 7 protein) with e-value of 5.5e-82 and BLAST sequence identity of 35.9
  misc_feature 454737:<222: Transcription Factor
  misc_feature (1)..(508): Functional Homolog of  Ceres CDNA ID no. 36577981 at SEQ ID NO. 4115 with e-value of 5.90E-235 and BLAST sequence identity of 81.8
MNLLLIPISFITLLLTYKIYQRLRFKLPPGPRPWPIVGNLYDVKPVRFRCFAEWAQAYGPIISVWFGSTLNVIVSNTELAKEVLKENDQQLADRHRSRSAAKFSRDGKDLIWADYGPHYVKVRKVCTLELFSPKRLEALRPIREDEVAAMVESIFNDCTNPENNGKTLTVKKYLGAVAFNNITRLAFGKRFVNAEGVMDEQGLEFKAIVSNGLKLGASLAMAEHIPWLRWMFPLEEDAFAKHGARRDRLTRAIMDEHTLARQTSGGAKQHFVDALLTLKEKYDLSEDTIIGLLWDMITAGMDTTAISVEWAMAELIKNPRVQQKAQEELDSVVGFERVMTEADFSGLPYLQCVAKEALRLHPPTPLMLPHRANANVKVGGYDIPKGSNVHVNVWAVARDPATWKKPLEFRPERFLEEDVDMKGHDFRLLPFGAGRRVCPGAQLGINLVTSMLGHLLHHFCWTPPEGMKPEEIDMSENPGLVTYMTTPLQAVATPRLPSHLYKRVAVDI

SEQ ID NO: 4061 - DNA, 1530 bp, Populus balsamifera subsp. trichocarpa
  misc_feature (1)..(1530): Ceres ANNOT ID no. 1528108
  misc_feature 454859:<222: Transcription Factor
atggctctgcctcttttagtattagtttcgatctttgttctccttcttgcatacattctgtaccagaggctgaggttcaagctaccacccggtccacggccgtggccgattgttgggaacctctatgccatcaagcctattaggttcagatgttttgcagagtgggctcaggcttacggaccagttgtttcagtttggtttggttcaactttgaatgttgttgtgtgtaatgcggaactggccaagcaagttctcaaagagaatgaccagcagctggccgatcgacataggtctagattggctgcaaggtttagtagagacggcaaggacctcatctgggctgactatggtcctcattatgtgaaggttaggagagtgtctactcttgagctcttctcagcaaagagacttgaggaactcagacctataagagaagatgaggttactttcatggcagaatccattttcaaggattgcaccaatccagaaaaccatggaaaaagcttgttggtgaagaaatatttgggagatgtggctttcaataacattacaaggctagcatttgggaaacgattcatgaattcagagggcataattgatgagcaaggccaagaattcaaggcaattgtttccaatggagttaggctgggtggatcactgaccatggcagagcacattccatggcttcaatggatgtttccactagaggaagaggctgttgaaaagcataacgctcgtcgagatgggctaactagagttatcatggaggaacacaccaatgcacgcaagaaaagtggaggtgccaagaaacatttcgttgatgcactgcttacattgcaagaaaaatatgaccttagtgaggttacaattactggtctcctatgggacatgattactgctggcatggatacaacagcaatcacagtggagtgggcaatggctgagctaatcaagaacccaagggttcaacagaaggctcaagatgagctagaccgagtggttgggttcgaacgtgtcatgactgaggcagatttcccaaatctcccttacctgcaagctgtagtcaaggaatcgctgaggttgcacccaccaacaccactgatgctacctcatcgtgccaatactactgttaaaatcggcggctatgacatccctaagggatcagttgttcacgtaaacgtatgggctgtggctcgtgatccggctttgtggaagaaccctttagagttccggccggagaggttctttgaggaggatgtcgacatgagaggtcatgatttcaggctacttccattcggagctggaagaagggtgtgtcctggtgcacagcttggtatcaatctggtcacgtctataatcggtcatctgcttcaccattttcattggaccacccctgatggtgtcaagccagaggaaattgacatgtcagaaagacctggacttgtcacttatatgatgaccccattacaagcagtggccactcctcgcctgccttcacacttgtacaaacggatggcttcagatatgtga

SEQ ID NO: 4062 - protein, 509 aa, Populus balsamifera subsp. trichocarpa
  misc_feature (1)..(509): Ceres ANNOT ID no. 1528108
  misc_feature (29)..(484): Pfam Name: p450 Pfam Description: Cytochrome P450
  misc_feature: SWISSPROT Homolog: C98A3_ARATH Cytochrome P450 98A3 (EC 1.14.-.-) with e-value of 9.1e-279 and BLAST sequence identity of 100.0
  misc_feature: SWISSPROT Homolog: C98A2_SOYBN Cytochrome P450 98A2 (EC 1.14.-.-) with e-value of 9.2e-231 and BLAST sequence identity of 80.4
  misc_feature: SWISSPROT Homolog: C98A1_SORBI Cytochrome P450 98A1 (EC 1.14.-.-) with e-value of 3.6e-197 and BLAST sequence identity of 69.9
  misc_feature: SWISSPROT Homolog: F3PH_PETHY Flavonoid 3'-monooxygenase EC 1.14.13.21(Flavonoid 3'-hydroxylase) (Cytochrome P450 75B2) with e-value of 5.6e-89 and BLAST sequence identity of 39.3
  misc_feature: SWISSPROT Homolog: F3PH_ARATH Flavonoid 3'-monooxygenase EC 1.14.13.21(Flavonoid 3'-hydroxylase) (AtF3'H) (Cytochrome P450 75B1) (TRANSPARENT TESTA 7 protein) with e-value of 5.5e-82 and BLAST sequence identity of 35.9
  misc_feature 454975:<222: Transcription Factor
  misc_feature (1)..(509): Functional Homolog of  Ceres CDNA ID no. 36577981 at SEQ ID NO. 4115 with e-value of 1.79E-217 and BLAST sequence identity of 76.5
MALPLLVLVSIFVLLLAYILYQRLRFKLPPGPRPWPIVGNLYAIKPIRFRCFAEWAQAYGPVVSVWFGSTLNVVVCNAELAKQVLKENDQQLADRHRSRLAARFSRDGKDLIWADYGPHYVKVRRVSTLELFSAKRLEELRPIREDEVTFMAESIFKDCTNPENHGKSLLVKKYLGDVAFNNITRLAFGKRFMNSEGIIDEQGQEFKAIVSNGVRLGGSLTMAEHIPWLQWMFPLEEEAVEKHNARRDGLTRVIMEEHTNARKKSGGAKKHFVDALLTLQEKYDLSEVTITGLLWDMITAGMDTTAITVEWAMAELIKNPRVQQKAQDELDRVVGFERVMTEADFPNLPYLQAVVKESLRLHPPTPLMLPHRANTTVKIGGYDIPKGSVVHVNVWAVARDPALWKNPLEFRPERFFEEDVDMRGHDFRLLPFGAGRRVCPGAQLGINLVTSIIGHLLHHFHWTTPDGVKPEEIDMSERPGLVTYMMTPLQAVATPRLPSHLYKRMASDM

SEQ ID NO: 4063 - protein, 181 aa, Arabidopsis thaliana
  misc_feature (1)..(181): Ceres CDNA ID no. 36579424
  misc_feature (6)..(69): Pfam Name: AP2 Pfam Description: AP2 domain
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Other Useful for making ornamental plants with modified leaves
MARPQQRFRGVRQRHWGSWVSEIRHPLLKTRIWLGTFETAEDAARAYDEAARLMCGPRARTNFPYNPNAIPTSSSKLLSATLTAKLHKCYMASLQMTKQTQTQTQTQTARSQSADSDGVTANESHLNRGVTETTEIKWEDGNANMQQNFRPLEEDHIEQMIEELLHYGSIELCSVLPTQTL

SEQ ID NO: 4064 - DNA, 588 bp, Populus balsamifera subsp. trichocarpa
  misc_feature (1)..(588): Ceres ANNOT ID no. 1455663
  misc_feature 455182:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Other Useful for making ornamental plants with modified leaves
atggccagaccacagcagcgataccgaggggtccgacaaaggcattggggatcatgggtgtctgagattcgtcatcctttattgaagactagaatttggctaggcacgtttgaaacagcagaggatgcagcaagagcttatgatgaagctgcaaggcttatgtgtggacctagggctaggaccaacttcccttataacccaaatgcatcacaatcagcttcatcgaaacttctctccgcaactttgacagcaaagttgcacaggtgctatatggcctcattgcaagtgaccaaaaaaacatcacttcatgaacaaaaacaacagcaacaaaaggcaccaacttcacttgccaacacccccaccaatggcattgtcataaaaagtgaggaacttgatgctttattgccagagaaaagcccattacaagttcaagaggcagaggcaaactgggtgtacaagaaagttcaagttgataacaacaaccagcaattcataaagcctcttgaagatcaccacattgagcaaatgattgaagagttgcttgactatgggtctatcgagtttttctctggggtaacaactcagtaa

SEQ ID NO: 4065 - protein, 195 aa, Populus balsamifera subsp. trichocarpa
  misc_feature (1)..(195): Ceres ANNOT ID no. 1455663
  misc_feature (6)..(69): Pfam Name: AP2 Pfam Description: AP2 domain
  misc_feature: SWISSPROT Homolog: PZ02_LUPPO Protein PPLZ02 with e-value of 3.2e-47 and BLAST sequence identity of 61.6
  misc_feature: SWISSPROT Homolog: DRE2D_ARATH Putative dehydration-responsive element-binding protein 2D (DREB2D protein) with e-value of 2.1e-20 and BLAST sequence identity of 50.0
  misc_feature: SWISSPROT Homolog: DRE2B_ARATH Dehydration-responsive element-binding protein 2B (DREB2B protein) with e-value of 3.0e-19 and BLAST sequence identity of 37.5
  misc_feature: SWISSPROT Homolog: ERF3_TOBAC Ethylene-responsive transcription factor 3 EREBP-5 (NtERF5) with e-value of 1.3e-18 and BLAST sequence identity of 69.0
  misc_feature: SWISSPROT Homolog: DRE2A_ARATH Dehydration-responsive element-binding protein 2A (DREB2A protein) with e-value of 4.0e-18 and BLAST sequence identity of 54.9
  misc_feature 455293:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Other Useful for making ornamental plants with modified leaves
  misc_feature (1)..(195): Functional Homolog of  Ceres CDNA ID no. 36579424 at SEQ ID NO. 4120 with e-value of 3.30E-58 and BLAST sequence identity of 69.2
MARPQQRYRGVRQRHWGSWVSEIRHPLLKTRIWLGTFETAEDAARAYDEAARLMCGPRARTNFPYNPNASQSASSKLLSATLTAKLHRCYMASLQVTKKTSLHEQKQQQQKAPTSLANTPTNGIVIKSEELDALLPEKSPLQVQEAEANWVYKKVQVDNNNQQFIKPLEDHHIEQMIEELLDYGSIEFFSGVTTQ

SEQ ID NO: 4066 - DNA, 546 bp, Populus balsamifera subsp. trichocarpa
  misc_feature (1)..(546): Ceres ANNOT ID no. 1438024
  misc_feature 455386:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Other Useful for making ornamental plants with modified leaves
atgactagaccacaacagcgataccgtggcgtccgtcaaaggcattggggttcttgggtatccgaaattcgccatcctctcctgaagactagaatatggctgggcacattcgaaacggcggaggacgcagcaagagcatacgatgaggcagcaaggctaatgtgtgggccaaaatcacgtacaaatttcccttacaatcccaatgagccacaatcatcttcatcgaagcttctctcagctaccttggcagccaagctacataaatgtcacatggcatctctacaagcaaccaagaaaaatgcaacaaaacagtcatatgaagcacaatgcaagaagacatttgacactagccatggcattgccggagaaactgtcgaaaccggctcaaaatggcaggagggtaactgggctggcgaggatagtcaagtagggaatggtgatcaccagcagcattttaagtcactagaagctcatcatatagagcaaatgatagaggagctgctagattgtgggtccatggagttctgttctgcaggttcaacatga

SEQ ID NO: 4067 - protein, 181 aa, Populus balsamifera subsp. trichocarpa
  misc_feature (1)..(181): Ceres ANNOT ID no. 1438024
  misc_feature (6)..(69): Pfam Name: AP2 Pfam Description: AP2 domain
  misc_feature: SWISSPROT Homolog: PZ02_LUPPO Protein PPLZ02 with e-value of 3.2e-47 and BLAST sequence identity of 61.6
  misc_feature: SWISSPROT Homolog: DRE2D_ARATH Putative dehydration-responsive element-binding protein 2D (DREB2D protein) with e-value of 2.1e-20 and BLAST sequence identity of 50.0
  misc_feature: SWISSPROT Homolog: DRE2B_ARATH Dehydration-responsive element-binding protein 2B (DREB2B protein) with e-value of 3.0e-19 and BLAST sequence identity of 37.5
  misc_feature: SWISSPROT Homolog: ERF3_TOBAC Ethylene-responsive transcription factor 3 EREBP-5 (NtERF5) with e-value of 1.3e-18 and BLAST sequence identity of 69.0
  misc_feature: SWISSPROT Homolog: DRE2A_ARATH Dehydration-responsive element-binding protein 2A (DREB2A protein) with e-value of 4.0e-18 and BLAST sequence identity of 54.9
  misc_feature 455497:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Other Useful for making ornamental plants with modified leaves
  misc_feature (1)..(181): Functional Homolog of  Ceres CDNA ID no. 36579424 at SEQ ID NO. 4120 with e-value of 2.10E-56 and BLAST sequence identity of 68.6
MTRPQQRYRGVRQRHWGSWVSEIRHPLLKTRIWLGTFETAEDAARAYDEAARLMCGPKSRTNFPYNPNEPQSSSSKLLSATLAAKLHKCHMASLQATKKNATKQSYEAQCKKTFDTSHGIAGETVETGSKWQEGNWAGEDSQVGNGDHQQHFKSLEAHHIEQMIEELLDCGSMEFCSAGST

SEQ ID NO: 4068 - DNA, 543 bp, Populus balsamifera subsp. trichocarpa
  misc_feature (1)..(543): Ceres ANNOT ID no. 1448068
  misc_feature 455587:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Other Useful for making ornamental plants with modified leaves
atgactagaccacaacagcgatatcgtggcgtccgtcaaaggcactggggttcttgggtttcagaaattcgccatcctctcctgaagactagaatatggttaggcacattcgaaacggccgaggacgcggcacgggcatacgacgaggcggcaaggctaatgtgcgggccaaaagcacgtacaaatttccctcacaaccccaacgaaccccaatcatcatcgtcaaagcttctctcagctaccttggcagccaagctacataaatgtcacatgacttctctacaagcaaccaagaaaaatgtaacaaaacagtcacatgatgcacaatgcaccagttttggcactagccatggcattgccggaaaaactgtcgaaaacggctcgaaatggcaggaggggaattgggttgggggggggagtcaagcggggaacgatgaccatcaagaacattttaagtcacttgaagatcaccatatagagcaaatgatagaggagttgctagatagaggatccatggagttctgttatgtagattcaacatga

SEQ ID NO: 4069 - protein, 180 aa, Populus balsamifera subsp. trichocarpa
  misc_feature (1)..(180): Ceres ANNOT ID no. 1448068
  misc_feature (6)..(69): Pfam Name: AP2 Pfam Description: AP2 domain
  misc_feature: SWISSPROT Homolog: PZ02_LUPPO Protein PPLZ02 with e-value of 3.2e-47 and BLAST sequence identity of 61.6
  misc_feature: SWISSPROT Homolog: DRE2D_ARATH Putative dehydration-responsive element-binding protein 2D (DREB2D protein) with e-value of 2.1e-20 and BLAST sequence identity of 50.0
  misc_feature: SWISSPROT Homolog: DRE2B_ARATH Dehydration-responsive element-binding protein 2B (DREB2B protein) with e-value of 3.0e-19 and BLAST sequence identity of 37.5
  misc_feature: SWISSPROT Homolog: ERF3_TOBAC Ethylene-responsive transcription factor 3 EREBP-5 (NtERF5) with e-value of 1.3e-18 and BLAST sequence identity of 69.0
  misc_feature: SWISSPROT Homolog: DRE2A_ARATH Dehydration-responsive element-binding protein 2A (DREB2A protein) with e-value of 4.0e-18 and BLAST sequence identity of 54.9
  misc_feature 455698:<222: Transcription Factor
  misc_feature: Phenotype: INFLORESCENCE - Late Flowering Useful for modulating flowering time
  misc_feature: Phenotype: FLOWER - Reduced fertility Useful for sterility, genetic confinement systems
  misc_feature: Phenotype: WHOLE PLANT - Small Useful for modulating plant size
  misc_feature: Phenotype: ROSETTE LEAVES - Other Useful for making ornamental plants with modified leaves
  misc_feature (1)..(180): Functional Homolog of  Ceres CDNA ID no. 36579424 at SEQ ID NO. 4120 with e-value of 1.70E-54 and BLAST sequence identity of 70.0
MTRPQQRYRGVRQRHWGSWVSEIRHPLLKTRIWLGTFETAEDAARAYDEAARLMCGPKARTNFPHNPNEPQSSSSKLLSATLAAKLHKCHMTSLQATKKNVTKQSHDAQCTSFGTSHGIAGKTVENGSKWQEGNWVGGGSQAGNDDHQEHFKSLEDHHIEQMIEELLDRGSMEFCYVDST

SEQ ID NO: 4070 - protein, 495 aa, Arabidopsis thaliana
  misc_feature (1)..(495): Ceres CDNA ID no. 36695523
  misc_feature (33)..(484): Pfam Name: p450 Pfam Description: Cytochrome P450
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
MDLTQILLLSFLFLTISIKLLLTKSNRKPNLPPSPAYPLPVIGHLHLLKQPVHRTFHSISKSLGNAPIFHLRLGNRLVYVISSHSIAEECFTKNDVVLANRPDIIMAKHVGYNFTNMIAASYGDHWRNLRRIAAVEIFSSHRISTFSSIRKDEIRRLITHLSRDSLHGFVEVELKSLLTNLAFNNIIMMVAGKRYYGTGTEDNDEAKLVRELIAEIMAGAGSGNLADYLPSINWVTNFENQTKILGNRLDRVLQKLVDEKRAEKEKGQTLIDHLLSFQETEPEYYTDVIIKGIILALVLAGTDTSSVTLEWAMSNLLNHPEILEKARAEIDDKIGSDRLVEESDIVNLHYLQNIVSETLRLYPAVPLLLPHFSSDECKVAGYDMPRRTLLLTNVWAMHRDPGLWEEPERFKPERFEKEGEARKLMPFGMGRRACPGAELGKRLVSLALGCLIQSFEWERVGAELVDMTEGEGITMPKATPLRAMCKARAIVGKTI

SEQ ID NO: 4071 - DNA, 1491 bp, Populus balsamifera subsp. trichocarpa
  misc_feature (1)..(1491): Ceres ANNOT ID no. 1451434
  misc_feature 455937:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
atggaagaaacccatgtttactcatttctatgtcttttacttgttattgttgcagttaagttgttgctacaaactagaaaaaaacgtagaaatctccccccaagcccaccagctattccatttattggtcatctccatctcctcagacaacccatccatcgaagtcttgaaaacctctcaaagaaatatggcccaatcatatctcttcgactgggccctcgacctgtggtggttgtatcatcaccgtcagctgttgaagaatgcttcaccaagaatgacatagtttttgccaatcgtcctcagttcttagctggcaagcatttgcactacaacaacaccacccttgcttcagccagctatggcgatcattggcgcaaccttcgccgcatttgcgcaattgaaatcttctcttcgtctcgcctcaacgcatttctggccatcagaaaggacgaaatcaggcgattggtgtgcagactccatcgagattctagcgatggttttgctaaggtagaactaaggtccatgtttatggacttcacgtttaatatagtaatgagaatgattgcagggaagcgatattatggtgaagatgtgaaattagttgaggaggcaaccaagtttaaggagacattacaagggtatgctgcccttagtgagttgacaaatcttggggacgtgttccccatttttcaatctgttgattataatggatttatcaagaggtgcactgggctcagtaacaggatggatctgatcttgcaaggactgattgatgaacttcgacgagaaaagaatggaaacacaatgataaatcatttgcttactttgcaggaatctgaacccgaatactatacagaagaaataataaaaggacttattctgataatgttgcttgctgggacaaaaacacttgttacatctatagaatggggagtctgtaatctgttcaaccatccagatgtggtaaagaaagccagagaagaattggatactcaaattggccatgaacgtttaatagatgaatcagatttttcaaaacttcactaccttcagagcatcatccttgagaacttacgactatatccagttgtaccactcttagcaccgcatatgtcatctgcggattgtgaagttggaggctatgatgtgccggctggtacaattttacttgtgaatgcctgggccattcatagagatccccagatatgggaggacccagaaagttttaagcctgagagatttgagaattggaaatccgaagcatataagcacttgccatttggattgggaaggagagcttgtcctggggaggtcttggcacacaaaataatggccctgaccttgggctcgctgattcagtgcttcgactgggagggagttggtggaaaggaaatcgacatgactgaaaagatggtcaatctcatgagcagagccgagccattggaggtcatgtgtaaagctcgtccaaacttgaacaacattctgtcttaa

SEQ ID NO: 4072 - protein, 496 aa, Populus balsamifera subsp. trichocarpa
  misc_feature (1)..(496): Ceres ANNOT ID no. 1451434
  misc_feature (33)..(485): Pfam Name: p450 Pfam Description: Cytochrome P450
  misc_feature: SWISSPROT Homolog: C81D1_ARATH Cytochrome P450 81D1 (EC 1.14.-.-) with e-value of 1.2e-157 and BLAST sequence identity of 59.3
  misc_feature: SWISSPROT Homolog: C81F1_ARATH Cytochrome P450 81F1 (EC 1.14.-.-) with e-value of 2.0e-139 and BLAST sequence identity of 53.0
  misc_feature: SWISSPROT Homolog: C81E1_GLYEC Cytochrome P450 81E1 (EC 1.14.13.89) (Isoflavone 2'-hydroxylase) (P450 91A4) (CYP GE-3) with e-value of 6.2e-138 and BLAST sequence identity of 49.8
  misc_feature: SWISSPROT Homolog: C82A2_SOYBN Cytochrome P450 82A2 (EC 1.14.-.-) (P450 CP4) with e-value of 3.4e-82 and BLAST sequence identity of 37.3
  misc_feature: SWISSPROT Homolog: F3PH_ARATH Flavonoid 3'-monooxygenase EC 1.14.13.21(Flavonoid 3'-hydroxylase) (AtF3'H) (Cytochrome P450 75B1) (TRANSPARENT TESTA 7 protein) with e-value of 7.1e-82 and BLAST sequence identity of 37.5
  misc_feature 456086:<222: Transcription Factor
  misc_feature: Phenotype: WHOLE PLANT - Dark Green Useful for increasing chlorophyll and photosynthetic capacity
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature (1)..(496): Functional Homolog of  Ceres CDNA ID no. 36695523 at SEQ ID NO. 4127 with e-value of 6.09E-137 and BLAST sequence identity of 53.7
MEETHVYSFLCLLLVIVAVKLLLQTRKKRRNLPPSPPAIPFIGHLHLLRQPIHRSLENLSKKYGPIISLRLGPRPVVVVSSPSAVEECFTKNDIVFANRPQFLAGKHLHYNNTTLASASYGDHWRNLRRICAIEIFSSSRLNAFLAIRKDEIRRLVCRLHRDSSDGFAKVELRSMFMDFTFNIVMRMIAGKRYYGEDVKLVEEATKFKETLQGYAALSELTNLGDVFPIFQSVDYNGFIKRCTGLSNRMDLILQGLIDELRREKNGNTMINHLLTLQESEPEYYTEEIIKGLILIMLLAGTKTLVTSIEWGVCNLFNHPDVVKKAREELDTQIGHERLIDESDFSKLHYLQSIILENLRLYPVVPLLAPHMSSADCEVGGYDVPAGTILLVNAWAIHRDPQIWEDPESFKPERFENWKSEAYKHLPFGLGRRACPGEVLAHKIMALTLGSLIQCFDWEGVGGKEIDMTEKMVNLMSRAEPLEVMCKARPNLNNILS

SEQ ID NO: 4073 - protein, 517 aa, Arabidopsis thaliana
  misc_feature (1)..(517): Ceres CDNA ID no. 36697835
  misc_feature (40)..(502): Pfam Name: p450 Pfam Description: Cytochrome P450
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
MDAIVVDSQNCFIIILLCSFSLISYFVFFKKPKVNFDLLPSPPSLPIIGHLHLLLSTLIHKSLQKLSSKYGPLLHLRIFNIPFILVSSDSLAYEIFRDHDVNVSSRGVGAIDESLAYGSSGFIQAPYGDYWKFMKKLIATKLLGPQPLVRSQDFRSEELERFYKRLFDKAMKKESVMIHKEASRFVNNSLYKMCTGRSFSVENNEVERIMELTADLGALSQKFFVSKMFRKLLEKLGISLFKTEIMVVSRRFSELVERILIEYEEKMDGHQGTQFMDALLAAYRDENTEYKITRSHIKSLLTVNVHEFFIGAADASSIAIQWAMADIINNREILEKLREEIDSVVGKTRLVQETDLPNLPYLQAVVKEGLRLHPPTPLVVREFQEGCEIGGFFVPKNTTLIVNSYAMMRDPDSWQDPDEFKPERFLASLSREEDKKEKILNFLPFGSGRRMCPGSNLGYIFVGTAIGMMVQCFDWEINGDKINMEEATGGFLITMAHPLTCTPIPLPRTQNSLISHL

SEQ ID NO: 4074 - DNA, 1539 bp, Populus balsamifera subsp. trichocarpa; identical to SEQ ID NO: 2547
  misc_feature (1)..(1539): Ceres ANNOT ID no. 1461440
  misc_feature 456398:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage

SEQ ID NO: 4075 - protein, 512 aa, Populus balsamifera subsp. trichocarpa; identical to SEQ ID NO: 2548
  misc_feature (1)..(512): Ceres ANNOT ID no. 1461440
  misc_feature (37)..(478): Pfam Name: p450 Pfam Description: Cytochrome P450
  misc_feature: SWISSPROT Homolog: C93A1_SOYBN Cytochrome P450 93A1 (EC 1.14.-.-) with e-value of 9.9e-92 and BLAST sequence identity of 38.3
  misc_feature: SWISSPROT Homolog: C93A3_SOYBN Cytochrome P450 93A3 (EC 1.14.-.-) (P450 CP5) with e-value of 1.7e-89 and BLAST sequence identity of 37.7
  misc_feature: SWISSPROT Homolog: C93A2_SOYBN Cytochrome P450 93A2 (EC 1.14.-.-) with e-value of 6.0e-85 and BLAST sequence identity of 37.1
  misc_feature: SWISSPROT Homolog: C93B1_GLYEC Cytochrome P450 93B1 (EC 1.14.13.87) (Licodione synthase) ( (2S)-flavanone 2-hydroxylase) (Flavone synthase II) (CYP GE-5) with e-value of 4.1e-77 and BLAST sequence identity of 36.6
  misc_feature: SWISSPROT Homolog: C81F1_ARATH Cytochrome P450 81F1 (EC 1.14.-.-) with e-value of 1.2e-70 and BLAST sequence identity of 32.4
  misc_feature 456549:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(512): Functional Homolog of  Ceres CDNA ID no. 36697835 at SEQ ID NO. 4130 with e-value of 4.79E-98 and BLAST sequence identity of 42.5

SEQ ID NO: 4076 - DNA, 1539 bp, Populus balsamifera subsp. trichocarpa; identical to SEQ ID NO: 2551
  misc_feature (1)..(1539): Ceres ANNOT ID no. 1461427
  misc_feature 456709:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage

SEQ ID NO: 4077 - protein, 512 aa, Populus balsamifera subsp. trichocarpa; identical to SEQ ID NO: 2552
  misc_feature (1)..(512): Ceres ANNOT ID no. 1461427
  misc_feature (37)..(503): Pfam Name: p450 Pfam Description: Cytochrome P450
  misc_feature: SWISSPROT Homolog: C93A1_SOYBN Cytochrome P450 93A1 (EC 1.14.-.-) with e-value of 9.9e-92 and BLAST sequence identity of 38.3
  misc_feature: SWISSPROT Homolog: C93A3_SOYBN Cytochrome P450 93A3 (EC 1.14.-.-) (P450 CP5) with e-value of 1.7e-89 and BLAST sequence identity of 37.7
  misc_feature: SWISSPROT Homolog: C93A2_SOYBN Cytochrome P450 93A2 (EC 1.14.-.-) with e-value of 6.0e-85 and BLAST sequence identity of 37.1
  misc_feature: SWISSPROT Homolog: C93B1_GLYEC Cytochrome P450 93B1 (EC 1.14.13.87) (Licodione synthase) ( (2S)-flavanone 2-hydroxylase) (Flavone synthase II) (CYP GE-5) with e-value of 4.1e-77 and BLAST sequence identity of 36.6
  misc_feature: SWISSPROT Homolog: C81F1_ARATH Cytochrome P450 81F1 (EC 1.14.-.-) with e-value of 1.2e-70 and BLAST sequence identity of 32.4
  misc_feature 456860:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(512): Functional Homolog of  Ceres CDNA ID no. 36697835 at SEQ ID NO. 4130 with e-value of 1.10E-96 and BLAST sequence identity of 41.7

SEQ ID NO: 4078 - DNA, 1539 bp, Populus balsamifera subsp. trichocarpa; identical to SEQ ID NO: 2549
  misc_feature (1)..(1539): Ceres ANNOT ID no. 1461430
  misc_feature 457020:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage

SEQ ID NO: 4079 - protein, 512 aa, Populus balsamifera subsp. trichocarpa; identical to SEQ ID NO: 2550
  misc_feature (1)..(512): Ceres ANNOT ID no. 1461430
  misc_feature (37)..(478): Pfam Name: p450 Pfam Description: Cytochrome P450
  misc_feature: SWISSPROT Homolog: C93A1_SOYBN Cytochrome P450 93A1 (EC 1.14.-.-) with e-value of 9.9e-92 and BLAST sequence identity of 38.3
  misc_feature: SWISSPROT Homolog: C93A3_SOYBN Cytochrome P450 93A3 (EC 1.14.-.-) (P450 CP5) with e-value of 1.7e-89 and BLAST sequence identity of 37.7
  misc_feature: SWISSPROT Homolog: C93A2_SOYBN Cytochrome P450 93A2 (EC 1.14.-.-) with e-value of 6.0e-85 and BLAST sequence identity of 37.1
  misc_feature: SWISSPROT Homolog: C93B1_GLYEC Cytochrome P450 93B1 (EC 1.14.13.87) (Licodione synthase) ( (2S)-flavanone 2-hydroxylase) (Flavone synthase II) (CYP GE-5) with e-value of 4.1e-77 and BLAST sequence identity of 36.6
  misc_feature: SWISSPROT Homolog: C81F1_ARATH Cytochrome P450 81F1 (EC 1.14.-.-) with e-value of 1.2e-70 and BLAST sequence identity of 32.4
  misc_feature 457171:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(512): Functional Homolog of  Ceres CDNA ID no. 36697835 at SEQ ID NO. 4130 with e-value of 1.50E-96 and BLAST sequence identity of 41.7

SEQ ID NO: 4080 - DNA, 1551 bp, Populus balsamifera subsp. trichocarpa; identical to SEQ ID NO: 2553
  misc_feature (1)..(1551): Ceres ANNOT ID no. 1440253
  misc_feature 457331:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage

SEQ ID NO: 4081 - protein, 513 aa, Populus balsamifera subsp. trichocarpa; identical to SEQ ID NO: 2554
  misc_feature (1)..(513): Ceres ANNOT ID no. 1440253
  misc_feature (37)..(504): Pfam Name: p450 Pfam Description: Cytochrome P450
  misc_feature: SWISSPROT Homolog: C93A1_SOYBN Cytochrome P450 93A1 (EC 1.14.-.-) with e-value of 9.9e-92 and BLAST sequence identity of 38.3
  misc_feature: SWISSPROT Homolog: C93A3_SOYBN Cytochrome P450 93A3 (EC 1.14.-.-) (P450 CP5) with e-value of 1.7e-89 and BLAST sequence identity of 37.7
  misc_feature: SWISSPROT Homolog: C93A2_SOYBN Cytochrome P450 93A2 (EC 1.14.-.-) with e-value of 6.0e-85 and BLAST sequence identity of 37.1
  misc_feature: SWISSPROT Homolog: C93B1_GLYEC Cytochrome P450 93B1 (EC 1.14.13.87) (Licodione synthase) ( (2S)-flavanone 2-hydroxylase) (Flavone synthase II) (CYP GE-5) with e-value of 4.1e-77 and BLAST sequence identity of 36.6
  misc_feature: SWISSPROT Homolog: C81F1_ARATH Cytochrome P450 81F1 (EC 1.14.-.-) with e-value of 1.2e-70 and BLAST sequence identity of 32.4
  misc_feature 457482:<222: Transcription Factor
  misc_feature: Phenotype: INFLORESCENCE - Late Flowering Useful for modulating flowering time
  misc_feature: Phenotype: WHOLE PLANT - Small Useful for modulating plant size
  misc_feature: Phenotype: INFLORESCENCE - Short Useful for modulating plant height
  misc_feature: Phenotype: ROSETTE LEAVES - Other Useful for making ornamental plants with modified leaves
  misc_feature: Phenotype: ROSETTE LEAVES - Oval Shaped Useful for making plants with increased biomass and foliage
  misc_feature (1)..(513): Functional Homolog of  Ceres CDNA ID no. 36697835 at SEQ ID NO. 4130 with e-value of 8.29E-94 and BLAST sequence identity of 40.6

SEQ ID NO: 4082 - protein, 362 aa, Arabidopsis thaliana
  misc_feature (1)..(362): Ceres CDNA ID no. 36779029
  misc_feature: Phenotype: INFLORESCENCE - Late Flowering Useful for modulating flowering time
MEPAHIDWKRIDSRFVEDVFYEHIRAPKWFDFLAPTHFDSIDDDAWFCKPECNHPKRPEDFFSTPTSSKHPSLRDTNETLTEQNQRRRGYALSPSTPNNQESENQNPNLATPPSYQAKSWRAAIKSTSVKKMNKEVPRLKSTQSARNLFSGRDIFGHISDFCYELKRLATRVTEREDTGKSEVKESHQVGEIVNQPYSVHDLELKKERKPLLEVSKDKLPESTDVKGSTFKENRRRKKRVDDAENIPVSLNVETVKNKGEEGRRKKRMDDAENIPVPLKLETIKNKGHERFLQQIRTNPPSPQCFSENRTATLKPLRTKPTEVLKRKEDEAEEEKNRKSGESKEATRGLDVLWFLKPCTLAN

SEQ ID NO: 4083 - DNA, 1077 bp, Populus balsamifera subsp. trichocarpa
  misc_feature (1)..(1077): Ceres ANNOT ID no. 1461475
  misc_feature 457733:<222: Transcription Factor
  misc_feature: Phenotype: INFLORESCENCE - Late Flowering Useful for modulating flowering time
atggaaccagcaaaaatagattggaagagaatagactctgtctttgtagaagatagattgtatgagaacttaaatgcacccaaatggtttgatttctttgctcctgaagactccacagatgatgaagcctggttttgcagacctgattgtaaccatccaaagacagctgatgatttctttaaaaccacaccaacttctaagctttcaagctcaggtgatagagctagaagtagaacccctctcgacgacaagaatctaagagatgcaaagttgaagagaagggggcaaagtcagtcttcatttacatcatgtgattataaagccaaattcaatgaagatagcgaaaatcggaatccaaatttatcaacaccatcaaattaccagaagtctatgaaacaaatgatcaaatcaagcagtgaaaagaacagacctattgatgatgtcccacaaaccagggaagaaccaaggctaaaaagcacgttatcggcaaggaatttgtttgcagggaaagatatattaggccatattactgagttttgcaatgaattgaagaagttggcaacgagagcgagggaaaaggagagtttaaatgagaaggggagtcaagtgggggagaaaaaagatggggtagttgtgaatgagggttctagagaggttttgggagagttgaatgtgaaggagaaagagagaaaaccattgcttaacaatgatagagagaaacccgaaggaaatgaaaagggaagtgccaagcaaggcaggaagaaaagagttgatgatacagagaacatcccagtgcctctgaatttggcaaatgtgaagaacaaaggagaggagcgcctgctgcaaattcggaccaatcctccttcacctcaatgcttttctgccaaccgtgcacccgccaaaactaccccttcgaaggcttccaggtccaggcttacggaaaggggaatccttaaggaactgaagaaggataaggaaaccaccgaggacagaagtcctttcatttctgatggaaaagaatcgagagctttggatgttttctggttcctgaagccctgcacgacgctctccagctga

SEQ ID NO: 4084 - protein, 358 aa, Populus balsamifera subsp. trichocarpa
  misc_feature (1)..(358): Ceres ANNOT ID no. 1461475
  misc_feature 457794:<222: Transcription Factor
  misc_feature: Phenotype: INFLORESCENCE - Late Flowering Useful for modulating flowering time
  misc_feature (1)..(358): Functional Homolog of  Ceres CDNA ID no. 36779029 at SEQ ID NO. 4139 with e-value of 7.90E-73 and BLAST sequence identity of 58.4
MEPAKIDWKRIDSVFVEDRLYENLNAPKWFDFFAPEDSTDDEAWFCRPDCNHPKTADDFFKTTPTSKLSSSGDRARSRTPLDDKNLRDAKLKRRGQSQSSFTSCDYKAKFNEDSENRNPNLSTPSNYQKSMKQMIKSSSEKNRPIDDVPQTREEPRLKSTLSARNLFAGKDILGHITEFCNELKKLATRAREKESLNEKGSQVGEKKDGVVVNEGSREVLGELNVKEKERKPLLNNDREKPEGNEKGSAKQGRKKRVDDTENIPVPLNLANVKNKGEERLLQIRTNPPSPQCFSANRAPAKTTPSKASRSRLTERGILKELKKDKETTEDRSPFISDGKESRALDVFWFLKPCTTLSS

SEQ ID NO: 4085 - DNA, 2275 bp, Arabidopsis thaliana
  misc_feature (1)..(2275): Ceres Promoter AtPES Arabidopsis geranylgeranylpyrophosphate synthase
accttctgagcgcaagagagagggccaagttgcgaagacagtatgggacccaaataccgactaagcggaaatctaacttttaacttttcctaccaatgaaacattgacacgtggaaaagcaacgtcgcccactttaccctccgcactttgaaatctttgataagcttatcgctctcccattggccgtaggctccacgtggcatctctctgatctctcttctgctaatccttttttacccaaactggcatgaccccacccctaaacccctattgtcctttctaccaacaattacttaatgacttatataatattctaattatattttaattatgtaattaaataactattgatcccatctccatagtgacatgtctcactttttcttccacaacaaaatgcgtcactcttgattcatcatgttcgtagcaaaatccacgttattacaaaaaacgttatacattttgaaaggtaatccataaaatagtgagatggatcaagttttctacgcaaccctcgtagaattttagcaatgatccaaagctactgtatatatatagttacgtttcgtaacacaacatgtattttaccatgattatgcctcttttttttttctttccacaacatatatgtatttacatccttatttggtttaggctgagtttgttaacatagcatcaccaatagggacaatttttttttttattacaatctaaatatctaaaatataaattcacatgaaattaatgtttctaatagagttcttcaatcttcatgtacaattgcacatttttgtgaaattattattactttatcattttttctttaaaattaattcaccgagtaccgataaatgtttatattgaatacgatttagtaaacgacatatatgtttcgtcacatttttatcactatttgtaatatatctgttaaatttgatgatgtagtttctgtttttgaattgaaaacttacaaagtttagaaaaaagaatgtaaattagaaataaatacactttctgtatttttgaatactataataggctaaaatcacatcattttctaatgttgctttaaataatatatatcaaataaaggcttaaattacatttatataagaaatattgtaatacaaatatcaatttagagctattaatttacaattacaacctgttgcccaattgatgaataaatcaaacatgtaattaaccaaactttctaattgatcaggaatcaatttagctaaataataagacataaatttggccaagaaaaagaagagaaaacatgttaaataggtaatgggttttaatattgggatagttacctttatttgaaaactattaaggtttgatttaagacacgagtcactcgagagtcgcatctcgccagtcaaaaactaaattaaaaaactatatagacccaaaaaataaaaataacgacttttgtatttatactggcaagattctcattaaaacccagcaaaaaaaaaaaaaaaagacaaagaaggaagaaaatttgagtgggtgagaattttttacgatagaggaagagacagcatcatctacttgtgttgtctgtgtacatatattacagtaagcgttgcaatataacttcttgaggatcttctcacattaatgggtcaaaccttttgctcttccttttgattaatttagtgtttgacaatctcctcctccttctccttcttcttcaaagttttgtcgcagtatctattgttcttacagagagaaaggtaggcttttgtgtccatcactcattttcgctcgtttggttaagcttcatctgccatgtggttcactgttttgatacttttgggctcttatacctaatgttgatgtaacacaacgatacataatctaatttgttttcgagtggaaaatagttgaacccagttgagtatttagccaatacgattagaggatttacttgttttttctcttttcatgttcttcatttgcttttgaagatcttcctctttatgtttgtgtctcttcgctattttacttgcttgaagaaattgagtttctcatctcgcttaaatttggctttatatacagatttagagatctcgattcctaatctacttgtttttgtattcaatttgcaggaaagctttagtcttttaccagtttgatccaattctgggtttcactgaaaaaaagttgggagtttgattcttctaactgtagaagaaacagagtcaacagaagaaaactaaaaaagttgagatttttctctcacgcgctcaagaacttgacc

SEQ ID NO: 4086 - DNA, 1291 bp, Arabidopsis thaliana
  misc_feature (1)..(1291): Ceres Promoter AtDXPR Arabidopsis deoxyxylulosephosphate reductoisomerase
aacgcattaattcaggctccgatttccgatgtttaaagaaaaagttgcatgcatgacttgggatggaatttgagtggatgcagcaagtaacacttgtttaacgtctctttcactgttttgccatgtgtcacttaacgtacaacacttgtcctcagatgatccattagcagtagtaaatgatttactgactcatctaccaataccaacataccattatcttaccattatcatttatctattgatctctgtatccccacgaaaacactatgtaatgtgatagtcaatcataacagcttaatcacacttaaataaagtaaattatcttttttctttttcttttctttttatgggataaattttattcctttccgaagaaagaaaagagagcaccattcaaacaacaataatctttttgaacggatgatctaatagtctacaagaagactaattttatttaaacaatcgaacctaacatgactctaattagagatatagagaattatatacgtaaaaaattcaagttggttaaagttacatggcttttgaaatttaaatttacaaattgaacattgaggaacatatcaaagaaataagaatgatagtgaaaaatgttgacaaaaaaaaaagaatgatagtgaaaaatattcaatacataatttttaaaaagaaaagtatattatatacttgtcaaagatctaaactaagtttgacatttggattataattgttacagcatataacatgtactttataaaaaaaaaaaaaaaagagaagaagaaaaaaaaaacatgtaacatgttttatttttgaaaaagacagcatacaacatgttagtcaaaacatattcaatttaagatattcatatcaaaaattcataatacgaacgaataccataaactttttcttttttattttgtaagagagaaatccttaaccattaatcccttgtaatgcatatttctaataataattatatttgacaaactatataattgatgatacagattctgctgtttaatactctaaagaaatcaaatagaaaatgggaacatagtaagactggattatttaccacttacaagttgtcgttaccttaataaaaaggtccttgttactaaatgctcagcgaaatctttaaaaaatgacaaaaatctgttgggtaccattcaaatccagattcctttcttatcatcatctctctctctcacactgtttatctgattcgtcttctctgataatcaagagtagtagtgcggttctctggaaaatattcgatttttaaaagactccc

SEQ ID NO: 4087 - DNA, 2957 bp, Arabidopsis thaliana
  misc_feature (1)..(2957): Ceres Promoter AtHMGS Arabidopsis hydroxymethyl glutaryl CoA synthase
acagcgaagatagtgaaatagtatcgaacctacctaccccgctcacgtgtataaccacgagttttgtgcaaccatcgatcgtgtcatcacttttatgtcccacaaaatcgtgacgtcagcgtaatccgactcatctctcagagacggtctgaaattggtacattctttaatgatgtttgaccatttttagtaaccaagtcggacggtcaggatgataatgagatctcaatcggacggtggcggagattccaaggtcttagggagattgttgttagctttaggaaaacgacaatgttttcacatgtttcaaagtccaaactcattgattccaaatcacaccatgttctgtctgatctagttaacagctaatcaccaaaatattactgtatcatgtataaatttttcgaattatctgaaaggaatcgatctctgtcctacacttacataaaacaatttacacctaaaatgggaaccactaatctataaaacttaagttttatttatttaattttttggttgagttttttttgttgttaataatattttgtttttacgtgatgtttccacttttcatgttgttgaggactataacatttcaaaatctccctattaataaactagattacaaagagaatcaatactagtgttagaatataaaaaacaaaattagttaaggaagtttattgatagtgtgaattaatgtataactcatgactttttcatggtgttgagttggttcggagttaatctaatcaattaatggtatcggacacattagcaatccaccaggtcgtaggtttaatttaccgaatatcatatcttaaattacttctattttttcagaaaaaatcaatatttctaatcgcatgtaaaatgagtgtatttaattaagagagaaaaaaaaacatatctaatcgcatggaaaatgagtgtattaattaatcctcttctttaaatcatattcttttttttttacaaaatctttttccatttaatttaccgaatatcatatcttaaattacttctatttttttagaagaaatcaatatttctaatcgcatgaaaaatgagtgtatttaattaagagaagaaaacaaaaacatatctaatcgtatggaaaatgagtgtattaattaatctccttctttaaatcatattctttttcttttacaaaatctttttttatttaaatgaaagttgaagttcctaacaaaattaaactataatttaaatctatttttctctttctaatttatgatttcttaaatatgaaacaaaaaagaaaagataaaaagcaacgaaaagaaattcaaatacagacttataagtaaaattatactatatttctaccaaaaaaaaaaagtaatttatactatattttttaattatctttaatacttttttatccattttatttattcaaaaacaatccttaattccaaatagattgaacttaactccaagttatctcaccaagttacatcagaaagctactctatcatacttatcaacaaaccaattgaatccaaaacataaaccaaaccaaaaaccataacaagaaaaccaaaaccaaaatttaggagtagcgaattggtaaattaacgaataagaaaagggtaaaaaaggaaacaaaaagaagcacgagggagagctaactcacgaagtctgcgttgtccagattccggactgcaccaatctctcacaagtcacaacatatccattttccaggtaattattatttgacacctttttttttttttgttcttgttttttttttggtaggcttttttgtttgttcacatgtagttgtccccagaaaaatataaaataggttaattttgaaccaaaaagtttctttaattacacaccaaaaattttataattaagtattgattccaccaataaatatatctggcatgtttcagttagtttaaacaaaaccatcaaatttgaaatttaaaatttataactaaaaaaatgaagaacaactgtacaagtattttgttgaccaaatttaaaaaaaattcacaactaattataaattaaatttttttattaggaaaataaaaaataaagaaagaaaatctgctaatttttctcgtggacttgtttattaaaaacaaattgagttttcatcatcaaccgattcatatctttcttcttcttcctctacagcttcttcataaatctctctctcttctcctctcttctcaaagatcgaacctttcgatttcagtctcttcagagttctttcgttttcatcgaaacaatggcgaagaacgttgggattttggctatggatatctatttccctcccacctgtgttcaacaggtaacaaaactccaagcttttttttttttattctctctgtttattattggagctattgcatttgatactctgtttttatcagagcatctttctgttttgtgtaccgttttaattctccatttttgacgtttggtttcataaatcttcaaactttatgagattttacgaacagggctttgagaatcaatccaagaaaatctcgttagattagacacacacacgaacacttgtttcattgtctctgtttttttgttctttcttctctgtaatggcggcggagttttgtatccgatgaagacagaaaatgctcaatttttaattttcatttaagaaacaaaaggatttttattaaatttctctattctcaaactcgagatctctgcatctgattgaaatgaggactttgaaaggttgaaagggtttttttttatactgagatttatcgtataagtctcaattggaaaaactgaaaaaggtacaattttgtgaatctgatcttgttgatcattttttggttatataggaagctttggaagcacatgatggagcaagtaaagggaaatacactattggacttggccaagattgtttagctttttgcactgagcttgaagatgttatctcc

SEQ ID NO: 4088 - DNA, 1393 bp, Arabidopsis thaliana
  misc_feature (1)..(1393): Ceres Promoter AtFPPS Arabidopsis farnesylphosphate synthase
tatagtagttaatgttggggtctagtccaactacaactgctcccacctgtcacaggaagtcatgaagaaatatacaacattagaacctagagcaaaagagaataagaaaaacgcaagattggagaaggaatcaaagtcttatggcccattacacttttatcatgttcaaagagagagtttgatttccattgtgccttcttttcaccatcttcctgcatggaagcaaatactgcttcagatagacagaggaattcaaattatacaattttggttggtttaaaaacacaggagcagtaagtatcaaacatcttgtacaatgatatgagtcctcagagtgaccaaaacatgacctgatcaaaacatataacaaaaggaagactacttacaggaccaccaagacctgtaaaaccggcaatctgcagctcctcaagaacaccctctccaccaatcacataaacctacaaaagcaaacacgaaaggaaaaaaaagtgagaaaaagatgacgatagagagacataagccaatgtgtcagtcgaagtagaaccttcttgtccttaggaaagttattgactttgagatacatagctgccgcaaatgacgaagagaagatctcatccttccaaagtaatcacatttttttgttttagttttaatggtaatcacaagtaatacgaagaaggagaactcaaagtttacctgagtaatagaagtgacacccaaagatcggaacttttcagcgtattgcctcctcgattttacggaattgttggtcacaaagacaacatttttaccctgaaaatcgcaaaagatcagagagagagagactgaaaaggaatagagagtggggaaaagggaaagcaccttagaacggataaggtcgagagtttgggagacgccatcgatgagcgtttcacccttccatataacacctgaatcgaatcatcatccatcatcagagtagtaactaaagaggataacaatcgaatggaagaaagtagaatctaccatcgcagtcgaagaggaacgtatcgacagagtcaaagagagatttgaagttactggaggagagaagctgaggcgccattggaggagtgtcttcttcttcttcttctgggaattgatcactctggtaaagcacaattggcacgtccaaaacgacaccgttccatcgaaagaggccacattgtgattggtgagcccaattaggaaggcctattttactaatgttgaagcacatgttgtactataaaaaaacagagtttattatctgtttctttggcttgacatgacaaatgtacaactgggagagaaagtcagtccgattgtgttggggatgacgatggcaaaagtagtaaataaggaagaaacaggaggggcgttttcgggagaagaa

SEQ ID NO: 4089 - DNA, 1824 bp, Arabidopsis thaliana
  misc_feature (1)..(1824): Ceres Promoter AtGGPS1 Arabidopsis geranylgeranylpyrophosphate synthase 1
atggagcttcatgtggatacacaggagagacttggaatgtgaaacaaacgtaccattgctgtttatttggtaagaaagaaacaaataagtttccaaaaagtttttaagagacaaaaacgcaggtttcagtgggaaaaaaagcactacttaactggtaatatccatcatcaggtttaatggatacttcaaagttcatcaaatcatctttgccatttggaaaagatattgaacaagagctaggaaggttcaactctgatatatctgcacagttcaaaatcggaaaaaacaccaaaaattgaaacttggagatgcaagaacaaaaaaaagatcaacaaggcatttatatacctttgtgaagacgaagttcgccagcagattgcttcttaacagaagctcctcctctagtagcattttgagcttgttctctttgcttttcctttactttaaacaacccaatcattgtttctgacttctcttaagaaactcacacccacacacacagctgtgacaaatcaaagaatgaatgattaattctatgacagatcaaagaagaccttaaaaaatcgatcctttcgatatatcaaatcacaactgcaactaaactcatatgcccacttttatattaatcttggtaacatagcttattagactttcacacaataattgaatcccaaatcataagatccctaaaacaaagctataaccaaaatctcagaaatgaaaacgcgttattacaagacaagctaatctactttaacaggttcaaagatcgaagactttccttccacataagtagaatcagaaatctcaaaacaacgactaggtcgaaacatcgaaagttaaacaccaagacaatcaaacaaagagaatgaaggaagaagaagaagaagcttacaagttgttaaattcgttgcaaaaacacgaaaatcaaaacgaattacgagcgaattaaaaaggtcgccgattgattaatctctctctctcgcctaccggattgtcgtcctctgaagctaaacgacgaagaaacagcagagaaatggttgcaataataataaacacacaatcgtagcttttttctcgacgctgaatcagaataattcaaaaatctcgtacctgtttgttgagttccagcttggcccattaaagcccgttaggcccatttcagttatatctatcttccaacaataaatttggtagtttgcgcgcttttaataagttaaaaccaagcagttgtcagagatcaacgagctcgtgtaaaatgtccacaagtgggacttgtgacccgtatgcattttttatgccatttttactaatttcgtgtaacaaatctacaaaacaagataatcattaatcactacgtaatcatctaaattcaatgtgtggtatagaaaaaaataacagatgagatttatgtgtttaagattttgatattttaccaaaacaacaatagtatatatttgtggtatagaattgaaaataaaaagaaaaaaatctaaaaaactgacaagtaatttatctgtaatctaagccagaaaaatatcatctttatgctataaaaacattttccatggacttaaaaacaataaaacaaaaacagtgaaaaaagaaaaaagatgcttttcaataaaagtgaagatcgtcatctccaccactaacaaggcccattccgtaacacaaccctatctgttacttcctagcttctcactaatggccaatccaattctccattcataattttgactccactttccaaaaaaaacaaaaaaaaataaatactaatataaaaaattctcaaatctaaaatttcagatttcagaaatcgcc

SEQ ID NO: 4090 - DNA, 1519 bp, Arabidopsis thaliana
  misc_feature (1)..(1519): Ceres Promoter AtBASL
tgattcttttcaagcaactatatccgaatcacaggacagaagagatcaacacttccatcaagaaagccgtgcaatacatagagagcatacaaatgcttgatggttcatggtattatataaattagcttttagatacagtgaaactgttcacaaagattttggttttaccaacaattcttggattgataggtacggaagctggggagtttgcttcacatacagtacatggtttggtctgggaggccttgcagctgctggaaagacatacaacaactgcttggctatgcgtaaaggcgttcatttccttctcacaactcaaaaagataatggaggttggggtgaaagctacttgtcatgtcctaaaaaggtaataatcattgcaatgtaagcgtcttttccccagttcccgcgagtcaagaaaaatatacttggtttggtgtgcagagatacattccaagtgaaggagagcggtcaaacttggtgcaaacctcttgggcaatgatgggtttacttcatgctggacaggtttataatatcgatatgctgagacttttacttcctcgctatatgaaagatcttattcaaagtatttaattgttccttttaatctcacactacaggccgagcgagatccgtctcctcttcaccgtgctgcaaagctcttaatcaactctcaactggagaatggcgattttcctcagcaggtacttttggaaacatgaaacaaagctaacacaaaaagctgctcatacaaaaaccttagagatgccctcacgatgaaccataacgactcaaattttatctggtccttttgctgcctaaaattttaactggtcctcgtgagttgatgctaaaaaaatgcataacgtttgaagagtcaatattgtatattttacaggagataactggagctttcatgaagaactgcttgttacactacgcagcatacagaaacatcttccccgtgtgggcactcgcagagtataggagacgagttcctttgccgtatgaaaaaccttcaacagagagaagaagttagatccatcagaacgtctcaaaactcacaggtcattgaccatgatgtaggatcattaagtcatgacctctattttgcaataagctattatttatatgaaggtggttgagtattcttactgaataagcaaactaatgatcgtgtatgaacatacacatctaatattatatgttcatatgtattatattcatgtattgtatcatgattcatgactatgtatgttctcaagtaatataaatgtattatattatatgtatgtagttaagtacgtatccaagattaagcaaaatcttttccccaacaagtactctcatttttgtcttttaattctctatcatcccagaagtaacatgttcttgtcggtgttttcttatcacatatttaccaaaaatctacccaccttatcttaacttaatatacttccacttatataatctaatgtatgcgtttaagaaatgaggtacgtagctcacattttttaat

SEQ ID NO: 4091 - DNA, 1759 bp, Arabidopsis thaliana
  misc_feature (1)..(1759): Ceres Promoter AtATCPS1
acctaccatatgtcatctagtgatttgtcgtttttccgaactgtagtatttcattacatgtcgtttgacattaaatgagattcatgtttggcatatttgcatcaaatgcgttttgttggaatgttcgaattcgttaatactatgtatggtcaagttaacgatcaagtatttattgttgtcgttataaaccgttattagaaattttttctcctgaaaatgttaattttgcaaacctaatctaccacatgtcatttaatgatttatcgtttttccgaacggtagtacttcattcaataacatattgtttgacattaagtgagattcatgtttgacatatttgagtcaaatgtaatttatagaaatgttggaattcgttaattttattgtatgcacgttaacgatcaattatttatgagtatcgttataaaccgttatcaaaaataatttctcctaaaattgataattttgcaaattcgatcaaccatgtatcatttagtgatttgttgttttccaaaactatagtatatcatttcgttatatatcacaaaatatgataacatctgttgaaagatttttacagtttacaaatacatttcctgatataactatatgtaaattatatcatttcgtatatatatatatatatgtttgaataaataatttaggcattattttattttattttatttaggcatttgatgagtagcaagactactgtaattatttttaaagctattgtcacgtaacaaaaaaaacgtctcaactctatatttgactggtagtaattcaaatttcaaatagttatacatgcaataatataactacacgtgtactttctacttcctaattttataagtatggaatccatgaaaaactggaaaaagatagagagagtctagagtcttaagataagatgtaagtaaaaggaagaaatcgtaaaactcctctttgaacttgacaaactaggaattactaccagattgatactgttttgacaagagattgtaatataccatctacttctaattcttatctagaccgagacaaataccatttataaagatttactgcaatattagtaatgtattgttacctgtccacacgacaaatatatcaatccatgtatttagagtttccggtaaacagaaactaatttgttacttaagattaaaacaaaataatcttaaacttgacaaaaaaaggaatcccaaatagattagtaccatatgacactagataagtaccatccttttttttgttttttacaccaagacaaatttataataattctattgcaatagtcatatatgacttgtcacacgacaaatattgtttcctaattatcttttacgaccttaaaaattattgtttgtgatatgatatgattagaagccctcgtatgtgtatgtgtgtgtgtactttcaaagatatcgaccttatgccattatttttataaaaaaaaatcaagttgtaaaagagatataaacaagagaataggaaatagaagaaaaagccaaatttacccttcaattccgtagctttggaagatcccacaaaaacacattccatgcatcatatccttctctctctctctcttctttctcaaagagtaaaatgaaacacaatctctgatgtgaagtcggttctgtccttataaatacccattaagacttctctctctctctctttctcaccaaatagtttcatcatctcttcttcactaaatacttagacagagaaaacagagctttttaaagcc

SEQ ID NO: 4092 - DNA, 1809 bp, Arabidopsis thaliana
  misc_feature (1)..(1809): Ceres Promoter AtSREBP
aggcatgcatcatgtcggtagtggtactctactactacgtctcactctcgtatacacattaagacacctaacatgatctcttctctacttagacaatattacaaaaagattatctactatacgtacctcaaactcacgtactcacatcaacaagtggttaagtttgacttcccggctccgcctcttgcggcggttgcatcctccccacgtgcacacccacgcctttctctaactcttccccactcttgcaacgacaagtttaatctttactcggcgagcaaatactatgccgcttgaaccggcgtaacaacacccacgatcttcctaagtgtctcaaacctcagcttatcagcttactagtatccaatctataaatgtaaacactttaacttgttatgatttatcgtaaatcatttatgaatcaagaaaaccaaatttatatgcgtctacaactctacatgaactggaacatctgattgataacacattatagttcatattttcatatttgcaagcaaaggtataagaagaggatggaacaaaatataaaaaatgaattgaatcactcgccataaaataatatacttggcacattatttatgttttttgccaaacatttggcacaatttataaatttataaattacaaagactgaagcaaaccattattccatatatacaaaaaaaacttagcatttaaatttatattatagacaatcgcaataacatcaagggtaaatataaacattatttcatattctgtcgatccaatatatatagagaaatataaaggtatattattactgtgggtcatgtcgttttaagacaattccgacataagaacagttaactgttgaactttatttatgttttggactagtgagtagtgacacctcaaaagaaaaaaatgaatacacgtgagttacgagtttcaactaattcatttaacttactgtttgacatgatagctgtaaaatacaaagcacagcaacattttcattttatgggctttaacaacattgataatccatgtcaagcgagagataacgataattgagttcatttagattcaaatttcttttaaatgagaacttttaacaatggagctctttttttttggcttcggttagatattctgattcaaattgtacacaagcatcattatggatatgcttatattaaaaaccgtgtgatggcctattagtaacaagtagtatttaccaaactttgatcaaaaaattattagtagatataaatgttttccaatgcaactaatcgttgtattggaatagttcatgatgcaaacaaaattattaacaagtctttaccaaaatttaatccaaatgtatggctaatcacaaaaggtttccaatatcagcaagtaataattaatagttgaaatgatgctaaacaaaattaactacctaatgcctagagcaatgtaaattgtctctaatcaaaactttagtgttgaccaaaatcattaaacaattataatttgtaacgtatataatcaatcatgtgattagttcaaaaaagaaaccaaaaagtcgatcatacatttatataattgttaggtaattcatggacacacatcaattaattaacattacacttttgacagtgtaaaacagacagtgttataataagtgaagagtatatgaatagggctgagctgtgcaaagacctgtctctctctcacttataattccctcttcacacattacttcttcacttatagagattctcacttacatttcccattttacccttcttcttccttcaaatccactgatgtcttgttattgaa

SEQ ID NO: 4093 - DNA, 1616 bp, Arabidopsis thaliana
  misc_feature (1)..(1616): Ceres Promoter AtSQS1
acgatcagttaatgaacaatgaatcctaaaatgcgagttatttaatttccatcatgtacaatgagatcttcagaagcatccgaattacttactactaaagaggaattgaaattgaactaacaaatttacacatcaattaaacccagaaactgagaaattctaccgagagttcttgaagaaaccatcccatcgccttgtgaaacttcgaaatcccaacacaatcagcacttgaatttcatgccgagaccatgcttaccacgaacgataccaggcttcaaaaacggagatatcttcgaggcatagaccttggcgattgctcttttccccagtttcctcatcctttgtctccccaccttcttactcacgctacgcggaaccaactcttcgtcaagatcatacgaatcgtcgtactcgcgatcttcttcgccgtcgtcattaacactatctccgtacgtaattccaacagaataaccagaacctccaccgagaaacatcatccgctgctgagaccatccaagatcattctcatcaacttcatcgcgaacgacatcatcgccaacatcatcatcaccatccagatccacggcgagatcaccaccgtcagcaataggaattatctcatgcggcggagaaatgacagagggtgcgacaaaggaagcgtcgtcaagagatatgacgtcatcgtcggaaagactatcgacggagaaagaatcgtcggagaactcgccatcagaaggattaacaacttcccagagatcgagatcaacttcttgatcgagaatgagaggagacatggtgataaccctagatcgctgcgccattttcgaaattgtgtgttgtttagaggttgcttctttgatttttcaagactgtttgtttttgataaccagaggaagttaccctattaatagaggcaaaccaccgagtgttatcttgtgctaattggtagttacactgttgaagatacgtatttacaaccagttatatgttgccacgtaaggattattttgccacctcagcgtcgccagaaagtttgccagtaaataaataagtggacatgtaaatttgatgtcgtacatttatgataataaaaactaaaaagataccttttcttccatttttttagaatatacctttttttcctttcaacatctataatttgatcatttctttctaattttgttaatttctgattatattaaacacattttctctgttttctgtttttttaatctaattaacacataagaaaaagggagttaaaaagaataaatgtactctccatttccatttgatgatattctttaagtttcgtggctctttttcaatttcattggctctgacattttgtttttaattaaaaaggaagaaacaaacaaaatgtgaatccttgtgagttggctcactggcaaaaaagaaagaaaaaaaattcagaagcctttgttttcatcgatgaataaattaacaaacaaaactaaaaaataggatattcgctggccgaatcgcgtcgatccacatcgcaggtgagggttcctgcaatttatccctcgtggtctctgaatctcagatcgtcgtcaacgaatcctccattttctgaatcaaaattttctggaaac

SEQ ID NO: 4094 - DNA, 971 bp, Arabidopsis thaliana
  misc_feature (1)..(971): Ceres Promoter AtBBE2 Arabidopsis berberine bridge enzyme gene 2 promoter
ggttcgtcaatattgtcgaggtaataaagcgtagggtataatgtatgtgtagattttttgattgcctagtcaaagggtaaccggttaacaaggaagattattagttactacaattctaggacaggagagaatgtatttaggcttcacgccacaactactgaagatagtggtgtcgctatctttagatgtgataaacataaagtcgtgtcggtatccttgaaaagttgaaattagtgcgtattagcattgtttatccctaaaggcacatatatattgttccttactttcaaacgacatatatttcttcagaaccttttgctataatatgtctgaataatcattacaatatagtatatacacacaaaacttattgatactatgcattctctttggctatgttggaaaattcacttgcatgacttgtataaacttctaagttatgcatgcgttttaaataatcaagttactactataaattaagatacaggtatgtatagcaattaattaaaaactaattaatacagtttagtaatgaataatgatataaacattatacagtacagtgtcgctgtttcagtaatgatataatattcacatcagatttacatgtaaagattcagatcatagcaaattagcaatgaagtaaaggacaatgcaagaaattgaccaaattacttgaatattctaataattcatttcttttctttttttggttggcgaaacatatatatttggttacgttatatgcttaagggatatactgcttatttttcaagtaatcaaaatataaagatagaattatagtaaggagataaaagttgagattttagtaatagaataaaaatagtaatgaagtaatatttacaccaactttacgtgtaagccatccccacacacacatcaacctcctatataaacctaaacacatacctcaaacaaccaaaagcaaaaacctcatcgacataaaaaga

SEQ ID NO: 4095 - DNA, 1006 bp, Arabidopsis thaliana
  misc_feature (1)..(1006): Ceres Promoter AtBBE5 Arabidopsis berberine bridge enzyme gene 5 promoter
tcctggagctaccattggcatttaataattgtttttgataattagaaagaaaatctttgaattaaatatttaacaatcttcccaaaatctctccatattaactacacgattagttacttaaataaagcttccaaaatatttaatatcatttaattactacaaaattatcatttttgatattgtttttctacatgactataacaattcgattataatcatcaattgtaactttaaaaaacttttatatataaacttttatatgtagtaactttaaaaaataaattgtccccgcggtataccgcgtgttaaaatctagttatatttaaaagttaaaactaacaaaaacgaaagtgtacttgatagaaacatagcttatatggcctaaatgtggtattaagtcttccaaagcaaaccatgaatagtttaagttttctagtgatgtaatgcatataattttatggattttagatagtgttgttttgagaaccatagtgttatttatatagagattaattcttaatttggcccttaatcaaattagaagttattaagtatatccagatatttacttttcattatatttatgtctcatgtcatttacttcatatatcaattgagtacataaacttagattaatcaaacaataaccataacatactgattaataccccaattaagttttagagaagtaactttgaattcatatgactctttttaacttaattttggacaactgaatgtgcattattttgtcgctttacaaacccgtggaaaatgttggtcacgttgctatcatttcacctaatcgtttcgtttgacaaatcaaaccatctttgaatttagagaaaaattcaatggaccttattttatcagaatcgctatatatttattaaaaaaaatggaaactcatttcttcttttacaagaaagaacaatatacaacatttccatcttgaagccttattgtgtgtttagcttctctcttgcatataatattcgctgctagg

SEQ ID NO: 4096 - DNA, 450 bp, Arabidopsis thaliana
  misc_feature (1)..(450): Ceres Promoter AtCR2 Arabidopsis putative codeinone reductase gene 2 promoter
tttgttttatgaagctaaaatgcttagctcacttggctccatttttccacacgggtgttaatgctcatacgtgacatgcttttgagaaaaagctgaaaacaacttatattaattcattattgatttacatattaaaattttgaaattttagcacaaattacataacatattattctttaaaagttttccaaataaacaatattaaagaatactaattcaaatatttttcgtatataatatcatgactactttctattaacaatttatagtcaaattatatagcgttataaacttataatatgaagacttacgtacttttctaatcaaagagagtatattaatataatattatcaggcactagcattagtcagtggctactgagtaaagctttgggccaccgagagaaaccattttctgagagcacactttcgttgacttctctttaacca

SEQ ID NO: 4097 - DNA, 1000 bp, Arabidopsis thaliana
  misc_feature (1)..(1000): Ceres Promoter AtROX6 Arabidopsis putative reticuline oxidase gene 6 promoter
agctatacatcctccttgcatttattatagtgcctagatttttttttttttttttttgacattcagtgcctagaattttggtttatgtagatagaaaagtgacactcgacgcaaattcgaaagaatgccaccgaaaaaaatggaacgaatgatgtttcgctatgttggatgcttcagatcccatataacaacactactctcaaaattcataaactctcaaaacatattaatttagtagcatcacgaaaatacatgttgttctcaaatcattacaataacttctactcttattagctgaaaagtataaccttatgtttttgtaaaaagattgctaaacgttatatttgtatatcttttcagtttgttaatgtcattagaacgaagtgtaaaatcgcttcaagatttgttattctaaatgtattttagaacaaatattctgaacattaaattattttcaacaaaatttattttgaataacaaataacttgtcatggtcgtaactcttttttttcattctctagattgaatcaaaaataattttgttttgtagtataaaacatttttggtcttttattcaccgttttatagaacattaatatctcaagttctaatatgaaaacaaaaataactgatccctcaaaaaaaaggaagataaaggttgaaagacatgttattctcttcccaaaacaacctaatccaatacctctaaaaatttatctttctcacaatgccttcaaacaaattgtgttctttctatagttaacttgactatattaaaatctctaaagttaacttgacttctgaaacttgtgatctttctatagttaacttgactatattaaaatcttgagcaattaaaccattaaaaaaaaaaaaaacaggagaaaccttgaccaatacaacaaatcctaaaaatggccaacgataagaatcacaacagaaatttaaagactacatgtaactatttatactacagaaaacaccaaatagaatccaatca

SEQ ID NO: 4098 - DNA, 1000 bp, Arabidopsis thaliana; identical to SEQ ID NO: 4097
  misc_feature (1)..(1000): Ceres Promoter AtROX7 Arabidopsis putative reticuline oxidase gene 7 promoter

SEQ ID NO: 4099 - DNA, 1039 bp, Eschscholzia californica
  misc_feature (1)..(1039): Ceres Promoter EcBBE Eschscholzia californica berberine bridge enzyme gene promoter
atctaacatgtacatagaccctagtatccttccataattttatgattgattgattctatcctctcattaagtctatataaggctaatactggtttcccattctgttggctactatcaaaatgacctaattagcaaagacaatttatctagttgactactatactaacaatggaactccctaaccaaagaaagagaagatatgggtgggtggggggagagtgacattcttctctaggttttcaattcctcccttgatcttaattttcctttctttcttttattgttttagattttcattatcacaagtaatcaacttgagttttcaacaaaaaaaaataatcaacttgagtataaaatttaatataaaatattagattttaattaataatcaactacaaaatttgagcgggacaaataaaaatcacgtgatttttttttataaaaggcaattaaacgttgtctgtaatcatgtaagaaagattctgactgaatgtataaaaaaattaatagttaagacgtggaaagaaccaaaaaccgtagtatatagtaattaattattttataaggtccaaattattattattagtcaatctaaccaggctgtattactattactaaatctattaatttatgaaaaattagctcgtaatctctttcttcccaaatttactcccacgcacacctcgtggtaggtcatcgtgcgtctcttatctattaactcatttgtttttaaatccctaagtcacctttataatcctgattttctaatccaacggtgcgtaattctctaacttgatcttgaagtccgcatctcattcttagaaccactgattgaaatatttgggatttgtttcgggatttgaccggtctcaataatagatttgtggacagacagccgccaatctggacagtatcttacacgtgtgagatgactgtaggatatgtggggtccatagaattagttgaccaaatcaaagttagttgacttaaaattcacagtataaataggattgacaatcataactggcattctcgtagt

SEQ ID NO: 4100 - DNA, 850 bp, Eschscholzia californica
  misc_feature (1)..(850): Ceres Promoter EcNMCH3 Eschscholzia californica N-methylcoclaurine 3- hydroxylase gene promoter
taacttaatttttcattagttcatggcagctagctagctaggctcctgttttcttatcttcatcaagaggtggtgatatactatgtgtatcttgactgtgatatacaaattaaccatgagacacaagttaggtgggtaggtggacatgagctataggtggctaataaggcaagaaagggagatattttcttcgatcaccaagggcgtaggtggctgggtcatgagctatagttggtttttgataattcttcaatacgtgtggtccatgacattccttaggcaggatgatttggttggaaaactggctataacgctgccggtctttagtctaatgaacgtggcatgaaggatggttagtattgtggttagctcaattcagactcttttcactacatacgattgagaatggttggactttgtttggttttctcactcgctacgtctcagttgatgggtctaaggcctctttcttttcgttttagactaataaagttatctttatcgcgttctcattgtagattatgtaccaatgattatctttttctttctctctcttttgattatgtggtcttttgattatttgtctctctttaagatgagacaaataattgtagccccttttttttctgcataaatgcaatttgtcttgctaccatttttcgaatggaactttaagatgagacaaataattattgagtggtatgagtctatatgatgttgacttcatcatggaccactccatacccccaaaaactaacactatgatctaaagctatattaaaacggtttggttttgtggttagactaccagttcatcctctctatctcctcccaagaatatcaggtagct

SEQ ID NO: 4101 - DNA, 1001 bp, Arabidopsis thaliana
  misc_feature (1)..(1001): Ceres Promoter AtSS1 Arabidopsis putative strictosidine synthase gene 1 promoter
agcaaccaatatgtacgtccatctttatatttattgaaaaataatgatatattgggaggtcaaaaatcggataagcttatgattctttttgtgcatttgcattttatttacccaacatatggaccataatattatatcttctgtttattatggtctatatgctagaatgtaataatacatcggaattttgaaagactagaaacattgctttgaaatcctgtgtattttgcacccaaaaaaaaataaaaaaaattgtgtgtttatatacgcaatttattcttaaccacatagtagttgtaaattgtaaacgcaaacagtaaacataaaacattccatattattgacgttttacgtttgtgtttacaatttgcaattgatgtttgatgataaacgcatcgatcgtcaatatttgatcaacaagactaagatcattgaatgcgactatgcgaccggttgatttattaacagtatccatttggtcctttcaatatcacaaaaatcttaaatttccttttttttttaatatccaagcaaatattctagggtatttctcaaaagtatatgtattttatttatttgtaatcaactgctccttggaattacacttgtatatattttctgatatctaaatacctacttctactttatcaaaaaaaagtttacctacttctaatcaatcttagacacaagtacataaatttttagaccatgcgtttgcgatcttgcgttgacagtcgtacgtctaccccaaaaatcagcaatgtacgtggattgcaactatttgactttttgttccatgtgcaacttaatctgtcaagaaaccccgagaaacaactctaatctcttcactaataaaataatccgacgagcataacgtgtgccatcaacttaatttacaaaataagaaaccttcttaaaaattaatcaaaaaagaaaaagaaaagttaaataatcaaacctataaatattcgtaacgactacaaagtacaagaaagtctcat

SEQ ID NO: 4102 - DNA, 976 bp, Arabidopsis thaliana
  misc_feature (1)..(976): Ceres Promoter AtSS3 Arabidopsis putative strictosidine synthase gene 3 promoter
aaggtctgtttacagttattttaaccataataatatcccctcaaatgtcctgcttgttacgtgggtgacacaattgttcggtgattccttgaataggctactactacttattgtttcatattttcgaagagattatctctagttcttaaggctttggttttctttgttttcaccctttgttttacttcataaagacgaaaaacaagaaaaattaagtatctatactaaaaaaaaatatgatctataattcgatatgtacacacgtttatacattgacttttatacaacacgttagtagatagaaccgtcattcttatagtatcaatatataaactataaagtaagatactagaatgcggccgatttatataggtacatccattttgaccattttaatgtcataagatctcgaaggtgtgaaatgtgaatggtggtgattaaaaaaacaagagtgtgcggtgtcgtacggtgagacggtttattttgcactatcatcatatgtgattttcgtgcacgctttagagaaaaaaaaattccacaatccacactatacatatatagaccataataatattttatgcatggtacaaaatgcagaagcaatgcaaatcaaattgctttccatttccgctaccgcatttactagtgaatcaagaaaagtaaatgtcaaaacatttaatgaaatgttcctaagataatgtgtagtatcttttcatcaatctacttctaattaatcttaaaactaacgtaatttaggcgtatttgtttcttgatttatattcaatattaattactaattttagtttgatttgtttctataaatactttgtctattgtcaactttagaaaaaaaaaaaaaaaaagatgtcttaatataaggaaatttcaaaaaaggtaacattccaaaaataaatctataaatatacatacatacatacagataagagatagataaaaagaacacaaccaaagaaac

SEQ ID NO: 4103 - DNA, 1003 bp, Papaver somniferum
  misc_feature (1)..(1003): Ceres Promoter PsBBE Papaver somniferum berberine bridge enzyme promoter
gttcctataaatgtggcttacagaagtcttgactgatgacaccaatgacaatcccgagaagttatctaaatgatctcgactgcaatcaagagcaaattttgaataccacagtaaaattaagtagaagaaatagaaaaaatagagcccgagaaccttactgatttggacaatattgtggttctatctttccgatttgttatttcatagcttttttattatgttattcaacttgatggatcttttttctcatatagtggaaagctaaattacacacaggagcatgaccgactgcttaccagtttgatgtccactcccaaaaaatctcgacttcgaacccaccacaaaatatccatccctaataacggtcgacaataaaggtttaacatcatgtctccttaatccattgccacagtaaaatcttttttacaacatttattttctgaaagaaaacatttacacagtgagcacttcaacaaatgacaccctagagagagtgccaaaaggcataaaactagagatccgcggagggctgtggagtgcgaacaagacatctcgacacttcattatctgtcaaaatatgatgattagctaccacaagatacccaaatcaaggataaaaacgagtaaataaatatcatattcgtttcatgaaaagaaatattatcactattttattttaatttaaaaatatgtaaattggaaaaatgatagccactttttttacggaaacagagggaacataatccgaatctaagtgttagtttgtctatctccatctttgatgaccattgaaatgcaatgtccaatcctaacgaaactggaatggcccgtgacatgtagcacagctgcacagcagccatttgagaaagtcagacgcgtttactcccacgtgcatcgcgtttacatctaataaaatgttagagttgcacgtgcctgcgggttattaaaaccagcactatattttgagcaccatttctttctatttttgacgtacttctccaac

SEQ ID NO: 4104 - DNA, 610 bp, Papaver somniferum
  misc_feature (1)..(610): Ceres Promoter PsROMT Papaver somniferum hydroxy N-methyl S-coclaurine 4-O-methyltransferase 2 gene promoter
ttaagtgtttttagttttgttacaagtttggtgaatgatctttgatgatattttttttttgaagtagtgaacgaagtaatgttctacttcccataggatttgctctaacgattaactatgtttgtcccaaagggttgtatgacttacatacacaatattaaaagattcgaggataaggatatgtttattaaccaactcctcaaaacatttagacctggatcaatcagttcgattcttctcagacaattacgacatgtatgaatcgatggatacatttgaaacatatatccttacccgtgccgttacggcatgggttgagacctagtgattacatataaaacaactaattataccaatgacttgagttcgaaactcgtcccatgatcaattttttatcaatcaaaagaaatttatacgaaaggaaactatatgattgccatgactcgtaaatatacacaagcaatatggaggtcctattaactccaatcaaaccacaatagataaatatatcgtgaatcatgtgtggccaatatatacccacacttctatatataagtgcatccacttctctttgttttccaaaacaaaacataaacacaatttattcaga

SEQ ID NO: 4105 - DNA, 575 bp, Papaver somniferum
  misc_feature (1)..(575): Ceres Promoter PsHMCOMT2 Papaver somniferum (R,S)-reticuline 7-O-methyltransferase gene promoter
agcacagaaaaaagcccttgctctttcatgtagcatattattaattaagcttgtcaattttcagtcttatgttttgaagcatattggctgagatttttattatgtgcttgactgggttttccaggaaattaccactggcaggtcaatcaagaatttttctcagaacttaaacttccggcccggcagatgcaagaaaacacatataccacttgcatgaaaccagatatagcatgggctgacctttctcagaattattcccacgagcttcttgcttttctctcgtgggctgatgatatatgtgacactcctcaacagcaaccgccactgtcaacaactttagtactataccaacttataatgatttcttagttaggtcatggtgggggacttattcttttcttttttttttgttgaatattcatatctgcatcctttaatgcacacaaacggtccggcaggcttagctgcatgcacttataaatacaccataaattttgaagagatttcaaaacacccacacataacccaaagccaaagcaaaaaactgtcttctcttcttgacaattatatacagc

SEQ ID NO: 4106 - DNA, 971 bp, Arabidopsis thaliana
  misc_feature (1)..(971): Ceres Promoter AtWDC Arabidopsis putative tryptophan decarboxylase gene promoter
gaaggcttgtactgttccaaccgtccattactttttttgagaaaatttgttgagagggcaattttcaagtttgtaaatttgccacttcaataacttctttgatttgatttgtcaattaggtagttcttacttcttactacattgatgtcatgcactttcatttagctgtcattttagagaagaaattacaaaaacgttattattttaactaactacttatgtggaatactatctcatttcgggggtacattgttttaacggtggcgataaaaagtgttttgtaacagtgaatagagaataatatactgttgacacatgatagtgtaaaagtgaacattatataacgaacaagtgtgtggtaaatactatcaccagggtaaagtaaagacattgttgtattaatgtgacccatgctgacgaaaatatgtatgtctgtgactcataatgacaaaaattattaatcatacatcatgtcatcactttgccttaatttgttggttaatatagagcatatgttggctaataaaaagaagaagaagaaactatcaaaataaaaattacgagaacgttacaaaagtaaaaaaattagatgcatacatgtgttaaatgttttataaagtttaatttgtgtggagtatatcatttttgaacaaataaccataaatagaaaaacaagaaaatactcaattcttaagtcaaaaatagtattaccaaagtcaaaaatagatgtacgcatgtgttcttcgagtatctcaattctttcgaaggtattatatattttatatttatgctaaaattttacagcttctatgatagagagtgacttattatactatataaacgctagaccattgagtgatgcaaatcacaaagcttctttaataacacacatacagattctttcaacagctgccactacctttcgaaatgtaagcatctcctctaatctccatcatttttcagaatgtgtt

SEQ ID NO: 4107 - DNA, 1899 bp, Arabidopsis thaliana
  misc_feature (1)..(1899): Ceres Promoter AtHMGR
attaaaaatggtttgccctaaagatattctatgtttttttcgtgaataggtgttaaggatattaaacaaaaatacccttatttattcttacgactatcttgtgtctatagcactctagcttctacgttggtatcatttatattttaaaaagattttgtgatattattatttactggtataaattttaaaatttctcacgtttaataaaactaaacatattaataatttaaaattattttacttttgatttttattgatatggttgacgaaaaagagtgattagtaatggaagtttgtctggatatgcatttttttttcttcgtaacgtgtatctcgttataagaactcatatgtattatatgagccaaatcaaatcgtgtgtattaaaattggttgccctaagaaaattcaatgtttctttcgtgaaagaaagtctattttttttatagatttgattctcttcttgggatttccacattaaaattattatcttagaggctcagtttgatacatacactatattttttatatattgttcaacgtatagtgactgaatggtagttgtttaaaaggattgtgtaaacgagttggatagccaaaactatgttaacttgatccttgtaaagtaaacaaagccatgcatcctctaattcaacaatttggtcccattaccccaagaaaatgttataaagaggttatctttatcaattacttgtaaacaggacattatctttataaagaaaatgatatacatgctgcatttttttggtttggtagttttacatgctgcattttgtacttgcaaccacttctatactaattgttttagataagatagtaccttcttgtttgatcacatcgtaaaaggatcggatatgttaaccgtctttttccaaacgttatatactcttcaacactcatcataatgtatggagatgtatcaagtatctcttacgaccattggtctttgcggcctaatttgcaacagaaagtcagaaatatccatactataactatgctatttgaaaattattcattttgactcatatataaagtagagttaattaggtgtatagccaaattatggatgaaaattagacaaatgatcatgacattcttttttcttaatttcccaaaagaattgtaatatcagaagggaaaaatacattccacacatagttagaacttagaagaggtccaatcaataggcggtaaaaattaatttgtaacggtaaacaaaaacgataaaggataatagtacaaactaattggcaattaatactgtttttggtcaaatatatatgtcacgacagtagatgaaaataccgtttttggttgaatcgttttattttttactttgtcttgaatcttgtctactcttcaataccgtttttcgttgaatcattcaaaaaaaaacagatctcctagtgatatgaatcaaagtttatcaataaaaatcttagtatacatttgcaaaccataacttcataattttgaataaacgataatgtaagacaggttggctcattagaaagcatatcaaattaattgtaaggacacaaatatctataattaatgcaggcttttatgaatcaatcatcatcattcacatcctcgtataattgtctaatttcgtacctcaaaaaaaaaacaacaacgtgaaaacctaaaattagatgagttacgaaaattaggcaaaaataaataaactaaatcatagtattacaaaacaaaatgaaaacgaaaaaatgaagaaaaagcaagctggtccccaacagacatgcgagttcgtctcctataaaactttgttaatctctccttcacacttatcacgccacctcaccacctctctcctctctcctctctctcccccctggagagattattcattccctccaa

SEQ ID NO: 4108 - DNA, 1817 bp, Arabidopsis thaliana
  misc_feature (1)..(1817): Ceres Promoter AtATTPS3
acattaaaaggtatttggtttgccggaaaaatgatcattttattttccaaactatttgtaattaacacaattattttttaattatatgtgcgcaaaattgatttttaatttgtcgttaacttaacaatttggtccaaaatttgatcaatgtttactagttgatatagaaacgttaaattactcgattaaaacctaataaactcaaaaaatcctaaaatttctcccaaattgaaagctaagtcattacttcgaataaaaaaaaaaaatcttcatctattcatcgtacttcgccaaaatatgcgaattcgattttattatttagctgaaattcatttattactattttctgcatggcaatgtttcgttaattttttactttcaattttattgtaattttaattcaaattataatatatgtacataatttaacaatgtgtttgataactttctctaaaattgttgtcatttattatttatacatagatatcaggaccggtttagagtgtgtgccaagtgccaatggtgcatttgtactgtttaagcaatcatggtcctattttctcaaaaatatataataaatgtccaaatccatacataagatataaacatgttttttataattagatacagggttctatttttctctgagtcggccctgatagatacatactatcagattaggcagaggtatggactatggagtaatttatgggggcacatccatccgttggtatgatcaaaatttagtataagtcttcagaaagtattttttagatgggatgaatttgcctctctattatcccaagattgaatccccatttccttcagaagcagtaaatacaaattaaactactgagctacaaattcgcgtaaagctacatgtgtatttttaatctcaaagttgctgtaattatgaaatgtgaacgaaatagaagtgacaggagcttgagtgccccatgagataagaacttatagatgtatattaatttaaactgtactgtctaaacctagacaacgccgtgacgtctttgcccacatgtgattattcgttaccacctctcttagtgtggtccaacaaaattggcctctcagttttcattgaaggcagggatagagatatacaggtagtcacatggacaccgaatcgatatttattccttggaatttcattaaggtttttcgaaccaagacaagacaagctatgcatgaaaccatttgccatgccattaacgtggactaagggtggacactgatctatctcgtacttgttattaataaaaacaaccgatttgtttttgtttttgttattatatctcctactttttgttataccatgcatgtccacacgtttttttcaatttgttacatgtccacaactttcacaaatatttttaccaaaaaaacaaaaaaaagtttgacaaatatctttagattttttttttgggcaattagtgacaaagcaagggacgttgaaagcaagaaacgtaaatgtttggatatcacaccacaccaatatgttttagccattacttctccaagtttttttgttgtgtgggaataatacttctccaagatatttaagaaaacgcaaatgcatggtcattgaattatatagcgagaaaacgtcaaaaactaaactgattaaaacagatattcttttagtaaaacagaaaaaataaaaatatcttcatatatataacctgtggtccgagacccaaaccttaaatcagtataaaatatcatagcggagtctaaagaagagttcatccaattatttaactctttagtgtaatcattagcaacgcaaagaaatgccc

SEQ ID NO: 4109 - DNA, 1823 bp, Arabidopsis thaliana
  misc_feature (1)..(1823): Ceres Promoter 21876
gtctcttaaaaaggatgaacaaacacgaaactggtggattatacaaatgtcgccttatacatatatcggttattggccaaaagagctattttaccttatggataatggtgctactatggttggagttggaggtgtagttcaggcttcaccttctggtttaagccctccaatgggtaatggtaaatttccggcaaaaggtcctttgagatcagccatgttttccaatgttgaggtcttatattccaagtatgagaaaggtaaaataaatgcgtttcctatagtggagttgctagatagtagtagatgttatgggctacgaattggtaagagagttcgattttggactagtccactcggatactttttcaattatggtggtcctggaggaatctcttgtggagtttgatatttgcgagtataatctttgaacttgtgtagattgtacccaaaaccgaaaacatatcctatataaatttcattatgagagtaaaattgtttgttttatgtatcatttctcaactgtgattgagttgactattgaaaacatatcttagataagtttcgttatgagagttaatgatgattgatgacatacacactcctttatgatggtgattcaacgttttggagaaaatttatttataatctctcataaattctccgttattagttgaataaaatcttaaatgtctcctttaaccatagcaaaccaacttaaaaatttagattttaaagttaagatggatattgtgattcaacgattaattatcgtaatgcatattgattatgtaaaataaaatctaactaccggaatttattcaataactccattgtgtgactgcatttaaatatatgttttatgtcccattaattaggctgtaatttcgatttatcaatttatatactagtattaatttaattccatagatttatcaaagccaactcatgacggctagggttttccgtcaccttttcgatcatcaagagagtttttttataaaaaaatttatacaattatacaatttcttaaccaaacaacacataattataagctatttaacatttcaaattgaaaaaaaaaatgtatgagaattttgtggatccatttttgtaattctttgttgggtaaattcacaaccaaaaaaatagaaaggcccaaaacgcgtaagggcaaattagtaaaagtagaaccacaaagagaaagcgaaaaccctagacacctcgtagctataagtaccctcgagtcgaccaggattagggtgcgctctcatatttctcacattttcgtagccgcaagactcctttcagattcttacttgcaggttagatattttctctctttagtgtctccgatcttcatcttcttatgattattgtagctgtttagggtttagattcttagttttagctctatattgactgtgattatcgcttattctttgctgttgttatactgcttttgattctctagctttagatccgtttactcgtcgatcaatattgttcctattgagtctgatgtataatcctctgattaattgatagcgtttagttttgatatcgtcttcgcatgttttttatcatgtcgatctgtatctgctctggttatagttgattctgatgtatttggttggtgatgttccttagatttgatatacctgttgtctcgtggtttgatatgatagctcaactggtgatatgtggttttgtttcagtggatctgtgtttgattatattgttgacgttttggttgttgtatggttgatggttgatgtatttttgttgattctgatgtttcgatttttgtttttgttttgacagct

SEQ ID NO: 4110 - DNA, 1000 bp, Arabidopsis thaliana
  misc_feature (1)..(1000): Ceres Promoter PT0668
atagagttttactatgcttttggaatctttcttctaatgtgccaactacagagaaatacatgtattaccactaggaatcggaccatatcatagatatcaggattagataactagttctcgtcgctatcacttcgcattaagttctagtaattgttaaagattctaattttttactaaacaaaaactaaatcaacatcaaatatgcaaagtgtgtgttgtccacacaagtgactcaaagtatacgcaggtgggattggaccatattattgcaaatcgtttccgaaccactcatatttctttttttctctcctttttttatccggagaattatggaaccacttcatttcaacttcaaaactaattttttggttcagtgatcaaatacaaaaaaaaaaaaaaagttatagatattaaatagaaaactattccaatcttaaaaatacaaatgaaaccataattttaatttatacaaaactatttaattagctaagggttgtcttaacgtttagaaaataaaaaattatgattgtctgtttaaaattacaatgaatgaataaaaaaaatatgcaatgaatgaaagaataaattttgtacatccgatagaatgagaaaatgaattttgtacaaaccactcaagaattcaaaacaattgtcaaagttttcttctcagccgtgtgtcctcctctcctagccgccacatctcacacactaatgctaaccacgcgatgtaaccgtaagcgctgagtttttgcatttcagatttcacttccaccaaacaaaactcgccacgtcatcaatacgaatcattccgtataaacgtctagattctttacagcctacaatgttctcttctttggtcggccattatttaacgctttgaacctaaatctagcccagccaacgaagaagacgaagcaaatccaaaccaaagttctccattttcgtagcttctttaagctttttcagtatcatagagacacttttttttttttgattagaa

SEQ ID NO: 4111 - DNA, 1000 bp, Arabidopsis thaliana
  misc_feature (1)..(1000): Ceres Promoter PT0535
ttagtgaaattatgacattaagtaaggttttcttagttagctaatgtatggctattcaattgttatgttaggctattttagttagtatatgaatttaggcagtctatgcaaatgatttcgttttcattttttcatatgtaaacatcaagatcaagtaacgccattcgagttgatattttttttttaaattagtgtgtgtaaattttggaccgcttatttgagtttgctaatgaagttgcatatatattacgttaaaccataggcaaactaatttgaaacatccgattcgatttcctgtaatttttcttggttaattgaccaaaatcaagatcttcagaaataaaataaaagacgaaagaaagctgtcgcaaagcagattgtgttaaaaaaaagtggattgggctcaaacgcaacttgtccagcccgtgacaattaccctatacgcaagtaagagtaacgtatcactggcaaaagttggtattagttacgatatctttgtcatgggggcatgcatgggcatggcttaagagttaagccttaagaagagtcccacactcgtgactctcatgatcacttgttgtttcttacgggcaaatacatttaactttattcttcatttattcacctatattcttttggataataacttttctctatataaaataacaaacatcgtacgtttcatttatttacaacaagcgatgagaattaaaaggagaccttaattgatgatactcttcttttctctcggttacaacgggattattacagataatgataatctatatggatgctgacgtggaaaaacaaaatttggtgaaacacgtcaattaagcacgacttttccatggctagtggctaagatcgtttcatcacatggctatatcatataatacttggatgaattcaaaataaacgactgagaaaatgtccacgtcacggcgcaccgctttggacttaagtctcctataataaatacaacaccaaacattgcattcca

SEQ ID NO: 4112 - DNA, 999 bp, Arabidopsis thaliana
  misc_feature (1)..(999): Ceres Promoter PT0585
tgaagtcatttaatatgagtttgacattaggtaaacctaatctatgagattatagaatgtagcaaaactatcaatgtttcttttccaaaatattttgtggtttttctttttggttcattatgttttgttatttgtgaattattttaatatgaagtaattatattgattttatatgatatacatattattttgatataaaatttaacacttatccattaaaatagcatgggcataatcaaaatcgggactattacgatgaaaaagatagttaaattgtatgataaaataaaatgtgtaagattaaaattttgggttttagaaaattactaaacaaaatatagacaaagtatgttgactattatttaaaatttaaatatcatcaataagatatagttaaagtcattaagtgtatagcaaaatgaaaattctaagattaaaattcgattaaaattttttttactaaattaaatatttaaaaatagggattatcatttactatttacaattctaatatcatgggtaaaaattgataactttttttaaacccgcctatctaggtgggcctaacctagtttactaattactatatgattaacttattaccacttttacttcttcttttttggtcaaattactttattgttttttataaagtcaaattactctttgcattgtaaataatagtagtaactaaaatcttaaaacaaaatattcaacctttcccattattggaatggtaatgtcttcaacaccattgaccaacgttaaggaatgtcttttaatatttttggaacctaaatgctaatactgtataccacaatcacttatgagtattgaagttgagatagaggaggtacaaggagaccttatctgcagaagacaaaaagccatttttagcaaaactaaagaaagaaaaaagattgaaacacaaatatgcgccactcgtagtccacccctatctctttggcaaaagccacttcactctttttccctttttat

SEQ ID NO: 4113 - DNA, 1000 bp, Arabidopsis thaliana
  misc_feature (1)..(1000): Ceres Promoter PT0613
ttaatactaacattgtagaaagccacaaaaaagaaattgaaatgtgagtagatgctgagtcagaggtttggtcaatacacaacagctaattgagataatattatacacgtcacgatgacttgttttttctcctcccaacttgttaatttctttattcttaaaattaaaccatcgcaaaaacagaagaacacagctgtttttctcgactcccaatttctattttgctgctaaggacatttcatttcattatttcccaattcaggactccttagattttcctaaatttgttttcctaacttgctctctctcattctaacattttctcatttttttagattatcttgtactttttagtagattattttatcaggttttacaaacatacattgacattctaaaaagggcttctaaaaattcagtgtggaatgctgatatactaaaaaaaggtcatgcaaaattatctacgatttatctaaaattagataatttgccatatataactattaactaataatcgatcctttgattttttgtttagataaaacgaaacagctatatcttttttttttgttatcggattttaatcgaataaaagctgaaaaataacagttatatcttcttcttttttaactaatgaaacagttatatcttaaacaaacaacagaaacagtaaaatattaatgcaaatccgcgtcaagagataaattttaacaaactaataacaattgagataagattagcgcaaaagaaactctaattttagagcgtgtaaacacaaacacgtcttgaaagtaaacgtgaattacacgcttctaaaacgagcgtgagttttggttataacgaagatacggtgaagtgtgacacctttctacgttaatttcagtttgaggacacaactcaagttatgtttgatatctaaggacttgcactgtctccaaatctgcaggaaggactttttgattggatcaatataaataccatctccattctcgtctccttc

SEQ ID NO: 4114 - DNA, 351 bp, Arabidopsis thaliana
  misc_feature (1)..(351): Ceres Promoter PT0625
gatcatgatcagtttcaactcgctgtgcccacgtgtcgagagatcggcacgtgcctgagctctcagccgctcataaatacacttgtttagtagcaacagtatactatagtagtcctctcctgtttggcttttagcttgcatcgatggatggatggatggatcgcatgagagggcttcgcgaaggtacggaaccttacacaacgcgtgtcctttctacgtggccatcgtgtaggcgtctcgccatgctacgtgtcccggaggatgtctcgatgccaacccttataaatactgttccattccaatcccatcgccacagccagtgcaaatctgatcgatcaagataatcgagca

SEQ ID NO: 4115 - DNA, 1022 bp, Arabidopsis thaliana
  misc_feature (1)..(1022): Ceres Promoter PT0633
cccgatcggccttaatctgagtcctaaaaactgttatacttaacagttaacgcatgatttgatggaggagccatagatgcaattcaatcaaactgaaatttctgcaagaatctcaaacacggagatctcaaagtttgaaagaaaatttatttcttcgactcaaaacaaacttacgaaatttaggtagaacttatatacattatattgtaattttttgtaacaaaatgtttttattattattatagaattttactggttaaattaaaaatgaatagaaaaggtgaattaagaggagagaggaggtaaacattttcttctattttttcatattttcaggataaattattgtaaaagtttacaagatttccatttgactagtgtaaatgaggaatattctctagtaagatcattatttcatctacttcttttatcttctaccagtagaggaataaacaatatttagctcctttgtaaatacaaattaattttcgttcttgacatcattcaattttaattttacgtataaaataaaagatcatacctattagaacgattaaggagaaatacaattcgaatgagaaggatgtgccgtttgttataataaacagccacacgacgtaaacgtaaaatgaccacatgatgggccaatagacatggaccgactactaataatagtaagttacattttaggatggaataaatatcataccgacatcagtttgaaagaaaagggaaaaaaagaaaaaataaataaaagatatactaccgacatgagttccaaaaagcaaaaaaaaagatcaagccgacacagacacgcgtagagagcaaaatgactttgacgtcacaccacgaaaacagacgcttcatacgtgtccctttatctctctcagtctctctataaacttagtgagaccctcctctgttttactcacaaatatgcaaactagaaaacaatcatcaggaataaagggtttgattacttctattggaaagaaaaaaatctttggaaaaggcctgcaggg

SEQ ID NO: 4116 - DNA, 1000 bp, Arabidopsis thaliana
  misc_feature (1)..(1000): Ceres Promoter PT0650
catacttaattctaaaaaaacaacacttatagtttataagcagctcttatgataaaaatctttctgagttatagctctgttaaacttgtattcaccccaaaaacggatgtttcatttcttattttttacttggagtattttattgtaatttgtaaaaaaaaatgtaaagtgggggatatcatgaaaaacaacgtcactttgtttggtcacaatatacatttgataaaataatggtcgtcgcgtgatttagttgatttttgttttatcaaccacgtgtttcacttgatgagtagtttatatagttaacatgattcggccacttcagatttgggtttgcccacatatgacataccgacatagaaggttaaatccacgtgggaaatgccaatattcaatgtttggttttcaaaagagaatcatttctttatatgatctcaaaagtatggaattgaaatgactaatgagcacatgcaattggtgctatcttaaaaaccgaacgtctttgaatttaatttgtttttcaccaaaggtacctaatgaaaccctttcattaaaaaataaaggtaacaaacaaaattttgtattggaaaaaacattttttggaatatataatttggtaatagaattatgagcaaaaaagaaaaagaaaagaaagaataatgagcataataaagcctttacagtattactaattgggccgagcagttttgggctcttgatcatgtctagtaatcttaaacagacgataaagttaactgcaatttagttggttcaggtgagctaccaaatccaaaaatacgcagattaggttcaccgtaccggaacaaaccggatttatcaaaatccttaagttatacgaaatcacgcttttccttcgatttctccgctcttctccactcttcttctctgttctatcgcagacatttttgtttatatgcatacataataataatacactcttgtcaggatttttgattctctctttggttttctcggaaaa

SEQ ID NO: 4117 - DNA, 998 bp, Arabidopsis thaliana
  misc_feature (1)..(998): Ceres Promoter PT0660
caagtcaagttccaatattctaaggagaaataatagtatactaaacatacattagagaggttaaacttctttttggatttaagtgtgtatgcataggctatttattcttaagtataactattaactgtagctagatttatacaagaaatacataaaactttatgcatgtgaggtagccatgaatatacgtacatgttgcaatcgattatacatgttgtatttggatttctctatacatgttttaacttgtcattctctaagtatatacataccattaatactgtgggcatgagtttatgataagacttttcttttggagaccagttttgttttcctttccacctatatttgtctataggcttcacggtacactagtttacaagtgtttttatatgttctaaataaaattgagattttccggaacggtatgatctgtttgcaaataaggacgtatatataacagtatcaaatatatttgttgttataaggcaataatatattttctgagatattgcgtgttacaaaaaagaaatatttgttaagaaaaaaaaagatggtcgaaaaaggggagtaggtgggggcggtcggcttttgattagtaataaaagaaaccacacgagtgacctaccgattcgactcaacgagtctaccgagctaacacagattcaactcgctcgagcttcgttttatgacaagttggtttttttttttttttttaattttttcatcttcttgggtttggttgggtcactcttcaggtcaggtgtgtaaaaaagaaagaaagaaaagagagattgttgtgttgtaacccctttgactaaaatctaatgaacttttttaacacaacaaaactccttcagatctgaaagggttcttcttctctcttagtctcttcgtccttttattctccgtcgtcgtttcatgatctgactctctggtcttctcttcttcttcttcttcttctattttttcttacttcgtcactgttgtgtctgaac

SEQ ID NO: 4118 - DNA, 1000 bp, Arabidopsis thaliana
  misc_feature (1)..(1000): Ceres Promoter PT0665
aaaaaggatgggtaatgggacctattttccccaacatcccacatgcacacttccctctccattctctcacatttatttctttcattctaatttatccattccgtgtgtaacatattcactaataatctcatctcactaactcattcattgattgtgatatgtttatctagaattagtgttttaacactgtgtctacatatgatttccttttcattgtatgtgaacatgttaactcactaatcattttgtattttcgagttaacatgagtctccacttcggtagactaaagtaaagataggtttgagtataataaagtttaaaatttgctttaaaatcaatatttataaataagtttttatcataagtgatttttgtatgttatattggaccttgtataaacagactacagaagaaaattatttatgagaacttgtaatgttagagtggacctcgtataaactaattatgtgggcttttaccataaactatttatgaaaattattatggcccacaccactataactaaagcccacatatttagcagcccagtttcattgtaagagacatgttcgctctggaactagaattttctggtttttgggtatttgttttcttatgtgtagagaaatgatggtaacgattaaatgttgtgtattacaatttacaatggtaagacgattaatatatttacacacaattttgttgttgctgtaacacgttagtgtgtgtgatgatagaatttcataaagctttaactacgaggggcaaaatgttaattctaaatagttgacagcagaaaaagatatgtatacataatataaggattaaaacgtaaataataataaataaggcgagttaaattaaaaccctgttaaaaccctagcttgaaacacatgtataaaaacacttgcgagcgcagcttcatcgccatcgccattctctctctcatcaaaagcttttctccttgattttcgcattctttagagtcttaacgcaaag

SEQ ID NO: 4119 - DNA, 999 bp, Arabidopsis thaliana
  misc_feature (1)..(999): Ceres Promoter PT0672
cagccgtaaatcctccataaatttattttgcaagttttgctcattatataatgagcggaatttatgatataatcgtttgtaataatgttatgttttgatcaaaatttgaaattaaaagtaggtgagaacttgttatacagtgtagataaggtggatcttgaatataaaaataaaatttataagatgtatttaaagcagaaaagcataaaactttagataaaataatgtaaaaatgtgttagcatcaatgttgggatattggccgacccgaacttaatcaatgtcggaagccattacttctctcccaaaagacctttttccttcggagaactaggaacttcctcactacctttcgcttaacgtgaaagccataaatttcatatattcataaaaatcagaaaatctaaaactgtttagtatcacctgtttttggtatagactattggttttgtgttacttcctaaactatatgatttcgtacttcattggatcttatagagatgaatattcgtaaaaagataagttatctggtgaaacgttacttcagtcatgttgggtctagatttacatactactatgaaacattttaagataataattatcctagccaactatatgttctatattatgggccaagaagatatagaactaaaagttcagaatttaacgatataaattactagtatattctaatacttgaatgattactgttttagttgtttagaataaatagtagcgtgttggttaagataccatctatccacatctatatttgtgtgggttacataaaatgtacataatattatatacatatatatgtatatttttgataaagccatatattactccttgacctctgcccccatttccttttactataaataggaatactcatgatcctctaattcagcaatcaacaccaacgaacacaaccttttccaaagccaataataaaagaacaaaagcttttagtttcatcaaagacgaagctgccttagaa

SEQ ID NO: 4120 - DNA, 1000 bp, Arabidopsis thaliana
  misc_feature (1)..(1000): Ceres Promoter PT0676
aagatagtacagtttcagtgttttgagaaaaaaagctgaactaaaactaaaatgtttaaggacacaatatttagtttcaattagataattcaacagtttgaacaattttttttttttttttttgaagtcatttatttatacaatgttttaaaacgcattaagcatttaggcagccgacaaacgcctattgtctaactgtaaataggcgcttccacttaggttcatattgcatatttactatatgtgtatagtgacaaaaaccaatatttctcttattttggatgaaggtatagtagttgttaaatgttcaatataattaagcattaatgacaaataaaataaaattaatttagttgataaaaagataatcttataaaaagatcgatgaatagatataatggtttactgaattctatagctcttaccttgcacgactatgtcccaaggagaggaagtaccttaactataattctgaacataattttgtctatcttggtgagtattatatgacctaaaccctttaataagaaaaagtataatactggcgtaacgtaataaattaacacaatcataagttgttgacaagcaaaaaaacatacataatttgtttaatgagatatattagttatagttcttatgtcaaagtacaattatgcctaccaaaattaattaatgatttcaacaggaagtctgagatgatgggccgacgtgtagttacgtttcttgaattgtgagagatggtatttattatactgaagaaaacattatttactaaataaattttcatttcacatcttctgtaatcaatgcgggtagatgaagaagttgttaatacgatggccaaccatatggatctcttttttggcgtttctatatatagtaacctcgactccaaaggcattacgtgactcaataaaatcaagtcttttgtttccttttatccaaaaaaaaaaaaaagtcttgtgtttctcttaggttggttgagaatcatttcatttca

SEQ ID NO: 4121 - DNA, 998 bp, Arabidopsis thaliana
  misc_feature (1)..(998): Ceres Promoter PT0678
aattaaatgaaaccgcccctaaattaggagggatttgggtaagtggtaacacattcactggaaacatgtgaagaaaggaggatgtcaagtagctgaaaactcagtatagtaaccaacggcttctcaccaacctttcattaataatttggtcatccctatatttttattcaacattttgtttttcaatagcttagagcaccttaatacctttcagtgtttttttataaaaaaaacaaaaattgggattaatcatcaatccccaaatgtaacgtttacttagattatgttcatttttctatacacacaaatcatattcttttgttttaatcttcgaaaaacgagaggacattaaatacccctaaaaaaggaggggacattactaccaacgtacattaacatgtttgatagcaaacgatttattttgttcgttttgaaaaggggaaagtaatgtgtaaattatgtaaagattaataaacttttatggtatagtaacattttcgaataataagagagggaaaacactcgccattgtcggcaatttagaaccaatattagaagggtttttttagagaaaaaggacttaaaagtttagagaccttaacaacaacttatttagaaatagacatgcttaagttgacaacagcgagtttattttctatatcgaagaaaaatacgaactttttcttaattagatttcgaatgcatgcactatcgagaatcgaccgtcacaagaaaaaactaatatacatactgtacatatctatattcaatattggtggggatgggtttaatgtgtatttataattcatggataaattcacacaataaggtccatgaaactagaaggtaccaaaaataagcattaatgactctttgccacttatatatatgattctctcatagtaccattttattctcccaaacctatcttcttcttcctctcttgtctctctcgctctctctcttctacattgtttcttgaggtcaatctattaaaa

SEQ ID NO: 4122 - DNA, 1000 bp, Arabidopsis thaliana
  misc_feature (1)..(1000): Ceres Promoter PT0683
gattgaatgatgagtgtgcacccttgtattactaataaaaaatttagcaacagttataagctaacgtcatccatgagtcattcattagattcactatttgcgttctcaaaaatcgaattgttaaaatttgagaagctctaatatacgagtcaatgagatgtggcaaaagcatgtccttgaccataaaatttcgaggggtcaactcattagataaggacaagaatcaaccaattgaaggcgtcttctataacaagtttctttattactaatattaaagtccaatggggtgagggggagaagaacttaaataaaaggaaataattggtaagtgaataaaatctaaatacgatactagatgattgatttgtgctagtgcatggtattagatcagatatgtgttactattcgaattcaaattggcatattccatgttgttgataagaaaattgtagaagtgtaaaagctgagttactatattcaaactagtggtttacataaagtgagacaacaactgtttcacaaaaatgactataaaatagtaagtagtattaggtcaattgattttaaaattttaatcaaattcaaatttgtgatataatcaaatttgtttatagaaaatgttaagaaatcaattttggcagaactaattcagtgagaaacaatcatttacaaaaacaattttaacattatttaacagtaagatttgacatttaacccgttcgtgtgaacccatcatatctaacatggctctacccatgacgcctccatgccatggacaattttgacagatcagaagttctgaacgtggacgaggtaagaacaccatgatgatacgattggagttagttatgtcgccaccgacatcactgccaatctcattaataaaagtggtactaaatctctaatctctattaactataaatataacaaagaaccaaaagaaagtttcttatctctcttatctttcataatttccaagaaacacaaaccttttctacta

SEQ ID NO: 4123 - DNA, 1000 bp, Arabidopsis thaliana
  misc_feature (1)..(1000): Ceres Promoter PT0688
acgttcagaggcatcgcttttgtacaaattgaagcgggtttgttcaatatttaaaataacacaggaaacattcaaatgtattattgatgttgcttaggtttgtgaaatgatatgaaccatatcgtatatattactagatttttcttatatgttttaagggtagtggggctgacctatcattctgtttggcattaccaatcagactatcagagtattcaccattcaggattccataactagaaaaagaaggggtttacattttctcatactgtataattttctactatcagagattttatcgattacattaatctcatagtgattattctgatttataaaaaagttgacaaaataattaaaaccagtattttataacaagattgtctctctcccatggccattattttgacctctgacttatttaaatcttaattaacagcataatactgtattaagcgtatttaaatgaaacaaaataaaagaaaaaaagaacaaaacgaaagagtggaccacatgcgtgtcaagaaaggccggtcgttaccgttaaggtgtgtcgaactgtgattgggccacgttaacggcgtatccaaaagaaagaaagggcacgtgtatagatctaggaaaaaagaaagaatggacggtttagattgtatctaggtaccaggaaatggaacgtcacaccaaacggtacgtgtcggatcctgcccgttgatgctgacggtcagcaacttccccttattcatgcccccctgcccgttaattacgtgtaacccttccatgcgaaaatcaaacccttttttttttttgcgttcttcttcaacttttctttttaaatcaaaccttttctttttaaaatcacattgcatttcctaacgctcaacaaaatctctctctactaatatctctctctctctctctctattgttgaagaagactcataatcggagattgtttgtttttggtttgctctgtaaattggagaagttttgttagagatcaa

SEQ ID NO: 4124 - DNA, 1000 bp, Arabidopsis thaliana
  misc_feature (1)..(1000): Ceres Promoter PT0695
aacattttctttaacttactcttaaattttaatagtaagttgatgcatgttatgttgatccgtcttgatcacaaatattgttttatggacgaattctttgacagtaaatggctatagtgactcagcttggagcatcccgatatgaaaacaaagtgcagtattgtgtcgtggtcatcactaacgcactttcctagaactatcgcgcgtgtttgacctatgcaacacaccagatgtcatgaacgtatacttaaatagaaacaatgatatagacaattggctatattctgtcatggaacgcaaaccggataacatgtctattagattcatcggacttgatcatggttatgtcttaatagacgaattctttgttaacgattggttaaaacggctcacgttagagcatcctactatgacttcaaaattgataaatattacatggaaatcactttaattttagttagaaggtagttaatttagatattcttatttaataaattaaaaaatagaagaaaaaaagatgagaagagtttttgtttataaaataagaaatatcttttattgtaattttaaaattaaacaaatttaatttatattaaaattatctttgttttattgttaaggcaataattatttttttggtgggaattgttaaaacaataattagtatactgttaagtggtcctttaataataagataacgtgatttaaaaaagaacgagacaggctaatatagtagagaggaaaaaatacaatttaggcccaataaagcccaatatagagttgtgctcaaacacaggtcttcgccagatttcctatgacgccgtgtgtcaatcatgacgccaagtgtcattcaagaccgtcacgtggcgttgtttctacacataggcgatccatacaaatcagtaacaaacacgaaaagagcattcatatgtacgaaagtagaaaagaagagactctttgtgataaaactaagtaagaaatagcataaaagtaaaaggga

SEQ ID NO: 4125 - DNA, 1000 bp, Arabidopsis thaliana
  misc_feature (1)..(1000): Ceres Promoter PT0708
gtttccaaaactagtattctttatttgctctattcattatatttttatatttgtaacgtcccgaccgtctttattaggtttcgacaatcacttctcggaaggtcgtccatcctgaaattactctatcctaaacatgtttaactataaaattctctcgaaacttttgtaacgtatataaccacataaattctcttaaacttatttgcatacaccattatatttctgaaatcgatatgttacaatattatttaatatttagattacttttactgaatcgaattaaatatcaaatcgaaacaaatctaatctaccaaaaataattttgttataaacatttcttgcctagttctacctcatatacattttagttaaagaaagaaatcacaacaattcccataattcaataattaaatccacaaaatcttggagtaagtaagagaaataaaaagatagtatcttaacataaacaattcaaagatgctctctcacacaattcacacacacttacaaaacaaaagacagaaacaatgttttcattcaaatcaaaagaagttataacactagtacaaaaaaagctcaaattctaatagtaactctttttatttcccaattacccaaagattctctctcacttcacaaaactagctttgagagtcgtgttccacaaaatccattaaagctgaaacggttttgctcaccattcaaacaaatacaaaattgcaaaaccccaaattataacaaaataatataaaaattaaaccgctaaaaagagtgaaccaacaaaaatcgccgaatgtgtgtgtaatgagaaaaccgacccatcatcccaatcatctcttcccgtgtcactctcttcctctcccacgtttcttctctcttccctttatgggttttaacttctccttcttcttcttcttcaatcttcagttttcaaattcaacaacaattcacattttgatttcttcatcatctctctctctctcgcttctctctcaaatcg

SEQ ID NO: 4126 - DNA, 1000 bp, Arabidopsis thaliana
  misc_feature (1)..(1000): Ceres Promoter PT0710
tagtgcgcgtggggagagggaatggtgaaaccttagtggttaagttatgaggaaaatgataaaaggataaaacaatcaaatgcagcttgaaacggccataacataaagtaccttatggtggtgcgaatatttttgtgtttctttcactcttttattgctgaaagctacgacacttgtcttaatatattgtttccgcaagtcacatgatctactttttatttaacgtctagaaacgccgagatatatgatgattagtatatcacgtctatgcaaattgttagttcgtgtttggccaaaagatatcgagacatgtctgaagaaccgagtctggttttgagatatttcttcaagcattactatacaatagaaaaaggagacacgcgaatatgataatagcaaaaggcataaaaaggcgaaaattaaagaaaaacgtaaagtgatttggcctcaatcaacgggaacgtatcttaattttagaggttcttcttttacttttgagacgagagagtttgcgtctttgcgagctgctttggttgactaaacattatcatattgaaaaccaaaatacaacggaggaatatttgtcacagtttcactttcacattgtttccttaacgtttaatcaaccttgttcaaaatttctatagttgtaatcatcattgtttacaaaattttcgttcaaagatgattttaaataaaattgtgaaagaaaaccttttctgaaataaggattggatgatagtgttaaaagaaaaatatgaactgaggcaaaaagaggagtggtccccggaagattgtgaaatgtgtcatctaaaccagccagacgtagtcacgtgttctctctagctttatgaacttccttagccagcaccatcattgtgattgtagtatatatgtaaccctaccttcatctctcccattttccattctccatatagactcctttacaatatacaaaacctatccaaaagcgaagaagccaagcaaacatattataaaa

SEQ ID NO: 4127 - DNA, 1002 bp, Arabidopsis thaliana
  misc_feature (1)..(1002): Ceres Promoter PT0723
gtcatatcttatcaacacgtcaacgatcaaaacctttagcctattaaattcaacggcttagatcaaaacgaaactaggtgggtcccacttttaatatcgtggctgcataacatttcctcgataactgaagccgttgtggtctttctcagaatctggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgttattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttrcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaa

SEQ ID NO: 4128 - DNA, 1001 bp, Arabidopsis thaliana
  misc_feature (1)..(1001): Ceres Promoter PT0740
tgtggccactaaagatttacccttaaccgggcccatataagcccacgtcaagtggcgcttatacgctctccgtaagagagccaacatttggtatgtaatgttgcaaattattcttcaagacaataaattcaaatataattcaatattgtccaaatatagtgatgtacttcagttgtgcacatagaaactccactaaaccaacttttagatagatgcattcacaaattttcaacaatgtcgcgaaagtctaatccatcaccagattctaacattttaattattatatttaactatacatactctaatcagcatgagtcaaacgtgtacaatagcccaagcatataataagaccaaagtcaaactcaaataaatgtctccaaactcaaaacttgaaaaagacctaattattacatggtagatatgactttgtcgacaagtaaaccaactaatcctcgaagctaccttctcttcccagttattatgtgtgatcgatttataaatctcttcttctaataacacctatatttttcttatgatgtgaataaatataaaacttttaactttaaaacatatttatccgaaatattgcacttagatttcaaatagataaataatagtactatctaactgatattgaaaagacctaacacggaaaacagttttataaaaaatcccaaatgtgggtaattatcttgatttcttgggggaaacagaaaatggattaagattaatcggagtcgtgtcaagcagctcgttaataactgtagcaagttgactgagtaagcatcaacgtgtcatctccgtaaagcccattatttctagtctcgccgcgtcttctcttccacgtagcacttcactttttctctccttttgtttcctttggaacacaaacgtttctatttataggaataattacgtcgtccgtatctgtgtcggaacatagatccaaattaaaagcgacttacttaattacatatcgttcgtgtttttttcttcaaaaa

SEQ ID NO: 4129 - DNA, 1024 bp, Arabidopsis thaliana
  misc_feature (1)..(1024): Ceres Promoter PT0743
tcgattggcccgatcggccccaaaatcaagctgagccgcttcaaacttcagcttttgaaatcacccccaaactcatgtcctcttatcattataactaaaggatctttcattttatttaactcatcgtcttgcactacccaacccaaaggttccaactatacccgaagctttctaaaggtccaaagactttttttttcgagccagactattcaagccaagaaaagccaaaccccacaagccagtacttttcaattccatattataaacttatctgtcttgttttagtcccactaaaaacaacagaatttaatttaggttgagctaaaacccttgacaaaagtgtatagtcgtcgattcagtagcacactcatcactcatcagatttgatagttgacctaaagtatgactactccatttcaactaacaaatgaaaataaaagagacctaagggttagaggattgaaactatactctcaagtcttttatcactaggctactaccagctagttaacttgatggatttaagcaagaaaacgtagaatttatattcgagcagattgtttagctaaaaaagcttgggtttgaaattgccttttctcccatataagcacgtcggttcctaaataactctttctagcggagagtgtctttccaataatttaataaaaatggtgtttgtatatcaaaaaaaaaagaaaaaagaaactgatcgagatagaacgtttgcagttttataaacaatttaaaaaacaaaaaaaattaaactcaatgtattttttattaattcacaaacaataataaatcataggatcgaatatttacacggtatcaaaacctactcgccgctactatataaaaattgaagtcaaatatcaaccgcaattattaaaccagcaagacaataattcataaacttaatataaacataaataaattaatgttacacaacgatatatggtgagggttattactatcttcttcctctcaaaacacatctcctaaccttaagctttagacggcctgc

SEQ ID NO: 4130 - DNA, 1000 bp, Arabidopsis thaliana
  misc_feature (1)..(1000): Ceres Promoter PT0758
agctagccacatcagtgaccaaaaaagataattaacaaaccaaataaaataacaaattttgatcatttggaataaaatttataaaaggaacgaaagcgccttctcacgggtcccatccattgaaatatattctctctttttgctctatataataataacgcgtactaatttgtagtatatattattacaaagtcgatatttgattgttttgtgaacgttgatatattaattttcttggatgatgacaaaaaaagtcatagaaagtaacgtgtgaacatagcattaacaaaatacaaacataatatataaccaaatatatgaaaataggataaaatctcattgaatagatcttcttctattcaaatatataaatatttgtttgtctataaaattaacagagcattcacattatctaaaataatagtaaaatcaaaataaaactaaataaaaataactctggttttataacgattgattttaaatattagtttttgttgtaaagagatcattatatatgtctgtaatatttttatactgagttacatgatatttagttattatagcgtaattaactaagataagaaattaactaaagtgatattctgattattattatttttgttaggacacgtacgtggaaaaactaaacactataggttacaaaacggtataataaactcaccattactggaaaatgtttgcatttgactcaataagtaacttattataagttactgatataatgcatagttttgaaattcttaaataaattattttggtttcgcatgaaaatatgaaaggagagaaatttattattgtcacttatatatatatacatcgtaatcattttttcgtgaataattctctctcccattccattatttctcagtatctctctttctttcccttactttattgttgcttttaaaccttcaatttgctcataaaccaaatatataatatcaaaacaaacaaacaaaaaatcagaattcccctaata

SEQ ID NO: 4131 - DNA, 921 bp, Arabidopsis thaliana
  misc_feature (1)..(921): Ceres Promoter PT0829
aaagttttgaattattgggaatcaatttcgaagttttgtaattctttgggggctaataggatattttattttcttggtttcgtctattgttgtttttctatttatggttgggcttttagaactctggacaggcccatgtcatatgttttcccttctccttatatttttcatttttcattttgttaaattaatgcataatatccaaaaacaatttaaatttttgaaggaaccctttagttacggctccgaagctttcacaagtgagaatgtgagatcaaagaaggcaaatggaggattttaaaagttaaaatcatcttttatctgcaaaagttgacaatttttttgtatcaaatctaaatcatcaaactctcttaaactacaagagcataacaacctctatgtaatccatgaaataatctgcttgaaggacataacataaatcattatggctagagtgactaacttcaatcaaatcctcttaactctagctcccttacaatggtatcgtaaaacattatgcattagggattgttgtcctaggaaaataaaataaaaatccccacagaccaactaccattttaacttaaaaataagcttcgtccgcgacgaattgttttccatcctaaaaatagaatggtgtaatctgctaatggtttagttccattaacttgcaagttctattgaaagcctaaatgtcaataaagatattaaaattcggagtcaaaagacaaatgaatcaaaagcaacaagacaagtcagctccattcttcactacccatcttttacaataaatcatctctcttttcacaaatttcaaactactctcattgccctttagctttgttatagagccaacactacagagagactcacacacttgtttcaataattaaatctgaatttggctcttcttataaacta

SEQ ID NO: 4132 - DNA, 763 bp, Arabidopsis thaliana
  misc_feature (1)..(763): Ceres Promoter PT0837
aactacaagggagacataatatcaccatctggttcctgttatcatctgaagatttcttgttttaccttccagtgataaaatgatccttataatacatatagatatattaaattgctgtattttaagattatagatatataaggtacatgagagtgtttatttaaaaaaattcacttggaattcatgttttgtgatacgttagattggaatccatttgggaaaagaagaatcatctgttcttatgtctcaaattttgacttcattcacttttcttcttgtcttttaagaaagcttccacaatctaactgttcgatgtgaaaactgagattcgagtaagaaaatgtgaactgtgttatactgttttttaattagataatttagattgcactcagataaattaataacattcctcgaatacttttatgtgattggatatattaggtatatctgccaaccaaccaataaactgctatgtttaaacaaattaaataaattagtatatgtttactcaagaataaagaagatagaaaagaaaattctatatgagctaaatttgctggaggaggcatcggacgtgggtaccagacctttccaagcacacgagtagtgcttagccatgtcatgctaacatacaccatttggttcatacaaaatccaaatcaaaatctatttttaaaatcttttgcacacgtctttgaaaaacacctctcatactatagctacggaagcttcaatttcaaggtttgtctaaaagctaacgatt

SEQ ID NO: 4133 - DNA, 751 bp, Arabidopsis thaliana
  misc_feature (1)..(751): Ceres Promoter PT0838
atactggtatgcttaaggttgaagccaagatctctgtcttacccaagtaaccactttctattagaagggatcaacactaagaatatggagatttaagcctaagggctaaggcggttctcaacaatacatgatgtgaatacaatcacagacgatttactgaggtttgttgataagatcttgatcagtctctgcatcatctgttcaacaatctcaatctttgactgtttgctttcggagccataaacagaggaatcccttattccctgttataggagcaatacaccaagtattatttccatggctgaaattctcttatggaaacctaattgttccattgaagctgtaaaatcgaatctggtgaatattctcgagcaaagccgcatgctaattatgtcaattcagaagagtttgattaggagactcgaagcgagtttgatgatctttcttgatgttcaactccgattgtaagggtataattgacttttcatgtattacggctccaccacctgacactaaggcactctttgtccatctcgttggtatcatcggattcggatggtaaaaataaaaagagcagaggaaacttgttactcatgcaagcttctcaggtgccacgtcactccattacgtgtcatcttcacacaccatctcgctcaaaaccgatctcatttttcaaaccttaaaggcagaagcaactgattaagttaacactcttgagaagctctcgattaagcttgaacttggaggatca

SEQ ID NO: 4134 - DNA, 669 bp, Arabidopsis thaliana
  misc_feature (1)..(669): Ceres Promoter PT0848
tctctttaaatcagttaactaaccgtttatatatttacgataaggtttgaagagattattgataaaataatacatttcataatcccgcgttcaaccgtttaaagtaacatttaagttgactatatctaattttttttccattaaatatggagctggtaaactttatcaacttctaaaaagtgtaacaacaaaaattaggtcaatcacaattctgttttttttattattttggattgacttccaattgcaaatagtcttagtgatcaccattatcatacatatatacatcaagtaggtttcatcatgatataccacaaagtatttgacaagccatatggttttggatcaaaaagtcggtccaaaattaatgttttatgtgcaagaaccgacccattgtacacacgtgttaacatcttcaagactttcatctctatttttcttttggtcattaagatacccattgatccgaatctgttacattcccacctacttttttaatttttactatccactccaaattaaacacaaccgatgattttaataattggaagcttttaaaaatatttcaaaacaagcctctttgtgtttgtctatatatatacacgtaataagaaggtgaatgaatctcacagcttacttgttctaaggcttccaataacgaaaacagta

SEQ ID NO: 4135 - DNA, 702 bp, Arabidopsis thaliana
  misc_feature (1)..(702): Ceres Promoter PT0863
cgggaaacgacaatctgatctctagtccagtcgattggcccgatcggccgattataaacttacatgagacaagtataaataattattataaacttattaagtttaagatcaaggcttttgtgcaatgtatcaatgaatgttagatgtgatatgatgaaagcaatgttttaaacacatacatagtcattgatcggaatgtgtgttattagaaatgcatgcctaagccgatagggttatctatgtttggtcttggacattatagccaaatttcgaatctaattcttccaatatatatttttttttttttgcttagggccactactagtattgcttatcaattttaagagctcatgaaaatgcaacaatatagtagttgcaaatccttgtttcaagagaaatcaaagggccacttgtgaattgaataataataatatttgcaaataacctttcactaaaccataccaacaaaaccacacagatttggcaaagacataacctttgggagacgtgaaaaggctcaaaatttgacaattgtccttacaaattcgctcattagtgcaattgtgagatttgtttgcatccaaatccaattcataactcacactcgtctcaaattcgaaaaggcctgcagggccagtgcactgggatccaacaatgtcctccgactcgtccaagatcaagaggaagcggaaccgcaccgcg

SEQ ID NO: 4136 - DNA, 435 bp, Arabidopsis thaliana
  misc_feature (1)..(435): Ceres Promoter PT0879
ttctaggaagactggtcaagctaagctgtttctgttttttgtttttgtactttactttttgtttgctagtgggaactgggtttattgggccttgaagttgataaaagatgaataaaagacatatcgcctaaagcccatatgagaagcagaagacaaaaacctccaactttgggcataaattttgattatagttaaaagtccagacccaatttggcacctggcttagttacgattctaaggcatgacacctgcctaatatgtttattacagaaaataaagagaatcagctaggtgtcccttattgaacacattaacaaactccaacgacactacgtgtcttcgtgactcttactatatccaaaaacctatagctaaagctgaattttccatgattagtatagtcccaaccaaaaaaatactgaagaaggcataagc

SEQ ID NO: 4137 - DNA, 397 bp, Arabidopsis thaliana
  misc_feature (1)..(397): Ceres Promoter PT0886
agtgtatttgaaaacgacattgaagaattaatatatttttttttaattttagttttttatagtacaaatattaaaacaaacaatcctaccatatcataacatttgtaaataacattttaagttttgttttgagttttaattaattttctatgacaaaaaaatgaagtcaatagactaagtgaatcatatagtataaataaacacaatttaaatagtttcaaataaatttagaaagaataaaacaaatagaaatcagaaggtgtctgtttcctcctcgcaacatacgatcaaagagaaacaacttgaccctttacattgctcaagagctcatctcttccctctacaaaaatggccgcacgtctccaaccttctcccaactccttcttccgccatcatc

SEQ ID NO: 4138 - DNA, 1024 bp, Arabidopsis thaliana
  misc_feature (1)..(1024): Ceres Promoter YP0007
agcagaacaactatatttattgtgtcacataaatctgagatcatttataaccaccaaagaacctatacacagtaaatgacaaatgtatctccctctatctctattgcccatatgtagatgctaaagtaagatttctcttttttttaatgtacttttttttgtataaagtatattccataagaaaaaggaaaagcttgtttatggatcaattgaccccaaaaaaagtttttagatcaaagcccaatataaaaaaaaaacacagtagtgacacaaaggaacttaaataaaccatgaattgatctataaacagtagagatcgataaggcgaacattttccatgtgaagtgtcttctttcatctataatatttttgacatccaataatttcctctataatatcattcacataattgatagaaacattatgttagaattgtccacatcatttgagctgtaatatattctgttttaacaaattatatggtagttgcttaatcttatgtccatcttcttctatgcatcgttttcgcgcctagttgtccagtccatttcaactacctacctctaattcttatcttaaaacaacattttttaatttaagtattatgctcaaagactaactagatagaaaaccgttattaaacattaaacgaattaaaagtcttacatggaaaatgtaggtttataaaccacgagttatgattgacaataaaaaaaatgcaaatcatcaatcaaaagagacttgagtgcgactctatatcaaccattgcaattaaaattatctatcacaaaaattttagacagattaagttaatttagtctaaattcactaatttattttctataattagtaattaactatatttatttatttacacattttctgataatttagaaatttgcatgaataacaaatataagattttggaaattagtagcaaatttaattaataattatttttgcctaaatgaaccaaactataaaacctccacatacaccagtcatcaaatttacagagacaaca

SEQ ID NO: 4139 - DNA, 1000 bp, Arabidopsis thaliana
  misc_feature (1)..(1000): Ceres Promoter YP0008
ctcgagagatgaagtcttagtaatgtttgaacaaacaataatcacgttttccatcaaattcgagcatttaaagtttatattactacatgccccaagatgataccgtccatctcatccgaaaatatttctgaaattgcgctaagacaacaatgtttgctcaaattcgatcatttaaagtttacaaatctctcatcaatcttacaaacttctcacactaaacagaggtacatattttcttataaagacaaaaggttcgaacagctggcttctcaactcgagttgtttgtcagggcctctcttcactaactacaagttggtacttcaaatattggtggctagcttcacgtgatattgtctacaaattaaacccatgaaaaagctgcattaattgttccaagtgaaccctgaggagtgtcaatagtctttgctttagtgtgatcattaaaccaaatctctaaattcctaatttgtactaacatttggaacgtatttcctactcttctccctgctccaactcccaaaaataagattagttagatttctataactaatatacatgtatactcccaaaaacagtaaaaccatattaataaagctaattttgcatagatttatttcggtaaaccggcggttcaagttggggaaaaaaaagacaaacggtctaaagtcatccaaagacaaaaaaccaaagacaagttgagagagacgagaccaatcacaacattgcttcgtagattgcgtgacatcatccttgacggctactttcatttgtgtcttatttggataaaacgcacgtgtttaattcacgaaccttcatagcaataagaaatttccattactttcatattttcaactttttttattacccattacatgcttaaaatattaattcacaagtctttgtcaaaattcaatattttccaggttcatgaaccctttttatctcaatctactctataatatctccctataaattacaacaaaacctctttatttttca

SEQ ID NO: 4140 - DNA, 999 bp, Arabidopsis thaliana
  misc_feature (1)..(999): Ceres Promoter YP0019
gatataagtagaatcattttttgccgccgtttctcgctaacacaccgaaaactgaatcaaatctcctagctcttctacgcaaaatcgagtgcatcgacaatggcggaacgtggtgtcgaacgtggtggagatcgcggcgatttcggacgtggattcggtggtcgcggcggtggaagaggtggtccgagaggtcgtggtcgccgtgcaggtcgtgctccagaggaggagaaatgggtgccagtgactaagcttggtcgtctcgtaaaggaaggtaagatcacaaagattgagcagatctacctccattctctcccagtcaaggagtaccagatcatagatttactcgtcggtccttcattgaaagacgaagtgatgaaaatcatgccggttcaaaaacaaaccagagccggtcagagaacgagattcaaggccttcatcgtcgtcggagatagtaacggtcacgtcggattaggagtcaaatgctccaaggaagttgcgacggcgatcagaggcgcgatcattctcgcgaaattgtctgtggttccgatacgaagaggttattggggtaacaagattggaaaaccacatacggttccgtgtaaggtaaccgggaaatgtggatctgttactgtacgtatggttccagctccgagaggttctggtattgtggcggctagagttcctaagaaggttcttcaattcgctggaattgatgatgtctttacttcttctagaggatccaccaaaactcttggaaacttcgtcaaggtatgtactttcacaatggctgttttggtttgatgaactctgaattaggcagtgaaaaagtaatcattaccagttaagtgaatttatattgaagattaggatttagctgattgtattggtttgagcatgtgagtttgtgtttaagattgcttgaattgaaatgctttaggttgtttgattacgctaaattctgactaatgtaattcaaattgttgttgtttttttttggtc

SEQ ID NO: 4141 - DNA, 1024 bp, Arabidopsis thaliana
  misc_feature (1)..(1024): Ceres Promoter YP0028
gtcagtgaagtcgattggtagtacttgaaacacttggttggtttcatgtatttggcctatatataaacaaacatcgtaattatatacggatttttttcggaattttacgccatatctgtaagtatatataacatgcatgtcgttttcaaattcatatgatgaacgatccacgtaagtgctactactcctacaatattgcatgagagagatatgtatttataaattttattttgaagaagaaataagagggaaggttacttgggtggatcgatgtgaaaacaaaagaagaaaaagcgaaacccactaagccattacatgatatcgaccttcttatctttttcctctttattttatttttctcatcttctttttgtcaggacttttttctacttaatgaaacctccaaactatctaactaatacactcccatgtagaataaagaaaattatataagatattgttgatattttgtaactagaaaatatatttgctctgtaatttttcgtaagttaaatcaacattttaaagtagaaacaaatattactgcaaaaagtaggatcattatttttgtccaaaatctcagttagctatagggttgtagtaaaaacaaaacacattcttgatttgccccaaaaaataaagagagagaagaatattgttcaaaagtggtctcttctctctctaattatgttttcactaaacccaattagattcaaacagtctacaaagtccaaaagataaacatgggacaacaattcgatgcaaaaaatcctcttttcatgctctttttttattctctagtcttttaaattactaataaaaactcacaaatccaccaaacccattctctacaactcaccttcatctagatttacccactcccaccgagaaacacaagaaaaaaaatatacatatataaatatacaagacaacacatgatgctgatgcaatatacacaacaaagtattaaatcttagatattgtgggtctccctttcttctattcattttcttattcattaaaa

SEQ ID NO: 4142 - DNA, 1024 bp, Arabidopsis thaliana
  misc_feature (1)..(1024): Ceres Promoter YP0039
ccgttcgagtatttgaaaatttcgggtacacccgcctaaataggcggaccttatctagtatatatatacatttgaactatattgtttactttttagttgatttaggctatgtcatgacattgacataaatctacctgttatttatcacgtgtaattcgtgtaaagtgtaaactagaaagttcaaatacgtatttgtttttgttctgttatataggattgtcatagttgtaaatctacaatttattacaacatgaataagtacacaagcaatgtaattggatttaattgctaaactctttacatggtcaatctaaatttgataagaaatacgtcacatattactaagactgatagtttttttgttgtcaccaattatttttgttaaattgacgaaaacaattccaaaaactcaaatgtacaaaatcatacagtctcacaaacatctcatagagaaagatataaatctcccatatgggaacgataacacgaggtcgaaatactattcgtaaaactaaaacgccttagttataaatcgttagttgtaaccgcggtcgagaatacatacagatccacgaaactactactacacatgctgctgaattggaatttggaaaagaccatcttctttaggaagagctcacccaatgagtgacaaaggtgtcggtggcttgttttctacccatatgtatacatcaaatggtagtttcattaacgtttggttttgagaaaagtaagactttggctagtagctaggttcgtatataataaactcttttgagaaagttcatcactggtggaaaatgttaaaccggttttttctcattttttccgccatgttaaccaccggtttaaaaagaccgtaacacattgaaagattaataagggtatatttgtaattacggtttgctggcaatttttaattattattttaattagagaaaatagagaagccctatcaatgtacatggtatatatataaaaggcaaaaccctagaaaacgatactattcgactcagccgtcctt

SEQ ID NO: 4143 - DNA, 1024 bp, Arabidopsis thaliana
  misc_feature (1)..(1024): Ceres Promoter YP0050
aatctgatctctagtccagtcgattggtacttgagggaaacatcatatttttaaaccttgtctcagtaagctaacacacaccccttgtgattacttatccatgtttatccacaagaatgcagttggattgagatattttcttctttgttgaaatcaggcctcaaggtgttcatgtggtctgcaaaaaaattcccaaaaataaagatagtgacatctgaaatcgataatggattagacgaagagtttcgtgttattccttggtatgggcgggtttggggacagatattttggcacagacgaggactaggccactgtggtcctgcagcattaggtgtcccttccatgtcctgcattacattttattgatggattcatcaccctatctactacaacggctacacaaactatgaagagttttgtttactaataaatgcccaagtgaggggtcgatcgaacccgggacacgtttttcagtttaccatatagaattatccttggaacccttgatactccatagaacatcaccacctctgttgtcatctcaggaatccaggttcaaacctagtctctctctccctagtgggaggtatatggccactgggccaatgatgacaaaatgcaaaaaaaataaaatacatttgggttcattatctaaaatatctcttgtgtttgtaagttttggttgcacactcgtgtggttgaagtgtgtgtgagaggtactatacaatacactctgcttttgttttgtacctatctctttctcttctccacatatccaagactttggggataaagctgagatcattggttgccatttggttgtgtagaagcaatcacccatttgctttatccgaggttgataaatttcctcgggttctccttctgacacgtatgacaaattctaatagtatattcctcgtagatattacctatatattctcaatagttgcaggtacttaaggctttgtcttggcatcctcgtcctcttcagcaaaactcgtctctcttgcactccaaaaagcaa

SEQ ID NO: 4144 - DNA, 999 bp, Arabidopsis thaliana
  misc_feature (1)..(999): Ceres Promoter YP0086
cttatcctttaacaatgaacaggtttttagaggtagcttgatgattcctgcacatgtgatcttggcttcaggcttaattttccaggtaaagcattatgagatactcttatatctcttacatacttttgagataatgcacaagaacttcataactatatgctttagtttctgcatttgacactgccaaattcattaatctctaatatctttgttgttgatctttggtagacatgggtactagaaaaagcaaactacaccaaggtaaaatacttttgtacaaacataaactcgttatcacggaacatcaatggagtgtatatctaacggagtgtagaaacatttgattattgcaggaagctatctcaggatattatcggtttatatggaatctcttctacgcagagtatctgttattccccttcctctagctttcaatttcatggtgaggatatgcagttttctttgtatatcattcttcttcttctttgtagcttggagtcaaaatcggttccttcatgtacatacatcaaggatatgtccttctgaatttttatatcttgcaataaaaatgcttgtaccaattgaaacaccagctttttgagttctatgatcactgacttggttctaaccaaaaaaaaaaaaatgtttaatttacatatctaaaagtaggtttagggaaacctaaacagtaaaatatttgtatattattcgaatttcactcatcataaaaacttaaattgcaccataaaattttgttttactattaatgatgtaatttgtgtaacttaagataaaaataatattccgtaagttaaccggctaaaaccacgtataaaccagggaacctgttaaaccggttctttactggataaagaaatgaaagcccatgtagacagctccattagagcccaaaccctaaatttctcatctatataaaaggagtgacattagggtttttgttcgtcctcttaaagcttctcgttttctctgccgtctctc

SEQ ID NO: 4145 - DNA, 1024 bp, Arabidopsis thaliana
  misc_feature (1)..(1024): Ceres Promoter YP0088
tcgattgggattactacttcatctagtaaggttctgaaaacgtttgttgttgataaggaagattcgtctcaggttattactgttgatcttcaaggtttgtgattgtgacgcttatacatgtgctgaaactgtggtgtttatttattgaaaacaaaaaaaaagtctctcttgtagtttcattgtactaaatagaaaacaagaaacgtttttttctttaatcttctacattgataatattggatcaaaggattgtttctgcaagacacaacacaaacatacttatactagtttacttctactaagtactaactacatacccatacacacacttgcacctagactttacttctagacatcattaccctaaggtagaaccaagcttacaagcaagttttaccgacaactcttacattacaactctagtctgtagtctttaacgtagacttactaactagtcattagtggtttaattttttaaattttcatccatatgtttttgttgtagatataaactaaagtcggtcacatttaataattgtcattatgtccgcgtaaaagtcaattcagctattggacatttatgaaatgtaagattttctctctcatttccccgtgcgtgaagacatgcattggtttttctgtaataatcaacaaatccaaaccccttttcgatctttatttggacattgttagagacaaaatttctctatagtctttttcctaatttgataccatgtttttgtttctgcacaaatttactcactggtttaactaactatccacttatttatgattttaccattaggcgtcagctagccctagtcaaatttgtaaacaagccaagctatctacataaatcgagatgtcattaacgttaatcgtcgttaattcgaatttgaaaacatagatagctttagcagtacaatgggcaatggtaagaagaatagcaaaaggcccaatatttggtttgcagaaattaaagccttaaaaaaaagcccacagatatttgtcaaagaaccctaat

SEQ ID NO: 4146 - DNA, 1024 bp, Arabidopsis thaliana
  misc_feature (1)..(1024): Ceres Promoter YP0092
aaagattgagttgagagagatggtggagacgcagaacagacaaagggagtttaccatatagtgctctaaagggcaatgagattgcagtgatgtggctatccggggaatcatcgcaggttattccttcccatgagcaacaatcaatggatgggttccaattcagaggagaaacagaagaagaaacgtttccagagaaccacagtagggattctcgatcttgcgagttgcagagagcctctgaaactgcaatagaaaggacactgatgaaaagaacacactgaaggagtatgccaatcatgtgaaaactcagagcttgtattggtcttgtggttgatgaagttctcacaaaacctttggctttgaatctcccctcattagtcatggtgagaacaagaacaagacgagaaacagacaaagaagatgaaaaaacttgttggccagtgttgactaagggggaatagccccagacataacaaaattagacttgtcgtacatctttaatatttttttatctgtttctttgtcctgacgctttcattattcctgtgatcaattttctcataccattggtccatcgttaatcctttcttaatttcattttctacgtaacatgagaggagaccaagtcctatgagaacagttgacgtaacagtggttgttaagttaagttaaaaagaggaagctagtgagagtgaccgttaggtagagaagtgagatctttaaccactcttctttctctctctctctgcttttttcgtcgtctttcacatctactgttcgcaaactctcttatgcttccaataatggtgataccaattgagacttgcaggagaatctcctcttctccacactctatcaactggtcagccatggaatggtcgtttcagtttcaatattcctggattctttttaaggattcctgtttctcttctgttcctggtatattcttaacgacgaaattagtatcggatcctggtaatacattttgaagcttttaagtaccattgcactgggatccaacaat

SEQ ID NO: 4147 - DNA, 1020 bp, Arabidopsis thaliana
  misc_feature (1)..(1020): Ceres Promoter YP0096
gaggtcagtgagtcgattggtgcaaaattgaaaaattgaagggtgaaacaaatttaaagataatatctattaaatcctctaattttaaaaatttagcaaaaattgtattttcttatggatctgttagttcacacgtatcttaattagtaccaaatcatatctaatgattagtgataaaactagttagatatctatatgtgtctttaccatttaacttgaatccttcttcttttttttacgtaaacaacttgaatccttcgttaatacataaatttaaagcattttttctttaattctattgatcggtatatatttactataagttttagctcatatgcaatttcaaatgatatgcttttaaattttgtctaggtgtgatagttgtatctttaacataaatcttatagcaaaattatacttgatattctaaatttatctatttgctcttgtgaacctcatattagtctagagaaactttgaaatcctttcaattagttgtatgtccaatacatttttactaacatttattagtctttttaattaagattattgttagaaaaaaaaagattttttaaaaataaataatatgttttagatacaatgtgagttaggcttcttatattttaaaaaataaatttatttcatacttaaaaatagtttggaatttcaatttatttggctgaataccataaaatatgtcaatttgaaccttatacccattgactatttggtgttagaaaccctttaacaaaaaaaaactatttggtgttagatatcaaaataaaaaaagtttaaccattggtttcttatattgaattggatattgttacatgtattaaagtttttttggtttaattttgaaacgttgatagaaactattaagtttaagtttggtagtatatttatttgtggaaaatttaattgccattaaatataacgtcaactttttttggttttttttgagaagttacgttgtgattttgatttcctatataaaagttagattacgtcattttttaa

SEQ ID NO: 4148 - DNA, 1000 bp, Arabidopsis thaliana
  misc_feature (1)..(1000): Ceres Promoter YP0097
ttcatctttatatttaagagtttaaaaactgcaacttttgtttttctttcactaagtcttatggccacagttaattaaaagcagatgaaaggtggtccaatggaaaaggagaatgtgattgggctagttgggagagttctgatgtctagtgttgggtacacgtgtccgtcagttacacatagcattaaatcagacggcatgtcattattcaaatctagttcacatagtacgactaatagctgataaattaatgattatacagcatatgaattatgaattcaaaaaaaaaaaaaaattgaaaatgttaaggagatgctatattttacaaaattcatcgcaatgctttctactaatttgctaagtggtcttctccagttagtcttgtcgattccaagcgatattattaaatcttgaagcatcgctcaaagcattatagcttaagataaccaaattgttattaaaaacacctagtgaaatttttaaattaaaacaattttgatatctttgtaatatctaatactactctttctgtgtctaaaaggattaattttcaaaaatttcacacatattaaaaaaaaaaaaaaattactagctaaacaattttcaataatcataaaacaatagtaacttaataatttttttttattttcaaaatagtccttcaagtttacaattcattttagtattataatcaacaaaatttgtattaaaaagttggaaaattaatctttgtggaacaaaaaaatctagaaatcattttttagaattagagagaggtttgataaaaaaaaataaaaaaaaatagagagaggtagtacatactaaacgatgtgatactactattgacaaaatcttaattctcagtttagtagaataaactagaaggaatgaatgaagtaaatgcgaatccaactactaacaaaccctacttagtcatcatattttcccatatgaaatccctatataaacccatcatcatctcccacttttttcatatcca

SEQ ID NO: 4149 - DNA, 1004 bp, Arabidopsis thaliana
  misc_feature (1)..(1004): Ceres Promoter YP0101
ttctcgttctctagaatattgctggaccggattaggtcaatattattgggccagattagatattgaattgtcgacgttgcttacgttacgttatatcttgtttaagaattaaacctatcgacttagtcttaattaagaaaacattgccttaaattctctggtctgcgaccgtttttttgaccgttaacccctaattaaagaaacaaaataattatagaaagagcactgaaatgtgattattttaacagtactcttatgagaaaattcgtactttttagttttttttttgtacaaatctctaagaaaaacactactactaattaagaaacgtttcaaacaattttattttcgttggctcataatctttctttctcggtccgggactaaccgttggcaaaaaaaaaaaaaaagttgacaataattattaaagcgtaaatcatacctctcaaataaaaacttgaatttggaaacaaagacaactaaaaaactcgaatttaagagaattcctaaaatcaagtgaagtatcatcacttggtaaaatttcataaccgttggcttctatttctatgtgtgccttggtttgcaggagataatatttcatttccaaccaatgatattcgtacacatagtcaaacaaatgtttgtctttgttattatattgagaaagaaacaagaaagagagagagagatagataagacgaaggaagtgaagcttccaagcgcccaccgttaaaaatctcgtgtgcaagtttcaaatacaagtggccggtggtctccataatttgatcgtcatccaattaaaaaggaagaaaaagcgtgttttatacaagaaaactcattaaaatagcaagtctagaaatatctcaacactaatctaccacgtctattacacacacacacacacacacttgatcttaatttattttcaagattcaagaaaatacccattccattaccacaacttgaccacacgcctatatataaaacataaaagccctttcccc

SEQ ID NO: 4150 - DNA, 1000 bp, Arabidopsis thaliana
  misc_feature (1)..(1000): Ceres Promoter YP0102
atttggttgataacgttttcactcgactaattatatacttcagaaggatagtaatagaataccaaaataattaaatgattggttagtgccttagtggagactttttaaccgattctaatagactaatgatgtagctaagcatttatttgggatcatcactgtttgaaaacgtgaaatgtgataaaagttatgaaacgattaaaatataaaataaccgtacaaaacattatgtaccgtttttttctctgttcttttggcgatttggtttagttcgttacactctaaatgttattgcagatatatatataatgatgcatttgcatctgaggaacatataattccggttaacacttccaaatcttatatccgtctaggtagggattttataaatcatttgtgtcatcatgcgttatgcttgtcggctttgaccataacgcagagatatagaactagcttttacttaacttttagatttattatttgatctagagttaagtggagatatatagtgtttttgttagattattggtggatgtgagagtttgtctttagtttcaagttgagaatataaggcaagaggagactctgaggcaatcagaggttttgattggcaaaatatccaaaaggcccaaaccaagtcgaagcccatctcgtacaaaaaaagaaagagatctgtaagaaaaaatattctttgatattcttacaaaaataagtgtaaaacttttattagtcaaaatcttcaatctttaaaaactctcatcactcctacgaaagcgcgtgagagttatgagacattccttaatagcattactcacaagtcacaagttcaaaacgtctgactgaaacagaaacaagcctttgttgaagtcttgaagaagagacattagtactcgtcgtatagccataaaaggtaatatacgaaatttcttcgctaatctcttcaccttcctctacgcgtttcactttcactttataaatccaaatctcccttcgaaaacat

SEQ ID NO: 4151 - DNA, 1004 bp, Arabidopsis thaliana
  misc_feature (1)..(1004): Ceres Promoter YP0103
gttttgaagaacaatctggatcgaaatctaacataaggtcatcgtattcaagttacgcagtcaaggacttgacatcatcctactctggtctgaggttaccacttccaaagatgggatttttcgactcggtatgcttcctaagaaattcgttttattgaacctagcaaatatcttgtaatgtaagattcctgagatgatgaagaaaaaacaaacttttgttacagcaggagaacggagagaaagaaaacagagaaccaaatgctcttgaagcaaacagaagaagaagacacaaatccaaacttgagacttcttctacaccagaaaaccgcagcattctgggacaacgcaaaacacgaaagtgaaacgggcaatgatatatatgtcttgggtgcgttacaaggcatcgtttgcaactgttgagttggataagtcaactgtcttcttttcctttggttgtagtagctgccttttttttcctttgttgctttaagaaatagcccgaaaaaaagaatgttctacatttcggagcagaaaactaaccgaatgagtttttggtcggatcatcggatcgatcagatatattttgagttacgaactgttataaaaaaagccataattttgtgttgagtttgcaaaataccttataacttgttatttgagattgcacctccatatatattaattcgtaagagtatttattaagtaagctttagtataaatccttttttcctttaaagtaagttaatgttctactaaataatagtaaagttgaagaaccgctccgtttttacaccatgcacgtgttatctaacaaagaaaatatggtacacctaatggctaatgcaaaggacaacacaatgaaactaacttgactctgtgttatagaaacccatagacatctgcatacatcctagtatttgtataaattggactcaaattcctgaggacaatcatagcaaacaatcacatcatcgcaatatacataaacaaaagaggaagaaaaa

SEQ ID NO: 4152 - DNA, 1003 bp, Arabidopsis thaliana
  misc_feature (1)..(1003): Ceres Promoter YP0107
taacaatccttgggaacattgcatccatagatatccggttaagatcgatctttgaactcataaaaactagtagattggttggttggtttccatgtaccagaaggcttaccctattagttgaaagttgaaactttgttccctactcaattcctagttgtgtaaatgtatgtatatgtaatgtgtataaaacgtagtacttaaatgactaggagtggttcttgagaccgatgagagatgggagcagaactaaagatgatgacataattaagaacgaatttgaaaggctcttaggtttgaatcctattcgagaatgtttttgtcaaagatagtggcgattttgaaccaaagaaaacatttaaaaaatcagtatccggttacgttcatgcaaatagaaagtggtctaggatctgattgtaattttagacttaaagagtctcttaagattcaatcctggctgtgtacaaaactacaaataatctattttagactatttgggccttaactaaacttccactccattatttactgaggttagagaatagacttgcgaataaacacattccccgagaaatactcatgatcccataattagtcggagggtatgccaatcagatctaagaacacacattccctcaaattttaatgcacatgtaatcatagtttagcacaattcaaaaataatgtagtattaaagacagaaatttgtagacttttttttggcgttaaaagaagactaagtttatacgtacattttattttaagtggaaaaccgaaattttccatcgaaatatatgaatttagtatatatatttctgcaatgtactattttgctattttggcaactttcagtggactactactttattacaatgtgtatggatgcatgagtttgagtatacacatgtctaaatgcatgctttgtaaaacgtaacggaccacaaaagaggatccatacaaatacatctcatagcttcctccattattttccgacacaaacagagca

SEQ ID NO: 4153 - DNA, 1024 bp, Arabidopsis thaliana
  misc_feature (1)..(1024): Ceres Promoter YP0110
gggatgcggttccgcttcctcttgatcttggacgagtcggaggacattgttggatcccagtgcaatggtaatataaaacaagaaaacaagagattttataggacaatcactaaatgacatttaattgattaaacatttattcattaataattgtatgttactaacttcaacatttaataattttgtttaagatacgtttacatcagagactattaatatttttacaggttgtaactttaaactttgtcttgaatcgaacatgactatagattttgggcaaacttaaagataacaacatttccgttttttttcaaattattacaaatcaaactgatatattagacacaacacgattacacgtaatgaaaaaagaaaaagataaaaagataaaagaagggatcgattctgtttggtctggtttagtgagattcaaagttaagctcttcctttcaagacatgccttcttaaaccgggaatgtgaacgtttgtaatgtagtccgtccagttaatgcttccaacatcaaatccaaattctctcttctcgtcctctgacatattctccattaatctctggggtattgctgttatcaaatctgtaaaagaaaccaaaaaaaaaagatgaaaactttgcgggtaccggttttgtctgctctaagaattagaatgttaatgagttctgtcttaccttccaccatagaaagtgtatggctcataaatagtagcaaggtgtttggcttgttcaacagatttcttgcatataaactttagcttctgcatcatcttactatccactgaactcataccactcatcaacccactccgttcttgagcatctctccacaaatgatccgagaaatcatcaacggaattgaaaagtttcatcaaacgcaccataataggatcacctttagagtccatgcatggagatgttttgtagtggttataaagaagctccgctaagtcttcgaaaaccagcgggtttatcgccgaagaagcgatctgatacacgtttatttcaggttcc

SEQ ID NO: 4154 - DNA, 1024 bp, Arabidopsis thaliana
  misc_feature (1)..(1024): Ceres Promoter YP0111
cgattggatttagtctatacattatagggcgcaagtttgtggatttaagaattatataaaaacttgaaatatatagtttttatgcattctcctcttgtgtaatacataaaccaaatatgagataggttaatctgtatttcagataatattaaattccaaacaatatttttacttgttataagaaggcaattaatatctctctgttaatggcaagtggtaccaagtagtattaaactattaatgcaatggaagagtactgttggaaattataatcctctatcacacattcaaacagatctcctgaaatcttctcttccaaacttgtacttctctgatccaaatgtaggctccaaaatatagacatttaccatttactaagtccacaactcctttcttgtctccttcaaaaatgactcttgtgtaaccaccatatgactccgacagttcggcattgccatgatgagagcttaaaaattcaccttcctgagcatttcaagtcttcactcccttagcttgacctgaaccaagataaaatgcctttgtcgtcccgtaatatccatcctgctttggacggcatcatagttacattcgatccatcctatttacaatgttattttagtattaaaaacatgacaataaatttgttgttaaacatattcaaatacaatatgattggatttataagtaattgtaatatgaaatgtccttagtaatatgttaaaaaatacatagatacacacacgtactaaaagaggcaacgcgggagatgtcattagaggaagaactaggaagcagagcgttcatgcaaaatgctaccaaaaacgttaatgcaatatctcaactaatcagcacagtccatttcatactgagaatgtaaaaaccaatcagcatcgtccattttttcatctaattatttgttaactcttaattggccacaacttccaaccacatgacgctctttctattccctttatatattcccatctcaaatgttcttggagacacaaaatatcataaacatata

SEQ ID NO: 4155 - DNA, 996 bp, Arabidopsis thaliana
  misc_feature (1)..(996): Ceres Promoter YP0115
gtcgattggatgatgaacattctacatatataattattatgtttaagcacttagacagcataaattctttctaattatataaatctaaccttgttacattgtacatctataaattacttgaagaaataacgagttctatttctttttaaaaattaaaaatactataccatatctcagtgattaagttgaaccaaaaggtacggaggagaaacaagcatttgattcttccttattttattttattcatctctcactaatgatggtggagaaaaaaagaaaatacctaacaaacaaatatatattgtcatacaaaaatatttctatatttttagttaattagtttatattcctcacttttcagggcttatataagaaagtgagcaaacacaaatcaaaatgcagcagcaaatactatcatcacccatctccttagttctattttataattcctcttctttttgttcatagctttgtaattatagtcttatttctctttaaggctcaataagaggaggtactattactacacttctctctacttttacttgtattttagcattaaaatcctaaaatccgttttaaattcaaaaataaacttagagatgtttaatctcgattcggtttttcggctttaggagaataattatatgaaattagtatggatatctttactagtttccattcaaatgattctgatttcaatctaatactctcactctttaattaaactatatgtagtgtaatttcacactgttaaatttctaccatgtcatgtatattagagttgcatagaaaattgtaaaacatccatttgaattcgaatgaaacaaaatgttttaaaataaaattttggtttttaaaagaaaaatctaaaactgaattatatcgtttaaccaagttgtaaaagtcataaaacgtagtatcttgtaaatcgctcttccacggtccaaatagacttctagtaataaacaagtaaaactaattttggtttcttac

SEQ ID NO: 4156 - DNA, 1024 bp, Arabidopsis thaliana
  misc_feature (1)..(1024): Ceres Promoter YP0117
gtcagtgagtcgattggatcacagtcctttatgataaaacaaactcataattattccaccgacaacatgcgttttaaattattttttcttaaattatattatattatattgatatcaacctagctaaaataattcggatggcgaaatcggacaatttttaatagaaaaaatgggtatgaagatagtctatgattccgttcttagcgactagagggacctgctcaaatctcccgggtgatacgcgatgtcaagctcaatagaaccccacaaccgacgagaccgagaaatccttgatttgggctagaagattttgaaataaatttaatatattctaagtaacttgcttaaattttttttcaaactctaaagacataactaacataaagtaaaaaaaaaaaagttaatacatgggaagaaaaaaattaaactaatgattagctctctaacgtgtttaatctcgtatcaagtttttttttaaaaattatattgctattaaaacattgtactattgtttctattttgtttagctattattcttgtgaaatgaaaagttgtgtttattcaattactaaatggcaatatttatcttggaaaactatacctctaattggattaggccctagacatcctctttagcttattgacgttaaaattattcccaaaactattaaagtttagtagtttgaaagatgcatcaagacctactcagataggtaaaagtagaaaactacagttagtgtgattatattttaaaatatataaaacaatcttattaaactaaatattcaagatatatactcaaatggaagataaaaacatttagtctgttaccactaccagcctagctagtcactaatagtcactttggaactgagtagatatttgcatcttgagttaccatggactcaaaagtccaaaaagagaccccgagtgaaaatgctaccaacttaataacaaagaagcatttacagcggtcaaaaagtatctataaatgtttacacaacagtagtcataagcaccattg

SEQ ID NO: 4157 - DNA, 1000 bp, Arabidopsis thaliana
  misc_feature (1)..(1000): Ceres Promoter YP0119
taccaaaaataaggagtttccaaaagatggttctgatgagaaacagagcccatccctctccttttccccttcccatgaaagaaatcggatggtcctccttcaatgtcctccacctactcttctcttctttctttttttctttcttattattaaccatttaattaatttccccttcaatttcagtttctagttctgtaaaaagaaaatacacatctcacttatagatatccatatctatttatatgcatgtatagagaataaaaaagtgtgagtttctaggtatgttgagtatgtgctgtttggacaattgttagatgatctgtccatttttttcttttttcttctgtgtataaatatatttgagcacaaagaaaaactaataaccttctgttttcagcaagtagggtcttataaccttcaaagaaatattccttcaattgaaaacccataaaccaaaatagatattacaaaaggaaagagagatattttcaagaacaacataattagaaaagcagaagcagcagttaagtggtactgagataaatgatatagtttctcttcaagaacagtttctcattacccaccttctcctttttgctgatctatcgtaatcttgagaactcaggtaaggttgtgaatattatgcaccattcattaaccctaaaaataagagatttaaaataaatgtttcttctttctctgattcttgtgtaaccaattcatgggtttgatatgtttcttggttattgcttatcaacaaagagatttgatcattataaagtagattaataactcttaaacacacaaagtttctttattttttagttacatccctaattctagaccagaacatggatttgatctatttcttggttatgtattcttgatcaggaaaagggatttgatcatcaagattagccttctctctctctctctagatatctttcttgaatttagaaatctttatttaattatttggtgatgtcatatataggatcaa

SEQ ID NO: 4158 - DNA, 999 bp, Arabidopsis thaliana
  misc_feature (1)..(999): Ceres Promoter YP0120
tagtttttgatttaatctacgtttttcttaatcataaatgggtaattattagtttttgcaaaatcaaaatccaaaaattgttctaaacactgcaaccatttaaggcctatatcactcagaaaatttctggtgggagaactaatcgtttgtcctttctaaatctcacatattagaatttagaattagtgtgctacataagaatattagttcagctcggaacaactattttttggtaaaacagagaacttaaacaaatgcattattttatcaacatgcattttgaattgaatataaaatttcataattgtaaagacataaattacataaaattttacatgaaaaaatagatatagaaagaaaatgaaactaactgatgatatgctctctaaattttttaatctcataacaagaattcaaattaattagttcatatttttggttaatataacatttacctgtctaagttggaactttcatttttttctgttttgtttagtcagtattcttaatgtgaaacggaaagttgaatttattcaaacttaaattcaatagcattaattaaaggcgaaagctattatctctacatgtggttcaaactagacatccaatttaattagcttattgacgttgaaatgttttccaaaactactatagtttggcaatttgaaagatgcatcagaactactcagacaggtaaaagtagaacctctagctgtgtgaattgtatgttagtccataaagaacatcttgtaaacttcatacttaagatatatattacaatatatacttgaatggtagataaaaacgattagtctgattgctagcatactcacaactatttggaaatgagtaagatattggcattctagagttactactatggagacaaaagtcgaataaaagagacctcacgtgaaaatgttacgagctagtaaaaaaagcatttacactaacggtaaaaaaagtatctataaatgtttacacaaggtagtagtcatt

SEQ ID NO: 4159 - DNA, 999 bp, Arabidopsis thaliana
  misc_feature (1)..(999): Ceres Promoter YP0121
ttggattttttttttgttgagtcagcagaccatctaatctctctttttccaccacagcctgctttctatgaagcatttgggcttacggttgtggaatcaatgacttgtgcactcccaacgtttgctacctgtcatggtggacccgcagagattatcgaaaacggagtttctgggttccacattgacccatatcatccagaccaggttgcagctaccttggtcagcttctttgagacctgtaacaccaatccaaatcattgggttaaaatctctgaaggagggctcaagcgaatctatgaaaggttggcccattctccttgacaggcttaacaatacaacttgtatcgcttcaacaagatgatggcttaataaggatttttgcatgtataggtacacatggaagaagtactcagagagactgcttaccctggctggagtctatgcattctggaaacatgtgtctaagctcgaaaggagagaaacacgacgttacctagagatgttttactcattgaaatttcgtgatttggttagtgtaacccactgttattcttttgatgtctacatctactttacttacattattcttttcttcggtttgcaggccaattcaatcccgctggcaacagatgagaactgatcatgacagggtaggattttatttcctgcactttctttagatcttttgtttgtgttatcttgaataaaaattgttgggttttgtttccttcagtggtttgattttggacttatttgtgttaatgttgttttggctgttctcttaatatcaataacaaataaatttactggttggtatctaagatctaacaatagttactatttttagaggtaaagacaccaaccttgttatattggtcagagagctaaaaccttgacttgttgggaaaacaaaactctaatgacagaaaatctgacatgatgccttataattcacagcctcatgttctacataaatcctaacaatagcactttgtttct

SEQ ID NO: 4160 - DNA, 1004 bp, Arabidopsis thaliana
  misc_feature (1)..(1004): Ceres Promoter YP0128
gataaactgataatggaaaagaacaaagaaaccagtttttaactatttgcatatgtaatttatttgttgcaaattatatttagttaaaatgtttcctctatttatatatatatatatcagtcaagcactatgtataagaaatgtcaatttataaatttttacatgtcctttaacagaaagaaaatgaatttttacatgtcattcatagagagtcactcgtttatttcttatatagagaataacacactcacatgcatatgcatgcaatatgatacattttatgacaaagataatcaacggaaacggtcaagacataatttgataaacaacttgcacgatgcacagatctgatcaaatatataactctttaacatatccaaaatattcaaaaagaaaaactcgatccaaactagcaacatcacgctcacgcggtaggctaaaaatttattaatctccaaaagtctttcttatgaacactgcaaacacaacaacttgaaaagtcatataggtttagatgatgacgcgtattggctatcgcttaccggagtggctcataaatacaataaacaatacgtaaaagtcaaagtcaaatatatttagtcaactataaccattaatcgggcaaaacctttagctgtcaaaacaacgtgaaaacgatatttgtatatatcatcaagaatcagtagataagagaatgatttaatcccctgactattacaattttggtgtaataaacagtctctattggtttttattctttgttttaatttctcatgacctatagagagaattaggtagtttcgaaaattggctaatcaacttttgaaaactactgtctactttgcttaaattctctacacttagtttcggataagataattgtcggactaatagttaatcccttgacaatctttgatattataaaaggtttagttaatctcttctctatataaatattcatacaccagctttcaaaaatatataatccaaacaccaaaaacaaa

SEQ ID NO: 4161 - DNA, 1001 bp, Arabidopsis thaliana
  misc_feature (1)..(1001): Ceres Promoter YP0137
gtggcacatgctgaaaccccgagcatctctccggaagacacgcgtcgttcgctccaaagaaaacagtcacagctgccggagaatctccgccgtcttcttctgccaccggaaaaactctctccaccactttcagtgcccacctcgtgttatatccactgtatcctcgtagcaccatatcagcctaataaaattttatgtatcaaattttaagacatagccgaaactacactatactagacaataataatatgatttgtttcctgaaaaattatggtttcatgagaaacattaatcatctataaaacaaattagctatggcatcgaagagttatcaatcaaaactgatgaatctttacttaatatatacaacatatctttaccttgcggcggagaagatcggcgagagaagcaccccagccaccgtcactaaaggattcttcagtgatggaatcaccaaagagaaaaaccttccgtctcatcatcttccacacaatcttcttgagaaaatctgagagataagaaaggtgtagtggttttgctgaagtgatcgtgtttgatttagtaaagaaatgctttatttattgttgggggaaacataaataaataaagtaaaagtggatgcactaaatgctttcacccactaatcaccgacctttcatggtttattgtgaaatacactcatagatagacatacaataccttatgtacgtaaataacattttatttgtcgacacttatgtaagtaacgcatagattattttctatgtgattgccactctcagactctcagtttcaaccaataataacaataactacaacaacattaatcataaacatatgctctggtttacaattaaagcttagattaagaaactgtaacaacgttacagaaaaaaaatgttatttacgttttgtaagattagtctctagaatcatcaccgttttttatatattaatgattctttcttatatataaaacctttctcgaaatacccatgaaa

SEQ ID NO: 4162 - DNA, 1001 bp, Arabidopsis thaliana
  misc_feature (1)..(1001): Ceres Promoter YP0143
atacaacagatggcagatatcgagttaaatacgtgaatcagccgttacgatattttaaaactagaaaattatttaaaaatattgcaaaataccatttaatttcattgttcataaaaaaaagaaattcaaaaacttaaaaactgattcaaaaatttggattaattctcattaacagtcttcaacactacaacaacatgtttctaatttattttatattttaataattaaacaatatatacgtctgcacattgttgctccgacataatctagtataaaaatagttgcagcatatgtgaaaagcaagcagcatttatcactcaatacttttaattttatctgttgtatgtattaaggttttgtagctttaagaaaacgcttataatataaaataacttctaaaagatatttcatgcgtatacaataaatatttgtgaaaaaacatttcgaaaacgtgtacaatatataaactattgtgttatcttttgacattcaaacaaatgttgacaatgtaattttatccatgatatgattggccaattagctgcgaggtaaaaatccgtatacgagtaaaagtaagataaaatttcgcaagaagatttttagcaggaaatctaagacaagtgtcatgaacgtgtcaatcaacaaacgaaaaggagaattatagaatccagattcgacgtaccacattaataaatatcaaaacattttatgttattttatttttgctctggcagttacactctttttcattgctccaataaaaaaatcactcgcatgcatgcatatatatacaccatagtaaactccgcctcttcttcattttaaaagtatcagtttacactgacacaatccttaactattttcctttgttcttcttcatctttattacacatttttttcaaggtaacaaataatctttttaagtcacttttatactctttaaatcttagattgatatatgaatgcatgttaatatttcaagatttataggtctaccaaac

SEQ ID NO: 4163 - DNA, 1003 bp, Arabidopsis thaliana
  misc_feature (1)..(1003): Ceres Promoter YP0144
aaacgttgcaagattattgattgtgagaaagagtgctcaaggtagtactgatttctgtaaagctcacggtggtgggaaacgatgttcttggggagatgggaaatgtgagaaaatttgctagaggaaagaagcggtttatgcgctgcgcataacactattatgtctcgggagaacaaagatggaagcaagagcggtttgattggaccgggactctttagtggccttgtttttggctctacttctgatcattctcagtctggagctagcgctgtctctgattgtactgattctgttgaacgaatacagtttgagaataggcagaagaacaagaagatgatgataccgatgcaggttctagtaccttcatcaatgaaatctccaagtaattcacatgaaggagaaacaaacatctatgacttcatggttccggaggagagagttcacggcggtgggctagtaatgtctttacttggtggctccattgatcgaaactgaaagccatttatggtaaaagtgtcacattctcagcaaaaacctgtgtaaagctgtaaaatgtgtgggaatctccgaatctgtttgtagccggttacgttatgctggatcaaaaactcaagatttgttggatattgttatgctggatcggtggtgaaaccacttcccggttgctaaataaataaacgtttttgttttataatctttttcactaaacggcagtatgggcctttagtgggcttcctttaagcgaccaatacaatcgtcgcaccggaatctactaccatttataggtttattcatgtaaaacctcggaaaatttgagagccacaacggtcaagagacaaaaacaacttgaagataaagggataaggaaggcttcctacatgatggacaacatttctttccacacaaattctcataataaaaatcttataatacaaatacttacgtcataatcattcaatctagtccccatgttttaaggtcctgtttcttgtctgatacaaat

SEQ ID NO: 4164 - DNA, 1004 bp, Arabidopsis thaliana
  misc_feature (1)..(1004): Ceres Promoter YP0156
ttggtttgcattgtgaagatttgtattaactatagaacattgaattgatggtgttaagttcttacacaagcgtgcttctcggtttgaactgtttcttttgtatgttgaatcagagcttagtttataggaaccagagtatctacttagtcattctctgatgctaagtgctaaggttctacctagttgccctctaggcccttatgttattgataacttatgaagctatttgaacacttgattcttaggagacctaagttggtacagccagatagagtgtatgttcttgttctctatgtgacaggatcaagctgccacacatagttcaagggtatgctctgtgtgggtttgctcagattgaggacaaatctatacaaggaagtagagtctttgacattttgatgttgtatgataagaagaagaaaggagagtaataaagaaagagaaaagggaaacagaaacacgtgggagaacatcccaaagaggaagcacacgcggatcttcatgcaaagctccccgattctcccatgtggtccctttctccctttgtccccctcctctttcttcttttctcattttactcctttttttaccattatacaacgaatcttttttatcataattttttggttttggtttattttccaataacactttcttggttacttcccattctcactttttcatataagaaactcactttgggaaacttatgtttgagaatgacaagtctttttagagaaagtgatgtaacaaatctaaagtgattatataataaccttgcacaatgtttttgattttttgtaagattcgaatattaggtttattattcgtagggaataaacttactttcaaaagcgttcataagttaatactttcatatatgatcataagtacggacactattgttttttgtttgtttgtgtttattctaaaagaaagtagcttttaattgaaatgtcctcggaggcacagtttaaagttcgagtgtaacagtttctaaggca

SEQ ID NO: 4165 - DNA, 1000 bp, Arabidopsis thaliana
  misc_feature (1)..(1000): Ceres Promoter YP0158
ttattagattaatagattgcattgcattgcttgtgctttcaatttacaaattgtctcccaactccatcgacacatctctttttgtgtatataagattcagacttgttatattttttttataaatatgttattagcatcttaagttaaattgattttttatatctgcattaaggattacacgactatatttgcgattgtgtgttggttaaaatataatttaggattgtctttaactacatttaggattatatgactatatttggttaaatataaaatctagctgtgattattagtattcaaaaataagtagcctaaccaattaaaacaacggctattggggcaaattagaacattttagtgtgtccaaaatataatggtcattaggtcatattcctcctagcttcatcgcagcataattgaatgattgccttatttagaagagcttttccactttcccaaaatctaggtgggatctttttgttttgaccttcatttttcttgtttaccatttttagctaaattatttacgattacaaaagatatcaaaagttggatcataatacaatttatagacttactgtagaaaattcgtatgtacaagtacaacaaattcttcataataaattttgaaaattctattacaaatgttgtaagaaatagaatttgaaatatatataaactaaggagaaaaaaaaagagaacatgcattgctctagtcagagtggaccaacatcaacgagataagataacataaaaaccaactcaccataactaaaaacatcccaagagatccaacgattcatatcaaacacaaaaacatcgaacgatcagatttaaaccatctctggtatctccaaaacacaaacacttttttttttcttttgtctgaatggaacaaaagcatgcgacatctctgtgtctttatcttctctctcctcttcttgaaaaactgaacctttaattctttcttcacatctcctttagctttctgaagctgcta

SEQ ID NO: 4166 - DNA, 1005 bp, Arabidopsis thaliana
  misc_feature (1)..(1005): Ceres Promoter YP0188
gattggtatgaaatttcggagaccaacaaaaaaaactttattgagcttggagtgaagctatatatatggggcaagatcataatatgtttatatcggccttttcgttaactgaaaataatagttttgagaaatatatcaaatggtaaacagacatcatctttgaaaaataccatcaatgaagttaatattgttattggcatatggtttacccatcttaattttaatgcaaccaaacaaacaagaaacaaaaactgtataagatacaaggtgttttacgattttccgtcttaaaaccgaaatatttttgttcctacgactttaaacggactttgcttaagttgtgtgcatgtaagctcgtcgtccctcgattgtcatcaacattcaccaatatcagcctctatcacacgagtgaaggtggtgattcggcttaatgaaaacagagaaatatttcaatatgattcctattaaattttaaatcttttttctcaatctctagattttcattaaaagcatcatgatttttttccactatgttcatatatctctatcacagttttaggtacattgtagaaattggataagatacgtcatacgtctaacatgaatttggtctagcaaggaaggtttgagataataagtgaaaagaaaacacaagataataaattataatttataaatgctttatagtattgaaaaataagatgattttttttttttttaataccggattggctgatccacttatgatgactcaaatgttattaagtttcaagacaatttatgatgacacaaatcacaatgagtcaatagtagccacgaagccagaaaaaaaaaatgtactacaaaaagataatgatagtacaaaatgatacgtcgtactgccacatgtacgacacaactcgattaccaaaaagcagagccatccaaccataaaactcaaaacacacagattccactggcgtgtgctctcctcacttcactcgtccttgaaacttgaggtactga

SEQ ID NO: 4167 - DNA, 1002 bp, Arabidopsis thaliana
  misc_feature (1)..(1002): Ceres Promoter YP0190
taaatagtgacattggtaagaagaaaaaaaacactattaaatagtgaaaaaatggtttataactctcttaattaacattacttattattgctagcacctaaaatctcccacaaaatatttgttgtaaaacacaaatttacaaaatgattttgtttttaaattagtaacacatgttcatatatacgttaataagaacataccctatatgattttatataaaaaaatttctttgagacgtcttattcttttttctttaataatatgcaattgtgagagtttggatttgaatggtagcattagaagcaaacttgaaccaaacatatttcatgaagtcaaacttgaaccaatgtgatcactaatcacagtgttcgcagtgtaaggcatcagaaaatagaagaagggacatagctatgaatcatataatcttgacacatgttttataggttttaggtgtgtatgctaacaaaaaatgagacagctttcttctaatagacttaatatttgggctaaatgtaccacagttgtgaatttcttacaaaaatgggccgagctacaaaaaactacaggcccactctcaactcttatcaaacgacagcgttttacttttttaaaagcacacactttttgtttggtgtcggtgacggtgagtttcgtccgctcttcctttaaattgaagcaacggttttgatccgatcaaatccaacggtgctgattacacaaagcccgagacgaaaacgttgactattaagttaggttttaatctcagccgttaatctacaaatcaacggttccctgtaaaacgaatcttccttccttcttcacttccgcgtcttctctctcaatcacctcaaaaaaatcgatttcatcaaaatattcacccgcccgaatttgactctccgatcatcgtctccgaatctagatcgacgagatcaaaaccctagaaatctaaatcggaatgagaaattgattttgatacgaattagggatctgtgtgttgaggac

SEQ ID NO: 4168 - DNA, 995 bp, Arabidopsis thaliana
  misc_feature (1)..(995): Ceres Promoter YP0212
agtcgattggtacactcttaatttaattagagtaagagatcaacaaaaatatagaattttctttatatcgaagtgctacgaccttatatatatagaaaaaaaagcataggtgaatctctaaattgagattgtgctgtagtaaacatattaagtttttagtttttttaagaaatgaatctttttgttgattaattcaaactagtagtcattaagattccggagattccaatttagaaaagtcaaagattcaaagaacaagtccaggtccacatgttgaatccgattcatcatccactcatccttcatatcttcctccaccgtctccgcccaaaaaatcaataacaataaaaaatcctaaaaaaacatatttgattttgaaaaaactttatcatatattatattaattaaatagttatccgatgactcatcctatggtcagggccttgctgtctctgacgtccttaattatcattatttttaaatttgtctctctcagaaaattacgccacaatcttcctctttcccttttccgaaaacagctaatatttgtggacctaaactaaataacgtagcctctagattttatataattactaatactatatgctactacttgttattatttactccaatcatatatgataccaatcaagaatcactacataagtagaaaactttgcaatgagtccattaattaaaattaagaataaacttaaaattttatggtattttaagattccctttggattgtaatgacaagaaatcagcaaattagtcgtaactcgtaagaataaacaagatcaatttttactttctttacaaagattccgttgtaattttagaaatttttttttgtcactgtttttttatagattaatttatctgcatcaatccgattaagaagtgtacacatgggcatctatatatatctaacaggtaaaacgtgtatgtacatgcataaggttttacgtgcttctataaatatatgtggcagt

SEQ ID NO: 4169 - DNA, 1024 bp, Arabidopsis thaliana
  misc_feature (1)..(1024): Ceres Promoter YP0214
ccagtcgattggcgcctcgcatgcctatcatatttaaccgtcaataatggatttggcggttttggtaggccgggtcaaccggattaaaagaaaacggtttggagtccttccttgcaattgaattttcacacattcgggttttgtgatttctctgtcataatgggcccggcacatatggttcataacccatgtgggcctatggtataatttttccaattaaaactattgttaggtcgataaaacaaaaaacaataaaaacgagtggaatacacataccaaaaagaatgtgatgaacattagtaattttattttgatggttaatgaaaaacaaaataaatgcatcttggcatcttccgttggaaagcgcaaatagggcagattttcagacagatatcactatgatggggggtgagagaaagaaaacgaggcgtacctaatgtaacactacttaattagtcgttagttataggactttttttttgtttgggcctagttataggatcataaggtaaaaatgaagaatgaatattagattagtaggagctaatgatggagttaagtatgcacgtgtaagaactgggaagtgaaacctcctgtatggtgaagaaactatacaacaaagccctttgttggtgtatacgtattaatttttattcttttatcacaagcgatacgtatcttaagacataataaatatatatcttactcataataaatatcttaagatatatatacagtatacacctgtatatatataataaataggcatatagtagaaattaatatgagttgttgttgttgcaaatatataaatcaatcaaaagatttaaaacccaccattcaatcttggtaagtaacgaaaaaaaagggaagcaagaagaaccacagaaaagggggctaacaactagacacgtagatcttcatctgcccgtccatctaacctaccacactctcatcttctttttcccgtgtcagtttgttatataagctctcactctccggtatatttccccattgcactgga

SEQ ID NO: 4170 - DNA, 911 bp, Arabidopsis thaliana
  misc_feature (1)..(911): Ceres Promoter YP0263
atctagctgtggattccaccaaaattctggcagggccatgatctaaaaactgagactgcgcgtgttgttttgcagtgatttgtatttcatatttgcaccatcctacacagtccacttggtatcgtaaccaaacataaggagaacctaattacattattgttttaatttcgtcaaactggtttttaccttttagttacatagttgattcttcatttgttttagtagttatggagcacaataatgtgcaacaaagaaagatcatagtggattaatatgttgagaggtcagaaattcttggttaacaaaaaaaagttacaaggactgagattttgggtgggagaaagccatagcttttaaaacatgattgaacttaaaagtgatgttatggtttgaggggaaaaaggttgatgtcaactaagatagttgaagtaatgtcttaaactaaagtaaaccaccggtccaaccgtggtccggaagcatctctggtatgatttatcctaaaaatcaaaatagtagaaacatactttaaatatatacattgatcggacgaaaattgtaaactagtatagtttcaaaaactagttgaacaggttatgtaccttaaacatttatttcaaacttaaacactaaagaacatatatgaatagaagtttatataaattactatatatctaccataaatctcttataattatgatgtcacgatgaggaagtgttgaaacgttaaaatgccaaaatataagcatgcgacggaattttggcagaagattgtagagttgtaatctgtcgcaatcattactcgtgctagcatttttcattttcccttcatttgtggataacgcacgatataacattctacacaccaacaagattctataaaaacgcaaaggttgtctccatagaatatcgtc

SEQ ID NO: 4171 - DNA, 999 bp, Arabidopsis thaliana
  misc_feature (1)..(999): Ceres Promoter YP0275
aaacattaatatgtagtaactatgggcgtatgctttactttttaaaatgggcctatgctataattgaatgacaaggattaaacaactaataaaattgtagatgggttaagatgacttatttttttacttaccaatttataaatgggcttcgatgtactgaaatatatcgcgcctattaacgaggccattcaacgaatgttttaagggccctatttcgacattttaaagaacacctaggtcatcattccagaaatggatattataggatttagataatttcccacgtttggtttatttatctattttttgacgttgaccaacataatcgtgcccaaccgtttcacgcaacgaatttatatacgaaatatatatatttttcaaattaagataccacaatcaaaacagctgttgattaacaaagagattttttttttttggttttgagttacaataacgttagaggataaggtttcttgcaacgattaggaaatcgtataaaataaaatatgttataattaagtgttttattttataatgagtattaatataaataaaacctgcaaaaggatagggatattgaataataaagagaaacgaaagagcaattttacttctttataattgaaattatgtgaatgttatgtttacaatgaatgattcatcgttctatatattgaagtaaagaatgagtttattgtgcttgcataatgacgttaacttcacatatacacttattacataacatttatcacatgtgcgtctttttttttttttactttgtaaaatttcctcacttttaagacttttataacaattactagtaaaataaagttgcttggggctacaccctttctccctccaacaactctatttatagataacattatatcaaaatcaaaacatagtccctttcttctataaaggttttttcacaaccaaatttccattataaatcaaaaaataaaaacttaattagtttttacagaagaaaagaaaaca

SEQ ID NO: 4172 - DNA, 981 bp, Arabidopsis thaliana
  misc_feature (1)..(981): Ceres Promoter YP0285
gggattatatatgatagacgattgtatttgcgggacattgagatgtttccgaaaatagtcatcaaatatcaaaccagaatttgatgtgaaaacactaattaaaacatataattgacaactagactatatcatttgttaagttgagcgttgaaagaaaatgaaagagtgtagactgtagtacgtatgagtttcccaaaagatggtgcttgaatattattgggaagagactttggttggttcggttgaatgaagatttttacctgccatgttgatagagaaaggcaaataaatgtaggggtcgatgtctaacgtaaagactggatcaaccaagagtcctcctcctcgtcttcaccaaaaaaaaagagtcctcctcgtggaaacttatttcttctccagccaagatctcatctcatctcttcactctatgaaatataaaggaatcttatggtttttctaaaaactatagtacgtctatataccaaaggaaacaatataaaatcagttaatctgataaattttgagtaaataataaagttaactttgtacttacctatatcaaactaattcacaaaataaagtaataataacaaagaatttttagtagatccacaatatacacacacactatgagaaatcataatagagaattttaatgattttgtctaactcatagcaacaagtcgctttggccgagtggttaaggcgtgtgcctgctaagtacatgggctctgcccgcgagagttcgaatctctcaggcgacgtttcttttgttttcggccataaaggaaaaagcccaattaacacgtctcgcttataagcccataaagcaaacaatgggctgtctctgtctcactcacacacgcgttttcctactttttgactatttttataaccggcgggtctgacttaattagggttttctttaataatcagacactctctcactcgtttcgtcaacattgaacacagacaaaaccgcgt

SEQ ID NO: 4173 - DNA, 996 bp, Arabidopsis thaliana
  misc_feature (1)..(996): Ceres Promoter YP0286
gaaaacaatcataggttacgctattatcatcgaaaggtatgtgatgcatattcccattgaaccagatttccatatattttatttgtaaagtgataatgaatcacaagatgattcaatattaaaaatgggtaactcactttgacgtgtagtacgtggaagaatagttagctatcacgcatacatatatctatgaataagtgtgtatgacataagaaactaaaatatttacctaaagtccagttactcatactgatttcatgcatatatgtattatttatttatttttaataaagaagcgattggtgttttcatagaaatcatgatagattgataggtatttcagttccacaaatctagatctgtgtgctatacatgcatgtattaattttttccccttaaatcatttcagttgataatattgctctttgttccaactttagaaaaggtatgaaccaacctgacgattaacaagtaaacattaattaatctttatatgagataaaaccgaggatatatatgattgtgttgctgtctattgatgatgtgtcgatattatgcttgttgtaccaatgctcgagccgagcgtgatcgatgccttgacaaactatatatgtttcccgaattaattaagttttgtatcttaattagaataacatttttatacaatgtaatttctcaagcagacaagatatgtatcctatattaattactatatatgaattgccgggcacctaccaggatgtttcaaatacgagagcccattagtttccacgtaaatcacaatgacgcgacaaaatctagaatcgtgtcaaaactctatcaatacaataatatatatttcaagggcaatttcgacttctcctcaactcaatgattcaacgccatgaatctctatataaaggctacaacaccacaaaggatcatcagtcatcacaaccacattaactcttcaccactatctctcaatctctcgtttcatttcttgacgcgtgaaaa

SEQ ID NO: 4174 - DNA, 1000 bp, Arabidopsis thaliana
  misc_feature (1)..(1000): Ceres Promoter YP0337
taatttttttatttttggaactaacacttattagtttaggtttccatcacctatttaattcgtaattcttatacatgcatataatagagatacatatatacaaatttatgatcatttttgcacaacatgtgatctcattcattagtatgcattatgcgaaaacctcgacgcgcaaaagacacgtaatagctaataatgttactcatttataatgattgaagcaagacgaaaacaacaacatatatatcaaattgtaaactagatatttcttaaaagtgaaaaaaaacaaagaaatataaaggacaattttgagtcagtctcttaatattaaaacatatatacataaataagcacaaacgtggttacctgtcttcatgcaatgtggactttagtttatctaatcaaaatcaaaataaaaggtgtaatagttctcgtcatttttcaaattttaaaaatcagaaccaagtgatttttgtttgagtattgatccattgtttaaacaatttaacacagtatatacgtctcttgagatgttgacatgatgataaaatacgagatcgtctcttggttttcgaattttgaactttaatagttttcttttttagggaaactttaatagttgtttatcataagattagtcacctaatggttacgttgcagtaccgaaccaattttttacccttttttctaaatgtggtcgtggcataatttccaaaagagatccaaaacccggtttgctcaactgataagccggtcggttctggtttgaaaaacaagaaataatctgaaagtgtgaaacagcaacgtgtctcggtgtttcatgagccacctgccacctcattcacgtcggtcattttgtcgtttcacggttcacgctctagacacgtgctctgtccccaccatgactttcgctgccgactcgcttcgctttgcaaactcaaacatgtgtgtatatgtaagtttcatcctaataagcatctcttaccacattaattaaaaa

SEQ ID NO: 4175 - DNA, 1000 bp, Arabidopsis thaliana
  misc_feature (1)..(1000): Ceres Promoter YP0356
ttagttcattgaaacgtcaactttttacttgcaaccactttgtaggaccattaactgcaaaataagaattctctaagcttcacaaggggttcgtttggtgctataaaaacattgttttaagaactggtttactggttctataaatctataaatccaaatatgaagtatggcaataataataacatgttagcacaaaaaatactcattaaattcctacccaaaaaaaatctttatatgaaactaaaacttatatacacaataatagtgatacaaagtaggtcttgatattcaactattcgggattttctggtttcgagtaattcgtataaaaggtttaagatctattatgttcactgaaatcttaactttgttttgtttccagttttaactagtagaaattgaaatttttaaaaattgttacttacaataaaatttgaatcaatatccttaatcaaaggatcttaagactagcacaattaaaacatataacgtagaatatctgaaataactcgaaaatatctgaactaagttagtagttttaaaatataatcccggtttggaccgggcagtatgtacttcaatacttgtgggttttgacgattttggatcggattgggcgggccagccagattgatctattacaaatttcacctgtcaacgctaactccgaacttaatcaaagattttgagctaaggaaaactaatcagtgatcacccaaagaaaacattcgtgaataattgtttgctttccatggcagcaaaacaaataggacccaaataggaatgtcaaaaaaaagaaagacacgaaacgaagtagtataacgtaacacacaaaaataaactagagatattaaaaacacatgtccacacatggatacaagagcatttaaggagcagaaggcacgtagtggttagaaggtatgtgatataattaatcggcccaaatagattggtaagtagtagccgtctatatcatccatactcatcataacttcaacct

SEQ ID NO: 4176 - DNA, 1000 bp, Arabidopsis thaliana
  misc_feature (1)..(1000): Ceres Promoter YP0374
aagacacccgtaaatgttgtcatgtagaagaaactagaaacgttaaacgcatcaaatcaagaaattaaattgaaggtaatttttaacgccgcctttcaaatattcttcctaggagaggctacaagacgcgtatttctttcgaattctccaaaccattaccattttgatatataataccgacatgccgttgataaagtttgtatgcaaatcgttcattgggtatgagcaaatgccatccattggttcttgtaattaaatggtccaaaaatagtttgttcccactactagttactaatttgtatcactctgcaaaataatcatgatataaacgtatgtgctatttctaattaaaactcaaaagtaatcaatgtacaatgcagagatgaccataaaagaacattaaaacactacttccactaaatctatggggtgccttggcaaggcaattgaataaggagaatgcatcaagatgatatagaaaatgctattcagtttataacattaatgttttggcggaaaattttctatatattagacctttctgtaaaaaaaaaaaaatgatgtagaaaatgctattatgtttcaaaaatttcgcactagtataatacggaacattgtagtttacactgctcattaccatgaaaaccaaggcagtatataccaacattaataaactaaatcgcgatttctagcacccccattaattaattttactattatacattctctttgcttctcgaaataataaacttctctatatcattctacataataaataagaaagaaatcgacaagatctaaatttagatctattcagctttttcgcctgagaagccaaaattgtgaatagaagaaagcagtcgtcatcttcccacgtttggacgaaataaaacataacaataataaaataataaatcaaatatataaatccctaatttgtctttattactccacaattttctatgtgtatatatatacccacctctctcttgtgtatttg

SEQ ID NO: 4177 - DNA, 998 bp, Arabidopsis thaliana
  misc_feature (1)..(998): Ceres Promoter YP0377
tataaaccattcctataacaccatatttaaacataacaatgaattgcttggatttcaaactttattaaatttggattttaaattttaatttgattgaattatacccccttaattggataaattcaaatatgtcaactttttttttgtaagatttttttatggaaaaaaaaattgattattcactaaaaagatgacaggttacttataatttaatatatgtaaaccctaaaaagaagaaaatagtttctgttttcactttaggtcttattatctaaacttctttaagaaaatcgcaataaattggtttgagttctaactttaaacacattaatatttgtgtgctatttaaaaaataatttacaaaaaaaaaaacaaattgacagaaaatatcaggttttgtaataagatatttcctgataaatatttagggaatataacatatcaaaagattcaaattctgaaaatcaagaatggtagacatgtgaaagttgtcatcaatatggtccacttttctttgctctataacccaaaattgaccctgacagtcaacttgtacacgcggccaaacctttttataatcatgctatttatttccttcatttttattctatttgctatctaactgatttttcattaacatgataccagaaatgaatttagatggattaattcttttccatccacgacatctggaaacacttatctcctaattaaccttactttttttttagtttgtgtgctccttcataaaatctatattgtttaaaacaaaggtcaataaatataaatatggataagtataataaatctttattggatatttctttttttaaaaaagaaataaatcttttttggatattttcgtggcagcatcataatgagagactacgtcgaaaccgctggcaaccacttttgccgcgtttaatttctttctgaggcttatataaatagatcaaaggggaaagtgagatataatacagacaaaacaagagaaaaga

SEQ ID NO: 4178 - DNA, 999 bp, Arabidopsis thaliana
  misc_feature (1)..(999): Ceres Promoter YP0380
acaagtaccattcacttttttacttttcaatgtatacaatcatcatgtgataaaaaaaaaaatgtaaccaatcaacacactgagatacggccaaaaaatggtaatacataaatgtttgtaggttttgtaatttaaatactttagttaagttatgattttattatttttgcttatcacttatacgaaatcatcaatctattggtatctcttaatcccgctttttaatttccaccgcacacgcaaatcagcaaatggttccagccacgtgcatgtgaccacatattgtggtcacagtactcgtcctttttttttcttttgtaatcaataaatttcaatcctaaaacttcacacattgagcacgtcggcaacgttagctcctaaatcataacgagcaaaaaagttcaaattagggtatatgatcaattgatcatcactacatgtctacataattaatatgtattcaaccggtcggtttgttgatactcatagttaagtatatatgtgctaattagaattaggatgaatcagttcttgcaaacaactacggtttcatataatatgggagtgttatgtacaaaatgaaagaggatggatcattctgagatgttatgggctcccagtcaatcatgttttgctcgcatatgctatcttttgagtctcttcctaaactcatagaataagcacgttggttttttccaccgtcctcctcgtgaacaaaagtacaattacattttagcaaattgaaaataaccacgtggatggaccatattatatgtgatcatattgcttgtcgtcttcgttttcttttaaatgtttacaccactacttcctgacacgtgtccctattcacatcatccttgttatatcgttttacttataaaggatcacgaacaccaaaacatcaatgtgtacgtcttttgcataagaagaaacagagagcattatcaattattaacaattacacaagacagcgagattgtaaaagagtaagagagagag

SEQ ID NO: 4179 - DNA, 1000 bp, Arabidopsis thaliana
  misc_feature (1)..(1000): Ceres Promoter YP0381
cacggtcaaagtattgctaacatggtcattacattgaaaaagaaaattaattgtctttactcatgtttattctatacaaataaaaatattaaccaaccatcgcactaacaaaatagaaatcttattctaatcacttaattgttgacaattaaatcattgaaaaatacacttaaatgtcaaatattcgttttgcatacttttcaatttaaatacatttaaagttcgacaagttgcgtttactatcatagaaaactaaatctcctaccaaagcgaaatgaaactactaaagcgacaggcaggttacataacctaacaaatctccacgtgtcaattaccaagagaaaaaaagagaagataagcggaacacgtggtagcacaaaaaagataatgtgatttaaattaaaaaacaaaaacaaagacacgtgacgacctgacgctgcaacatcccaccttacaacgtaataaccactgaacataagacacgtgtacgatcttgtctttgttttctcgatgaaaaccacgtgggtgctcaaagtccttgggtcagagtcttccatgattccacgtgtcgttaatgcaccaaacaagggtactttcggtattttggcttccgcaaattagacaaaacagctttttgtttgattgatttttctcttctctttttccatctaaattctctttgggctcttaatttctttttgagtgttcgttcgagatttgtcggagattttttcggtaaatgttgaaattttgtgggatttttttttatttctttattaaacttttttttattgaatttataaaaagggaaggtcgtcattaatcgaagaaatggaatcttccaaaatttgatattttgctgttttcttgggatttgaattgctctttatcatcaagaatctgttaaaatttctaatctaaaatctaagttgagaaaaagagagatctctaatttaaccggaattaatattctccgaccgaagttattatgttgcaggct

SEQ ID NO: 4180 - DNA, 999 bp, Arabidopsis thaliana
  misc_feature (1)..(999): Ceres Promoter YP0384
tttaaaaaattggataaaacaccgataaaaattcacatttgcaaattttattcagtcggaatatatatttgaaacaagttttgaaatccattggacgattaaaattcattgttgagaggataaatatggatttgttcatctgaaccatgtcgttgattagtgattgactaccatgaaaaatatgttatgaaaagtataacaacttttgataaatcacatttattaacaataaatcaagacaaaatatgtcaacaataatagtagtagaagatattaattcaaattcatccgtaacaacaaaaaatcataccacaattaagtgtacagaaaaaccttttggatatatttattgtcgcttttcaatgattttcgtgaaaaggatatatttgtgtaaaataagaaggatcttgacgggtgtaaaaacatgcacaattcttaatttagaccaatcagaagacaacacgaacacttctttattataagctattaaacaaaatcttgcctattttgcttagaataatatgaagagtgactcatcagggagtggaaaatatctcaggatttgcttttagctctaacatgtcaaactatctagatgccaacaacacaaagtgcaaattcttttaatatgaaaacaacaataatatttctaatagaaaattaaaaagggaaataaaatatttttttaaaatatacaaaagaagaaggaatccatcatcaaagttttataaaattgtaatataatacaaacttgtttgcttccttgtctctccctctgtctctctcatctctcctatcttctccatatatacttcatcttcacacccaaaactccacacaaaatatctctccctctatctgcaaattttccaaagttgcatcctttcaatttccactcctctctaatataattcacattttcccactattgctgattcatttttttttgtgaattatttcaaacccacataaaaaaatctttgtttaaatttaaaacca

SEQ ID NO: 4181 - DNA, 998 bp, Arabidopsis thaliana
  misc_feature (1)..(998): Ceres Promoter YP0385
actcaacaataggacaagccaaaaaaattccaattattgtgttactctattcttctaaatttgaacactaatagactatgacatatgagtatataatgtgaagtcttaagatattttcatgtgggagatgaataggccaagttggagtctgcaaacaagaagctcttgagccacgacataagccaagttgatgaccgtaattaatgaaactaaatgtgtgtggttatatattagggacccatggccatatacacaatttttgtttctgtcgatagcatgcgtttatatatatttctaaaaaaactaacatatttactggatttgagttcgaatattgacactaatataaactacgtaccaaactacatatgtttatctatatttgattgatcgaagaattctgaactgttttagaaaatttcaatacacttaacttcatcttacaacggtaaaagaaatcaccactagacaaacaatgcctcataatgtctcgaaccctcaaactcaagagtatacattttactagattagagaatttgatatcctcaagttgccaaagaattggaagcttttgttaccaaacttagaaacagaagaagccacaaaaaaagacaaagggagttaaagattgaagtgatgcatttgtctaagtgtgaaaggtctcaagtctcaactttgaaccataataacattactcacactccctttttttttctttttttttcccaaagtaccctttttaattccctctataacccactcactccattccctctttctgtcactgattcaacacgtggccacactgatgggatccacctttcctcttacccacctcccggtttatataaacccttcacaacacttcatcgctctcaaaccaactctctcttctctcttctctcctctcttctacaagaagaaaaaaaacagagcctttacacatctcaaaatcgaacttactttaaccaccaaatactgattgaacacacttgaaa

SEQ ID NO: 4182 - DNA, 1000 bp, Arabidopsis thaliana
  misc_feature (1)..(1000): Ceres Promoter YP0396
catagtaaaagtgaatttaatcatactaagtaaaataagataaaacatgttatttgaatttgaatatcgtgggatgcgtatttcggtatttgattaaaggtctggaaaccggagctcctataacccgaataaaaatgcataacatgttcttccccaacgaggcgagcgggtcagggcactagggtcattgcaggcagctcataaagtcatgatcatctaggagatcaaattgtatgtcggccttctcaaaattacctctaagaatctcaaacccaatcatagaacctctaaaaagacaaagtcgtcgctttagaatgggttcggtttttggaaccatatttcacgtcaatttaatgtttagtataatttctgaacaacagaattttggatttatttgcacgtatacaaatatctaattaataaggacgactcgtgactatccttacattaagtttcactgtcgaaataacatagtacaatacttgtcgttaatttccacgtctcaagtctataccgtcatttacggagaaagaacatctctgtttttcatccaaactactattctcactttgtctatatatttaaaattaagtaaaaaagactcaatagtccaataaaatgatgaccaaatgagaagatggttttgtgccagattttaggaaaagtgagtcaaggtttcacatctcaaatttgactgcataatcttcgccattaacaacggcattatatatgtcaagccaattttccatgttgcgtacttttctattgaggtgaaaatatgggtttgttgattaatcaaagagtttgcctaactaatataactacgactttttcagtgaccattccatgtaaactctgcttagtgtttcatttgtcaacaatattgtcgttactcattaaatcaaggaaaaatatacaattgtataattttcttatattttaaaattaattttgatgtattacccctttataaataggctatcgctacaacaccaataac

SEQ ID NO: 4183 - DNA, 1514 bp, Arabidopsis thaliana
  misc_feature (1)..(1514): Ceres Promoter p13879
tttcgatcctcttcttttttaggtttcttgatttgatgatcgccgccagtagagccgtcgtcggaagtttcagagattaaaaccatcaccgtgtgagttggtagcgaattaacggaaagtctaagtcaagattttttaaaaagaaatttatgtgtgaaaagaagccgttgtgtatatttatataatttagaaaatgtttcatcattttaattaaaaaattaataatttgtagaagaaagaagcattttttatacataaatcatttaccttctttactgtgtttttcttcacttacttcatttttacttttttacaaaaaagtgaaaagtaaattacgtaattggtaacataaattcactttaaatttgcatatgttttgttttcttcggaaactatatcgaaaagcaaacggaaagaacttcacaaaaaaccctagctaactaaagacgcatgtgttcttcttattcttcatatatcctctgtttcttgtgttctgttttgagtcttacattttcaatatctgactctgattactatatctaaaagggaacatgaagaacttgagaccatgttaaactgtacaatgccttcaaacatggctaactaaagatacattagatggctttacagtgtgtaatgcttattatctttaggttttttaaatcccttgtattaagttatttaccaaattatgttcttgtactgcttattggcttggttgttgtgtgctttgtaaacaacacctttggctttatttcatcctttgtaaacctactggtctttgttcagctcctcttggaagtgagtttgtatgcctggaacgggttttaatggagtgtttatcgacaaaaaaaaaatgtagcttttgaaatcacagagagtagttttatattcaaattacatgcatgcaactaagtagcaacaaagttgatatggccgagttggtctaaggcgccagattaaggttctggtccgaaagggcgtgggttcaaatcccactgtcaacattctctttttctcaaattaatatttttctgcctcaatggttcaggcccaattatactagactactatcgcgactaaaatagggactagccgaattgatccggcccagtatcagttgtgtatcaccacgttatttcaaatttcaaactaagggataaagatgtcatttgacatatgagatatttttttgctccactgagatatttttctttgtcccaagataaaatatcttttctcgcatcgtcgtctttccatttgcgcattaaaccaaaaagtgtcacgtgatatgtccccaaccactacgaattttaactacagatttaaccatggttaaaccagaattcacgtaaaccgactctaaacctagaaaatatctaaaccttggttaatatctcagcccccttataaataacgagacttcgtctacatcgttctacacatctcactgctcactactctcactgtaatcccttagatcttcttttcaaatttcaccattgcactggatg

SEQ ID NO: 4184 - DNA, 1954 bp, Arabidopsis thaliana
  misc_feature (1)..(1954): Ceres Promoter p326
gtgggtaaaagtatccttctttgtgcatttggtatttttaagcatgtaataagaaaaaccaaaatagacggctggtatttaataaaaggagactaatgtatgtatagtatatgatttgtgtggaatataataaagttgtaaaatatagatgtgaagcgagtatctatcttttgactttcaaaggtgatcgatcgtgttctttgtgatagttttggtcgtcggtctacaagtcaacaaccaccttgaagttttcgcgtctcggtttcctcttcgcatctggtatccaatagcatacatataccagtgcggaaaatggcgaagactagtgggcttgaaccataaggtttggccccaatacggattccaaacaacaagcctagcgcagtcttttgggatgcataagactaaactgtcgcagtgatagacgtaagatatatcgacttgattggaatcgtctaagctaataagtttaccttgaccgtttatagttgcgtcaacgtccttatggagattgatgcccatcaaataaacctgaaaatccatcaccatgaccaccataaactcccttgctgccgctgctttggcttgagcaaggtgtttccttgtaaagctccgatctttggataaagtgttccactttttgcaagtagctctgacccctctcagagatgtcaccggaatcttagacagaacctcctctgccaaatcacttggaagatcggacaatgtcatcatttttgcaggtaatttctccttcgttgctgctttggcttgagcacggtgcttctttgtaaagctccgatctttggataagagcggatcggaatcctctaggaggtgccagtcccttgacctattaatttatagaaggttttagtgtattttgttccaatttcttctctaacttaacaaataacaactgcctcatagtcatgggcttcaaattttatcgcttggtgtatttcgttatttgcaaggccttggcccattttgagcccaataactaaatctagccttttcagaccggacatgaacttcgcatattggcgtaactgtgcagttttacctttttcggatcagacaagatcagatttagaccacccaacaatagtcagtcatatttgacaacctaagctagccgacactactaaaaagcaaacaaaagaagaattctatgttgtcattttaccggtggcaagtggacccttctataaaagagtaaagagacagcctgtgtgtgtataatctctaattatgttcaccgacacaatcacacaaacccttctctaatcacacaacttcttcatgatttacgacattaattatcattaactctttaaattcactttacatgctcaaaaatatctaatttgcagcattaatttgagtaccgataactattattataatcgtcgtgattcgcaatcttcttcattagatgctgtcaagttgtactcgcacgcggtggtccagtgaagcaaatccaacggtttaaaaccttcttacatttctagatctaatctgaaccgtcagatatctagatctcattgtctgaacacagttagatgaaactgggaatgaatctggacgaaattacgatcttacaccaaccccctcgacgagctcgtatatataaagcttatacgctcctccttcaccttcgtactactactaccaccacatttctttagctcaaccttcattactaatctccttttaaggtatgttcacttttcttcgattcatactttctcaagattcctgcatttctgtagaatttgaaccaagtgtcgatttttgtttgagagaagtgttgatttatagatctggttattgaatctagattccaatttttaattgattcgagtttgttatgtgtgtttatactacttctcattgatcttgtttgatttctctgctctgtattaggtttctttcgtgaatcagatcggaa

SEQ ID NO: 4185 - DNA, 2016 bp, Arabidopsis thaliana
  misc_feature (1)..(2016): Ceres Promoter p32449
gatcggccttcttcaggtcttctctgtagctctgttacttctatcacagttatcgggtatttgagaaaaaagagttagctaaaatgaatttctccatataatcatggtttactacaggtttacttgattcgcgttagctttatctgcatccaaagttttttccatgatgttatgtcatatgtgataccgttactatgtttataactttatacagtctggttcactggagtttctgtgattatgttgagtacatactcattcatcctttggtaactctcaagtttaggttgtttgaattgcctctgttgtgatacttattgtctattgcatcaatcttctaatgcaccaccctagactatttgaacaaagagctgtttcattcttaaacctctgtgtctccttgctaaatggtcatgctttaatgtcttcacctgtctttctcttctatagatatgtagtcttgctagatagttagttctacagctctcttttgtagtcttgttagagagttagttgagatattacctcttaaaagtatccttgaacgctttccggttatgaccaatttgttgtagctccttgtaagtagaacttactgggaccagcgagacagtttatgtgaatgttcatgcttaagtgtcgaacgtatctatctctactatagctctgtagtcttgttagacagttagttttatatctccatttttttgtagtcttgctagttgagatattacctcttctcttcaaagtatccttgaacgctcaccggttatgaaatctctacactatagctctgtagtcttgctagatagttagttctttagctctctttttgtagcctagttctttagctctccttttgtagccttgctacagagtaagatgggatattacctccttgaacgctctccggttatgaccaatttgttgtagctccttgtaagtagaacttaggatagagtgagtcaactttaagaaagaacctagtatgtggcataaccagattgcaggctctgtctcggctacagtaacgtaactctatagctctttgttttgttcagaaagaaccagtgattggatgattcgtccttagaaactggacctaacaacagtcattggctttgaaatcaagccacaacaatgcctatatgaaccgtccatttcatttatccgtttcaaaccagcccattacatttcgtcccattgataaccaaaagcggttcaatcagattatgttttaattttaccaaattctttatgaagtttaaattatactcacattaaaaggattattggataatgtaaaaattctgaacaattactgattttggaaaattaacaaatattctttgaaatagaagaaaaagcctttttccttttgacaacaacatataaaatcatactcccattaaaaagattttaatgtaaaattctgaatataagatattttttacaacaacaaccaaaaatatttatttttttccttttttacagcaacaagaaggaaaaacttttttttttgtcaagaaaaggggagattatgtaaacagataaaacagggaaaataactaaccgaactctcttaattaacatcttcaaataaggaaaattatgatccgcatatttaggaagatcaatgcattaaaacaacttgcacgtggaaagagagactatacgctccacacaagttgcactaatggtacctctcacaaaccaatcaaaatactgaataatgccaacgtgtacaaattagggttttacctcacaaccatcgaacattctcgaaacattttaaacagcctggcgccatagatctaaactctcatcgaccaatttttgaccgtccgatggaaactctagcctcaacccaaaactctatataaagaaatcttttccttcgttattgcttaccaaatacaaaccctagccgccttattcgtcttcttcgttctctagttttttcctcagtctctgttcttagatcccttgtagtttccaaatcttccgataaggcct

SEQ ID NO: 4186 - DNA, 667 bp, Arabidopsis thaliana
  misc_feature (1)..(667): Ceres Promoter PD1367
acagttttcttttctcatcttacaacaagtttccaggaggatagagacataaacgaagctcggattgtatcgttctttttagcttttattcacatccgaaagtcctgtagtttagattctgttatcttgcggttttgagttaatcagaaacagagtaatcaatgtaatgttgcaggctagatctttcatctttggaaatttgtttttttctcatgcaatttctttagcttgaccatgagtgactaaaagatcaatcagtagcaatgatttgatttggctaagagacatttgtccacttggcatcttgatttggatggttacaacttgcaagacccaattggatacttgctatgacaactccaactcaagagtgtcgtgtaactaagaaccttgactaatttgtaatttcaatcccaagtcatgttactatatgtttttttgtttgtattattttctctcctacaattaagctctttgacgtacgtaatctccggaaccaactcctatatccaccatttactccacgttgtctccaattattggacgttgaaacttgacacaacgtaaacgtatctacgtggttgattgtatgtacatatgtacaaacgtacacctttctcctctttcacttcatcacttggcttgtgaattcattaattcctgcgaa

SEQ ID NO: 4187 - DNA, 1836 bp, Oryza sativa
  misc_feature (1)..(1836): Ceres Promoter p530c10
gcctctcgaccacgagtttagcacttgtgcaacatatatgcgtgcgatgaacatctactgatgcgccatgcgaattttagcgttcgttcatgacgcttccaacggcacagaggctgagcagcagcatgcatgcatggctcttgtgaaaacaaaaaaggttactggtaaatgacatgctgctgtagctagctagcagaatgcaaggcccatgcatatgcaatgctatgcgacaagtacagtaccagcatgtatggtagccagctaactaatctatcagcagaggcagcaagctcgtgcatggtgtgatgcacttctctccagtaatctagtggtaattttcacccaaagcgttgctcatatggacagtaattagtaatattaccaaggttcacaatcccgttacctgaccaaatactactcacgaatggtatctctggttttcgttaaaaccgttggtaaaccagcaaaaatagacaaaatttgtcaaaattttaaattttagttttttttttttaacttagccgggaaaccttgaagtttgtgctgtcgagctgtcctgggaaggacggttttggttgggattgtgaaccctggttactgcacttcatttttgaacagatattagtgcaacagacaaatgccaacgcatttttttctgtttaccggcaagctgaagcttttacgatccccatacagccgttgctgcaaacctgccaagaaagagcagcagaaacaggtgtcattttgtggtggaaagccaagtaaagtaaacagaagatggaagatagtgaggaccagggagtgaggcaggggacacatggcccacgcctccctgcacattttcgtgtataaatacaggtggatgcatcgctctcccagcatccatcggttctctgctctgttcatccatagagtttcctcctcttctcctttagtgcaaggtagagaagagcatgtgtgtgtgtgtgtgtgtgtgaactgtgaagtgcagagtgcttctgtagttctgtgttatgtccatagtgatcttgttaggattgttgctatggatgcatgatgttatggttgatctctgaattacagtagggacttttctgagatctctggattagtggggggtgctaaatttttttctggttgcatcagcttgggtttctggtattggtgtgggttcttgctctgaattttggttcagaatgtcgatttgtttgtgtttgttctctgaagttgagagtagctatgatccatccagcacagaactgcaggtcctgcctgccggctgcatatacaggacatgccattttgcaagctctgggcttatggtttctcttttggagttcttcttcttgcatgatctgtgttctctaacaaaggaagcaagatttagcaactttattcagagacaagaaaaggatctggcaaccttttgtttctgttttatcctactcgtaaagattgttatttaagcaaaaatttcccaaaagttttaaatataatttccatgatgtgccactctcatgtccttgaacctggcactcattatgggctcctcagaagtgctgtagctaatgtcactaatcttttgtatctttgttcatagtcttgtattttatgatgcttatccctttgtgctttccatgtttgatgtccaaatgtcatggcaatgtttttgacttctagtaggggttttagtacctttttgttagataagtacatccaaattctgtttatttattcaaaaatcattctgtttattcactgaaaacatttgtccattcaatggactcataaactgtctgtgtttttcaggcttgaggatccatctagaagatagca

SEQ ID NO: 4188 - DNA, 3000 bp, Oryza sativa
  misc_feature (1)..(3000): Ceres Promoter pOsFIE2-2
gcttaacacatgaactaccaaaatatactgatcactttgttctagtcatacataccttaagtcattttattctgcagtgtttggattggagggagcattctagcatcccttgggtcgttccagcaaatgtggttctccaaagcagagtaagcacaacacagtattttaggttatgtttcccctatctcgtcacggacagctcacaagttaatgtgatttatctcactatagatacgaagaacatggagtatcctacatccaaaggaagtgcccatgaagttgtggagcatcgctacgatttgtgaccaaatttgggtgcatgtgggcaatcgtattacagccaccctgttgttgatctatatcgactattatccgacgatatttatcattatattatgactagttagtttgtagattttgagagggcaacataagaagcaatccagcttaacctgttatgttcttgatggtagattctagttcatgtgttgaatctgttctccctgctgtagaatgtatcgagttgctgctctctactctgtacttttagaataccttttcaatcatttggagtcagctgattgttgtactacttatacgccacctgattagtcatgtcaacaattaaacttgagcactggttaagttaagagtggcctgattgtagttgataatcacattttattcgtagacattgtatgctggatctttatcagccaccgtcagatcatcctctgtaataaatcttcatcagacgtgtgtgccaatcgcaaggaacacgaaatgcatccgaaatgttactctgagttaatcaatactataattcttggtcaaattaattatttatatctataaagtttaaattaaatttaggaaaatgaattcatgcaaatcttgtggtaagttgtcaatttcataaaaaatccagcttactactccctttttaggagtgtgttgtggctgcacacttctgccttttgatatatacggttctattctcggtgtactcctttattattattaaaacaatcccagttacttggtaagtgctaatcacgaatcaaagtcaacataacaaatcatgtgcgtacagctataactcgattacacaaacaacaaaattcatatttgaacataaatccagttgtagcatatctggtagtataaagttttttttttgtatagaagagttttaatttctgtaagttttggaaagcatttaatcctagaaattgtagtgtagctcaactaaaaaataaatgaacttgaatcgaaattgggttgtatcataaatctttaccactcaaacgaatatttatcctaaaccacaaatgactcttttcatcaaggaatgttttgttttcagcattttaaaaaaaaacttttctaatatggttttcatgtttcgttcttttgaaatttaacatctatttaatttgcacggctccataaattcaacggatacatattctgaataattactaaggaggcatatatcggctctcttaatacaaccgcttgtttctcaaaatttattttgagttttgtctacacattctcaaggacggtacaaacacactatagatgttcacaattttttttttctaaagttgattgatggacaaatgtttgaacatataaacatataagcactgaatatttgcttatgcaggaggtatttatatcaagttcgatactttactaccatagtccctaggacactaaaatgccttcaatgatctgatgaagcctaagagagaatattgatcagtggagcgacttgcaactacacatggcacaagtagactagacacggtatatattcatattaacttgttaaaattttactacttaacagttcacttgtggtgcatccatatcaattcttacttacacaatatttgtaaaaacaacctaacactataggatgacctagacaacctttatgtcaatcacacttagaagatgatcgtctttttaataaataatgtgtactacacaccatgctctccatatagatcaagatctacaaacccttccacttataaaccttaccaccaaaaactcattaagttgcttcatttatctatgctattaagaaaaaaacttatttcgtttatgccatttctagaaatggctagtcacactattcacaatattatataataaataaaagtttcaaatattcatccaccaaaaatcatcaagtcgtgggacttatatgttaattagagaagtccctttgggtgcaatcgattttggaaaccctaaattttttctatacatagaagagagagatgtctagttgcaattgcttttgcgatgtgccaaccacccttctagctttcatccacgtctacttaattgccattcttcttcttctttttcttcactattactacctcctatcttagcgaatcttcttcttcttcactattactacctcccaccttagtgaattcatcctcattgttcacaatgacattgctaagttaactaggtatgctaagtacacaattagaatataacctagagcctttgtttccatcatacttaaaagatgacatttttatatagataaagtgtgctactcacaaggcttactatatatatgtatgatacacacaaactccacaacccaaaactctttcaagttgtgtggcccatctatgctattaaaaagcccatttagcccatccaacatgagaaaccctagggttttttccctataaaagatacctaggttattgttgcttttccaccccgcccgccgccgctccctattcctatttaatcccatctctcttcctcatcaccgctctcctctctccaggcaagaggtacgcactttttgtttcggatttgaaatctttgcttcgttttactatcattggtcataagttcttttttgaagatgtttgagaataagtttatcattgagattatcgtcacttgtgataggaagtacgcaacctcaagccggacaagacgtgagcaaag

SEQ ID NO: 4189 - DNA, 2023 bp, Oryza sativa
  misc_feature (1)..(2023): Ceres Promoter pOsMEA
gagagcagaacatagtagccgctgttttctgggggtgcaatttgtgcaagatcgctatccttatggaccatgcaagcaccaagcaatattaagccaggtccaacagcggtcttggggaattcagaaatgagcttaaaaacctccttgagctggccagctcagccaaggaggtccatcatgcatgtgcatgctcaatacttggaattattgcaaaatgatcggtcattgactggaagactttgcgcccttcctcagccaaccttatgtggctgcatgcatagagtaccaacaggaaggtagcgtttgttggaataaggtttgcatccagcatgtccttgtagagcttcaaagcctcagcaccttggcccatgaaggccatatccagctaattgcattccatgagaccacattcttgctatccatactgttgaagtgaagatgctccgagcttcggaaatgcttccacactatgcatacatgtcaatgagcactgtcatgacataaacattgggccccaagtcctcctcagcgataatcctatgcagccactttcccagggacaaagctccaagctgtgcacacgctgaaagagagctagaaatgatgattggatttggtcacacgctaagtaccagcatttgctcaaagagggcaattgccatctccgtccagccattctaggcataccctggtattattgctttccatgattccgattccgtggtcttctatggcatcgcattgaaggccttccttgcagactccatatcatttaacctacagtacaatatggtaattgctgtcgacactggagaattcgcagtaaatccagacttgagaggaccatgtaagcattgatcaagcagttcattcccaaacagactatacgggatcagtgccagtgctcgagtttggcttcaattccaaggccatcaacccaataaacagattaactgatgaaccaaccatgcaattcgccgagcaaacatagattaagcattgtaggcaaccaaatctggattctccatcaagtcaaagagacgccatgcagaattccacatccccgctgtatacaccgagatcaaccggtcagaacatgctcatactccgccaaccctctcttcagaacatgctcatactccgccaaccctctcttctctgcaagaggcatcctccccaattccccattgttatatctgttgctggtaagaccgttgccagcgtggttgtgtcagaccgaacagactctgcactcgccatcctcacgaacgactccagggcctccgaaccaggaagcccggccggccatcagcgtgttccacataacggtatccggcgactgcacagtgtcgaacaccttgcgtgcgtggtcacctctggacagcatgaagcgtacaggctacagcttggccaatgcggacgccacgaacgtgtcggcggcgtaacccgcgcgtgcagcgcgccgcgcgcgggctgcggagtcggttggagacgacacgccgccgccatgagagcaatgagcgaggtggcggcgaaggcgaaggagaagtagtcgaggcaagcggaagagaaggcggcagcggagaaagcgatcggggcggcggaggaggtgggtgggagggagggacgcgtagcggaggtcggaggaggagggagctgaggtttccggggcgggggtcgagagggtagtgtacggaggcgagggacacggcgaggatctggtcgaggtagcgcagtgtgaaggaaagcgcgatgaggcggagggcgccggcgaagagcggcgcggcggatagcgggaggaggcggcgccggcggggtctcatccgattggaaacagattgggaagggggagggggtaggaatacgtggcgtcggcagtattaggtagagagagaaaccctttccatcctttgtctcttagccccgaaggagagagaaaaatcagaaaaaaaaaaccctccgcgtgtgggggaagcagagctccggacgctggcgccgctcgcgccaccgcacccgcaccgcc

SEQ ID NO: 4190 - DNA, 2034 bp, Oryza sativa
  misc_feature (1)..(2034): Ceres Promoter pOsYp102
gaacgacccaaacgcgtaaatggtggtactggtttccctgctttgccgagtaccagcagccacgaagaacgttacacaatcgagtacaaaatctataagagcaagtttaatagcatagccaaatactacctctaaatcatctatagccaatttaatagttcatttattcaataattacttataaacatatactacaatcattaatatatggtcttacttcttatacacataatattttggagtccgtgttacagctggctataaatataagggattttggttggatgtggtacatcctattataatgaatctagacatgaaacctgtccaaattcatcgtgctaggatacgccacatctaaccaaaatctcttatctttagggatggagagagtaataattaaatgaagctaggtagagtttcccggtcaatacgcttgcgtgtgcttataagagcatggccaacagtttcccgatactcttcccaatatcagttttgaggagttttgttggaaaaaatcgctccaacagtagacctaaatcacccctaaaagcttggcgtttccaaacccgcatatttcgttctccacttgtagggaagagactcggcgcccaatccttcaaccgcatgcacttcgcgcgcgctgtgtgaaaattttcctaccaggttcttctttgtgcgttcgtctacctgtgagtcaatccatcacgccagcagcctcatcttccccgcagctgtctgggaaagcagccatggctcccccaagcttccccagcgtcgacatttttttctcagcggcagcgccagacccatctccaacccaattgggcggaccttcgtcggcgctcccccagcaccaccaccgactcgaatcggccgtcgcccctattcatctccaatcgtccctcgaccctaccgcatcctgcagcacagcctgtctctcgcgtcagactggcgctgcgctccccccggtaatgtgcaggcgacaaaggccccatgcgatgcgaccagcagccggcgacaaccggaggtgcccagtcgctggccttcatcgaatcatcgtgcacctcggtcggagtcgatttctgattgttgctgctgctcaaatctggagcttgctattgctgagaactgcttggtggtggtactggaaatttgttgtttgctggctgatgaaaactgttgttctttgctgctaaaaactgctgcttgctagtactgaaaagtactattgcagctgctgaaatatcttgctgcttgctgctgaaaacttcaagttgttaacaccgttcacactaaaaaagctgaaattttttttctgggctgaaaaccccattgttgatgattgcagaaccaatatttttccatgtaaaatacaggagatcgtggtaataatcaagtgaaatatcattttggggcaaatactcagatcgtacctgaagccaatggaaacattgttcaatgcttaaactgtcagttatgatgtcaaagagattgatcactgaatgtcctgaaaggagccgtgaggaggatgcagcattgcagcgtgcgcgagcgtgagtggaggagaggaatgacgattctgttggtagttgtcgatgtggcctactttttttgttttgaggattaaattttgggaatctcttggagataaaaggtattctcataccttaaatcctttttagagatctaaaaaaaatgatttaggggattgaattttgggtggctgttggtgatgctctaagttgcacatcctggggaaaaacctccctaatccatcagcaaaccgatcaaccacccacgacaagtcgacgccaccgttttttttttctccctcctaagtcctaaccccacaaaaatcccgcgaactttcgtctcaccacgcgccgcgtgccccctacaaataccaaacaacacccaccacgtccactcacaaaccacgcaggaaacctcagaaaatcaccgtacgcgacgcgggcccaagaaaaccccgacagaaaccgcgcagcagcaacaccaccaccggcgtcggag

SEQ ID NO: 4191 - DNA, 1877 bp, Oryza sativa
  misc_feature (1)..(1877): Ceres Promoter pOsYp285
ggcccgagttaaacgatcttccacgtgtcagcgaatcctagtcgttcgatgaatctgaatctgacttgtggtggttggacggccacgtgttaaaaaagggaaacgtccgcatcacccgatgctgggacatttgcaatttcgatccagctgtagattgaccagttgttactctcttttttttaacaccatacaaacgtaatactccctctgtcccaaaatataagtattttttttaacctcggttcagtcttcgaggtgctactttgaccaataatatttataaaaataagatgttttaaataaagagagttgcatattatgatagctcgtttaatgataaacaaagtaccatcaaatttacatgattaatctttttaatttatttgctattaatagttaaaatttaaaaagtttgacttcacactgttctaaaaatacttatattttgggacggagggagtacacattagagcaggtacaatagcagactagtagccagctataaacatattttaatgagataaaagatgagagagaacagcgggctacagatctgtagccagctgcagcacggactccaagacattgtgtgtgtatgacaggtgggaccatatattaatagtacagtaagtaactattgtatgaattggctattagattagctataggtgaattgtagctagtagtgggctatactattgaacttactcttatatctctcaatatctccagaaaactaggacgatatatattgatattaacaaagtcatcatagatatctcgctatcgacatatatattacctatcactgaaaaaataattaatcataaatgcaagcacatatactacgttcaacactgaatgtaggtagattggtagacgggttccaccgcaagaaaagcattgcaccagtgaagaaagaaacatcggaatttgtatgtagtttgttgtttgatgaattcttttgattaaaaaaaactaaaatcagagttgattcagttaatggtgttgcctacgatatacttccatatcatgatatcactgtagactatgaatcatatctttaattaaaactaaatcaagaaattaagtatgagacctcaactcaatgaagaatttctagttgaaaaacattcctagtgtgcgttcggatggaggtagggatcttctctccgttcatataaaaccggatggttcattagaacatgattaattaagcaacagttaatctaaaaataaattaatattttttaagaaatttttgtatagagatcttttgaaaaaaatacattggttagaaagcatactaataaaaagagaaaaataagaacatagtactatagtagaaaatgagaacttggagtatttgagaggatgggaaataagaagattaagaagatgcgtaaagtgaacggttaacgcatgattgattaattaaatattaattattttaaatttggaaaataaattagtatgatttttaagcaacatatatatatatatatatatatatatagaaaaacatagttttagaaaatataagcgtgtaaaacgatatgcaggaacgaaacgttgagcattcaaaatttcaaattgaacatatgaatcaagagagaataaaaaaagaggccttctaggctggcatggacaattggacatgttttcaactagggtttcaagcttcgagcatccacttttgtccttgcaaactttatacggcaaggcccgtgaatctagccccccacaccaccccacccgcccgcgccgcgcggccgcctcgcctcccctcccttctcctcctctccgcccccgccgccaggccgtccacctccgccgtctcctcccccattcgcacccaaggcgctggcgcggaaggc

SEQ ID NO: 4192 - DNA, 3000 bp, Arabidopsis thaliana
  misc_feature (1)..(3000): Ceres Promoter PR0924
atctataacgagttaacatgttgccagtttgaatcaagaagcttggatgatgaatgaatggatcggtttgtggtacaattcttaaaattgtagtagaggagacagagaaaaaacatgataagactttggtatttacaacttgacggagacaagacagtaagccaaatctgtcacaaaaacactcaaactcttttctcagtgttttgagtttaaagagagacttattcacttcccctttcgtaacacttatttgtctcccaaccaaacagtttctgtcctttcccttgtcctcccacgtgcatctttatatctcatgacttttcgtttctagatcttgaataatgtcttagtggattaggtttgttgtcggtaaattaggtgaccgtttttttcttatatttggaagatcgcgggatgaagcagatactgagtttcagggcatacacacctaatttgaaaatcattgttagtccaatttcactttaatcttgtttacaaaaaaattgatctgaaaatgttgatgggataagtaaaaatgtaagttttgctagtagtcatgatataataatagcaaaaccagatcaattttgagcaaaaggaagaaacaaaaaacagatcgatcccacgagcaagactaagtgtaaagtggttcccacaagagccatatggatatggtccttcaacttttaaagcccattacttcagtggtcgacccgacattacgccacgagtagtcacgcacgcacgactccgttcacgtgacattcacgttgatatttccccctctactctcttctgcttggttgatctaaaaaacatgaagagaccaacctaatttcatattaatatatgatatagacttcatactcaacagtcactttcgtaatccaaatccatatcttacgaaattagttcttaataaaggttgtggattaagttataatattgtgttaagagttaagacacagcatataaccttgtaccaacagtgctttattcttaaatggaaacaaaacatatgtcaatgtcaagcatacagctaaaatatcattatctaatattaagagtaaaacaagataattaaaaattgaaacaacaccatatttttatagctttacttatcgtatttttctagtcttcatggtaattgtgttgctttattttgtttataaatgaatttggttcgaccagatagtctaatatcagtttttaaacactggttttaataaaatcatatgtcggcaattcaacctgttacgttgtatgattgtatcctagtcaaataggggaggaggtactagtcgtttcaattagtttacgtaatcaatccaaagaaactataagctataaagatcctcaatttgttggttacaataaaaacaacagttgtcaaaatttatgtttataaaaagtaataactatgttccttcccatatagagcaaagtacctcaggataggcaaaccgtacttaatagcccttattcataatttgatccaactcttccccacaaaattgcaactgatgaagtcaatacttgtatagtgagtcaagctataaatgtctagtgatagttttgtctcttaaaaggttaacaaaagttatgacaagctgaaaaatcagagtttgctaggagtattacttacagttatcagtttaagtatcacatttatagtattgtatacaatgattcttaaattccaccttttccgtgcgaaaccaaattttctattggaaacatagaatgtaaacaaaaatatgggacgttgtccgttccaacattaaccaaacttgtctattactaatattcgtgttggtttgatgttggatgtctaaattcgttgaatcatgtgtctcttgacgaaatatgcatcttcttatttcttagtatagatgcactttatcattcttttagtacatgcttaatttttttttttaaaatatgttgattgtcatattgccaaaagtatgaattaaagacgcacatctaacacaagttagcagccgtaaatccttccataaatttattttgcaagttttgctcattatataatgagcggaatttatgatataatcgtttgtaataatgttatgttttgatcaaaatttgaaattaaaagtaggtgagaacttgttatacagtgtagataaggtggatcttgaatataaaaataaaatttataagatgtatttaaagcagaaaagcataaaactttagataaaataatgtaaaaatgtgttagcatcaatgttgggatattggccgacccgaacttaatcaatgtcggaagccattacttctctcccaaaagacctttttccttcggagaactaggaacttcctcactacctttcgcttaacgtgaaagccataaatttcatatattcataaaaatcagaaaatctaaaactgtttagtatcacctgtttttggtatagactattggttttgtgttacttcctaaactatatgatttcgtacttcattggatcttatagagatgaatattcgtaaaaagataagttatctggtgaaacgttacttcagtcatgttgggtctagatttacatactactatgaaacattttaagataataattatcctagccaactatatgttctatattatgggccaagaagatatagaactaaaagttcagaatttaacgatataaattactagtatattctaatacttgaatgattactgttttagttgtttagaataaatagtagcgtgttggttaagataccatctatccacatctatatttgtgtgggttacataaaatgtacataatattatatacatatatatgtatatttttgataaagccatatattactccttgacctctgcccccatttccttttactataaataggaatactcatgatcctctaattcagcaatcaacaccaacgaacacaaccttttccaaagccaataataaaagaacaaaagcttttagtttcatcaaagacgaagctgccttagaa
